United States Patent 8,586,006 (ORGAN-SPECIFIC PROTEINS AND METHODS OF THEIR USE) - sequence listing, part 17

SEQ ID NO: 32127 - protein, 1335 aa, Homo sapiens
  VARIANT 1223, 1233, 1296, 1304, 1321: Xaa = Any Amino Acid
MVFEFLENVRKATVCCGQGAALLLAAAPWDSGVLCPFSPSGGAPPEECPVSGDVRRTGLSPPCTRGHPSRADIGAPPAPGRWSERTQTGITAGTQLAGTEAASLGADPRSCCSERRQELIALEHRVLVIGKVHLLGAGTSFGSSDHGEIGRSLQPARQKAVPPPPAAPVLRMDRNREAEMELRRGPSPTRAGRGHEVDGDKATCHTCCICGKSFPFQSSLSQHMRKHTGEKPYKCPYCDHRASQKGNLKIHIRSHRTGTLIQGHEPEAGEAPLGEMRASEGLDACASPTKSASACNRLLNGASQADGARVLNGASQADSGRVLLRSSKKGAEGSACAPGEAKAAVQCSFCKSQFERKKDLELHVHQAHKPFKCRLCSYATLREESLLSHIERDHITAQGPGSGEACVENGKPELSPGEFPCEVCGQAFSQTWFLKAHMKKHRGSFDHGCHICGRRFKEPWFLKNHMKAHGPKTGSKNRPKSELDPIATINNVVQEEVIVAGLSLYEVCAKCGNLFTNLDSLNAHNAIHRRVEASRTRAPAEEGAEGPSDTKQFFLQCLNLRPSAAGDSCPGTQAGRRVAELDPVNSYQAWQLATRGKVAEPAEYLKYGAWDEALAGDVAFDKDRREYVLVSQEKRKREQDAPAAQGPPRKRASGPGDPAPAGHLDPRSAARPNRRAAATTGQGKSSECFECGKIFRTYHQMVLHSRVHRRARRERDSDGDRAARARCGSLSEGDSASQPSSPGSACAAADSPGSGLADEAAEDSGEEGAPEPAPGGQPRRCCFSEEVTSTELSSGDQSHKMGDNASERDTGESKAGIAASVSILENSSRETSRRQEQHRFSMDLKMPAFHPKQEVPVPGDGVEFPSSTGAEGQTGHPAEKLSDLHNKEHSGGGKRALAPDLMPLDLSARSTRDDPSNKETASSLQAALVVHPCPYCSHKTYYPEVLWMHKRIWHRVSCNSVAPPWIQPNGYKSIRSNLVFLSRSGRTGPPPALGGKECQPLLLARFTRTQVPGGMPGSKSGSSPLGVVTKAASMPKNKESHSGGPCALWAPGPDGYRQTKPCHGQEPHGAATQGPLAKPRQEASSKPVPAPGGGGFSRSATPTPTVIARAGAQPSANSKPVEKFGVPPAGAGFAPTNKHSAPDSLKAKFSAQPQGPPPAKGEGGAPPLPPREPPSKAAQELRTLATCAAGSRGDAALQAQPGVAGAPPRPTLHQTGAGGRGAXEAPGHPQHLXDVHSKGLCDPLPGMGCQRPWVGAQRDTPDAGPARRVRLHRVRKELPPARPPQGPHAGTLSGVXVRWASGFXSSYHLRRRPQTRERPFXHRYRPDSASEKGNL

SEQ ID NO: 32128 - protein, 1334 aa, Homo sapiens [sequence omitted]

SEQ ID NO: 32129 - DNA, 17 bp, Homo sapiens
gatccgcaaacaggaat

SEQ ID NO: 32130 - DNA, 17 bp, Homo sapiens
gatccacccatttccct

SEQ ID NO: 32131 - DNA, 17 bp, Homo sapiens
gatcattagttgctact

SEQ ID NO: 32132 - DNA, 17 bp, Homo sapiens
gatcgtctcctctgcct

SEQ ID NO: 32133 - DNA, 17 bp, Homo sapiens
gatcctttttccttgcc

SEQ ID NO: 32134 - DNA, 17 bp, Homo sapiens
gatctgtttcttctttt

SEQ ID NO: 32135 - DNA, 17 bp, Homo sapiens
gatcagttttggaatgt

SEQ ID NO: 32136 - DNA, 17 bp, Homo sapiens
gatcagcagtgccttgt

SEQ ID NO: 32137 - DNA, 17 bp, Homo sapiens
gatcggcaggagtccta

SEQ ID NO: 32138 - DNA, 17 bp, Homo sapiens
gatcccaagactgtaga

SEQ ID NO: 32139 - DNA, 17 bp, Homo sapiens
gatccccaaaagccact

SEQ ID NO: 32140 - DNA, 17 bp, Homo sapiens
gatctcgtttctaccaa

SEQ ID NO: 32141 - DNA, 17 bp, Homo sapiens
gatcctgagccaaggag

SEQ ID NO: 32142 - DNA, 17 bp, Homo sapiens
gatcatgtcagggctgt

SEQ ID NO: 32143 - DNA, 17 bp, Homo sapiens
gatcaagaaagtcagga

SEQ ID NO: 32144 - DNA, 17 bp, Homo sapiens
gatccctcttttaataa

SEQ ID NO: 32145 - DNA, 17 bp, Homo sapiens
gatctgcagccagcaga

SEQ ID NO: 32146 - DNA, 17 bp, Homo sapiens
gatcaaaaagttggact

SEQ ID NO: 32147 - DNA, 17 bp, Homo sapiens
gatcaactcgtagtgta

SEQ ID NO: 32148 - DNA, 17 bp, Homo sapiens
gatcaccaaaggactga

SEQ ID NO: 32149 - DNA, 17 bp, Homo sapiens
gatcttcagggtggtcc

SEQ ID NO: 32150 - DNA, 17 bp, Homo sapiens
gatcatttttgcacaag

SEQ ID NO: 32151 - DNA, 17 bp, Homo sapiens
gatcagatggttgtata

SEQ ID NO: 32152 - DNA, 17 bp, Homo sapiens
gatccccccaggccatg

SEQ ID NO: 32153 - DNA, 17 bp, Homo sapiens
gatccttcctacaggtc

SEQ ID NO: 32154 - DNA, 17 bp, Homo sapiens
gatcagcctggccacca

SEQ ID NO: 32155 - DNA, 17 bp, Homo sapiens
gatcaccttcaagggtg

SEQ ID NO: 32156 - DNA, 17 bp, Homo sapiens
gatcagcagcacatttc

SEQ ID NO: 32157 - DNA, 17 bp, Homo sapiens
gatctcatctgggaaag

SEQ ID NO: 32158 - DNA, 17 bp, Homo sapiens
gatccacgggaactgca

SEQ ID NO: 32159 - DNA, 17 bp, Homo sapiens
gatccttgccaacaagt

SEQ ID NO: 32160 - DNA, 17 bp, Homo sapiens
gatcaagtttataatgt

SEQ ID NO: 32161 - DNA, 17 bp, Homo sapiens
gatccattcgcctcccg

SEQ ID NO: 32162 - DNA, 17 bp, Homo sapiens
gatcagacagcccctac

SEQ ID NO: 32163 - DNA, 17 bp, Homo sapiens
gatccttcaactctgtg

SEQ ID NO: 32164 - DNA, 17 bp, Homo sapiens
gatctcttgcaagttta

SEQ ID NO: 32165 - DNA, 17 bp, Homo sapiens
gatcctgagtgggttgt

SEQ ID NO: 32166 - DNA, 17 bp, Homo sapiens
gatcctcagtctgtaat

SEQ ID NO: 32167 - DNA, 17 bp, Homo sapiens
gatcctttcaaattgta

SEQ ID NO: 32168 - DNA, 17 bp, Homo sapiens
gatctttcatgctctta

SEQ ID NO: 32169 - DNA, 17 bp, Homo sapiens
gatcccaccactgctct

SEQ ID NO: 32170 - DNA, 17 bp, Homo sapiens
gatccatccaggactct

SEQ ID NO: 32171 - DNA, 17 bp, Homo sapiens
gatcatcacagtttgag

SEQ ID NO: 32172 - DNA, 17 bp, Homo sapiens
gatccctgctttctcca

SEQ ID NO: 32173 - DNA, 17 bp, Homo sapiens
gatctcaacatttttga

SEQ ID NO: 32174 - DNA, 17 bp, Homo sapiens
gatcatcttaaaaacat

SEQ ID NO: 32175 - DNA, 17 bp, Homo sapiens
gatcagtttcacattgt

SEQ ID NO: 32176 - DNA, 17 bp, Homo sapiens
gatcctttttgtccctg

SEQ ID NO: 32177 - DNA, 17 bp, Homo sapiens
gatctcactatattact

SEQ ID NO: 32178 - DNA, 17 bp, Homo sapiens
gatccaaggagtatgac

SEQ ID NO: 32179 - DNA, 17 bp, Homo sapiens
gatctgttctcatttct

SEQ ID NO: 32180 - DNA, 17 bp, Homo sapiens
gatcattgtcatttgtg

SEQ ID NO: 32181 - DNA, 17 bp, Homo sapiens
gatctagaattccatga

SEQ ID NO: 32182 - DNA, 17 bp, Homo sapiens
gatctctgtctgcaatg

SEQ ID NO: 32183 - DNA, 17 bp, Homo sapiens
gatcatttcacaataaa

SEQ ID NO: 32184 - DNA, 17 bp, Homo sapiens
gatcattgacaaattgc

SEQ ID NO: 32185 - DNA, 17 bp, Homo sapiens
gatccaacagaaatcct

SEQ ID NO: 32186 - DNA, 17 bp, Homo sapiens
gatcagtatcaaaagca

SEQ ID NO: 32187 - DNA, 17 bp, Homo sapiens
gatcataaagtcttatg

SEQ ID NO: 32188 - DNA, 17 bp, Homo sapiens
gatcattttgttttata

SEQ ID NO: 32189 - DNA, 17 bp, Homo sapiens
gatccgccatttagcat

SEQ ID NO: 32190 - DNA, 17 bp, Homo sapiens
gatctgccttacataat

SEQ ID NO: 32191 - DNA, 17 bp, Homo sapiens
gatcctgtgtcaaaaga

SEQ ID NO: 32192 - DNA, 17 bp, Homo sapiens
gatcccaggtgactctg

SEQ ID NO: 32193 - DNA, 17 bp, Homo sapiens
gatcggctgaggaactc

SEQ ID NO: 32194 - DNA, 17 bp, Homo sapiens
gatcccggttcactgca

SEQ ID NO: 32195 - DNA, 17 bp, Homo sapiens
gatcagccctgggatag

SEQ ID NO: 32196 - DNA, 17 bp, Homo sapiens
gatcctgtattttgtaa

SEQ ID NO: 32197 - DNA, 17 bp, Homo sapiens
gatcccagctatctctt

SEQ ID NO: 32198 - DNA, 17 bp, Homo sapiens
gatcaaggtaggcaaac

SEQ ID NO: 32199 - DNA, 17 bp, Homo sapiens
gatctccttcaactcgt

SEQ ID NO: 32200 - DNA, 17 bp, Homo sapiens
gatctaaagcagagcag

SEQ ID NO: 32201 - DNA, 17 bp, Homo sapiens
gatccaactaaacatcc

SEQ ID NO: 32202 - DNA, 17 bp, Homo sapiens
gatcctgccctatggaa

SEQ ID NO: 32203 - DNA, 17 bp, Homo sapiens
gatcatactgtggtaat

SEQ ID NO: 32204 - DNA, 17 bp, Homo sapiens
gatcctggccagaggaa

SEQ ID NO: 32205 - DNA, 17 bp, Homo sapiens
gatctaatgataagaaa

SEQ ID NO: 32206 - DNA, 17 bp, Homo sapiens
gatcgcagcttctgtgt

SEQ ID NO: 32207 - DNA, 2078 bp, Homo sapiens
ttcccgcaaacaaatcaccgccaccacttaggaaaccacgggaaagctgtgattgcagcgccacggtcgccagatttctgctcctgggcacattacccccaactccgaggccccctttttggcagggctagtctggactggccaatccaggtccctgcacgcctctcaccgcaacatccccgcagggcgctgcgcgcggggtactagccaggcggcgcggcccgatgacgcattgcgcctgcgcgcgcgaccgagctcgggaggggtggggcgccaggtgcttgggggcgcggcgaccgccgaggccggctaaacgcagaatggggaagaatcctgtgcgtcctccacgagctcttccacctgtgccaagtcaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttg

SEQ ID NO: 32208 - DNA, 1522 bp, Homo sapiens
agtcgctatgcgtgtcttgtgggtgagggagggcagaaagggagagtgctgggcgggcttagtcggagattgaggactgggaatccgcttccgggagggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggcacgaagtgacgttggtctcccgaaagcccgggcccggccggatcacgtgggatgagctcgctgcatcggggctgccgagctgcgatgccgccgtcaacctggccggagagaacatcctcaaccctctccgaagatggaatgaaaccttccaaaaagaggttctcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttgggtgctgccctgggccgccgagccttcatccctctccccagcgctgtggtgcaagctgtctttgggcgacagcgtgccatcatgctgctggagggccagaaggtgatcccacagcgaacactggccactggctaccagtattccttcccagagctaggggctgccttaaaggaaattgtagcctaagtaggtcgtggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccagtttggtttctctacatgtcctgcagctgccccacttctcctttacgctgtgtagagaatgctctgcagtttaggcaataaaaataaattgtctcactaaaaaaaaaaaaaaaaaaa

SEQ ID NO: 32209 - DNA, 2045 bp, Homo sapiens
ctgtggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaacttttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcatatgaaaaaaaaaaaaaaaaaa

SEQ ID NO: 32210 - DNA, 1002 bp, Homo sapiens
atgaggatctggtggcttctgcttgccattgaaatctgcacagggaacataaactcacaggacacctgcaggcaagggcaccctggaatccctgggaaccccggtcacaatggtctgcctggaagagatggacgagacggagcgaagggtgacaaaggcgatgcaggagaaccaggatgtcctggcagcccggggaaggatgggacgagtggagagaagggagaacgaggagcagatggaaaagttgaagcaaaaggcatcaaaggtgatcaaggctcaagaggatccccaggaaaacatggccccaaggggcttgcagggcccatgggagagaaaggcctccgaggagagactgggcctcaggggcagaaggggaataagggtgacgtgggtcccactggtcctgaggggccaaggggcaacattgggcctttgggcccaactggtttaccgggccccatgggccctattggaaagcctggtcccaagggagaagctggacccacggggccccagggtgagccaggagtccggggaataagaggctggaaaggagatcgaggagagaaagggaaaatcggtgagactctagtcttgccaaaaagtgctttcactgtggggctcacggtgctgagcaagtttccttcttcagatgtgcccattaaatttgataagatcctgtataatgaattcaaccattatgatacagcagtggggaaattcacgtgccacattgctggggtctattacttcacctaccacatcactgttttctccaggaatgttcaggtgtctttggtcaaaaacggagtaaaaatactgcacaccagagatgcttacgtgagctctgaggaccaggcctctggcagcattgtcctgcagctgaagctcggggatgagatgtggctgcaggtgacaggaggagagaggttcaatggcttgtttgctgatgaggacgatgacacaactttcacagggttccttctgttcagcagccagtga

SEQ ID NO: 32211 - DNA, 685 bp, Homo sapiens
attagaatcataagatttttgtttaagacttgcttaagatgtttttcagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttaccgtggctggccaagcctgctgtgcttcacagaccccactcaggatcacaccacttcgttccactgtttggagatgccatgtttgcttatcccttcatcagctgatgagcatttgtgctgttttcactttttggctattacgaaaatgttgctacgagcatccatgatattcgcccatttaaaaaagtgtttttcaccattactgctgtgggaaatttctccctggctctgtcctttctttgtagcccagccttcccccaggttttggctctccctctctggctcaatgtcagctccttgtctcacctcctag

SEQ ID NO: 32212 - DNA, 1180 bp, Homo sapiens
atgtggccacccatgtgacatgaagttggtgtcactaggtaccacgttgtctgtcccatccaacaggaaaaatagcctgttggccagtgaataaggtaggaatccaggtggtcccctgagggtcttctgacaggctcctttatcaggctcttctcatggtatgagcaccgcagcttgctgacagtggcaacgttctcaagcttcacagactccgtcacttggcctggaggggaattctaggtgtccagccccaggacaggcattttggcaccatgattgagcacgatatggtgagccatcctcacaggattaagaagaattctggacagaaatatagttgtaagtaagcatcagtcagcctgcactttgacccacttccttgtaaccaacagtgacgtagcactaggtaacatttgcatccccgttgttcctatagatacaatttctgaccttagaatcacaaggcttttgtttaaaatagatgggatctctgacattagaatcataagatttttgtttaagacttgcttaagatgtttttcagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttaccgtggctggccaagcctgctgtgcttcacagaccccactcaggatcacaccacttcgttccactgtttggagatgccatgtttgcttatcccttcatcagctgatgagcatttgtgctgttttcactttttggctattacgaaaatgttgctacgagcatccatgatattcgcccatttaaaaaagtgtttttcaccattactgctgtgggaaatttctccctggctctgtcctttctttgtagcccagccttcccccaggttttggctctccctctctggctcaatgtcagctccttgtctcacctcctag

SEQ ID NO: 32213 - DNA, 2163 bp, Homo sapiens
agaggcggaagtaaaagcgaactacagtggatgggtgcagttcaggagatagctgttctccagcctttctggagggatgcagagcctttccttaggacaaacaagcatttcaaaaggtttgaactacctaaccattatggcaccaggaaacctctggcatatgagaaataactttctctttggttcaagatgttggatgactcgattttcagcagaaaacatcttcaaatcagtttcatttaggctttttggtgtgaagtgtcataatacagacagtgagcctttgaaaaatgaggacctactgaaaaacttacttactatgggagtagatattgacatggcaaggaaacgacagcctggagtttttcataggatgattaccaatgagcaggacctgaagatgttccttctttccaaaggagctagcaaagaagtgatcgctagcatcatatcaagatatccacgagcaataacacgtactcccgagaatctttcaaaacggtgggatctgtggagaaagattgtgacatcagaccttgaaattgtaaatattttggaacgttctcctgaatccttttttcggtccaataacaacctaaacttagagaataatataaagttcctctactcagttggattgacccgtaaatgcctttgtcgattgttgaccaatgcccctcgtaccttctccaatagtcttgatctgaataaacagatggttgaatttttgcaggcagccggtttgtcattgggtcacaatgatcccgcagattttgtcagaaagataatttttaaaaacccttttatcttaattcagagcaccaagcgggtgaaagctaacattgaattcttacggtcaactttcaatttgaacagtgaggaactgctggttctgatatgtggtccaggagctgaaatcctagacctttccaatgactatgccagaagaagctacgcaaacatcaaagagaagctgttttctcttggatgtactgaagaagaggtacagaagtttgtcttaagctatccagatgtgatcttcttggcagagaaaaagtttaatgataaaatagactgcctcatggaagaaaacattagcatttcacaaataatcgaaaatcctcgggttctggattcaagcataagtactttaaaaagtcgaatcaaagaattggtaaatgctggctgtaacttgagtactttaaacatcactcttctatcttggagtaaaaaaagatatgaagctaaattgaaaaagttaagcagatttgcctaaggatgccaatgtttttaattctcaggaactgtgaatatgttatgccacattgcaaaagaattttgcagaagtgattaatttaaaatgttattaagggccttgagatggggagattatcctgaattactttggagggcctaatataattgtagggatctttaaaagttgaagagggaggcaaaagaggaggtcagagtgatcctgtataagaaagacaactacttttgaaggaagttaaaaggtggctttgaaggaggaagacaccttgagccaaggaatgaagggggcctgtaaaaaaagattgaaaaggcaaggaaacagattctccattagagtccccagaaaggaatgcagccttgctggcacctttttagcccagtgagatcaatgtcaaacttctgacccacagaaccataagatggtaaatttgtgttgttttaaaccactgagtcagtgataatttgctgaagaagcaaatagattaacatagcaactaagtagatgattagttgcattataggtgaagtcaaaaatacagtcctttagtaaagtctctatttcttccttttataagagtaattatatttaaaaaatctacctacccttctggaattgctaatgttagtgtttataaagtcttaaatgtgtgcataaaaaactaaatgtgaatataaaatctaaataaaggaatatgtttgcctaatatagtttaaggaaatgataatcatttctgtgcattttgttggcatttcagctaatattaaagagtaattttcagaggcattgacttaaaaaatggcaaatcagataatgtcggtattttcaagatacaatctagctctgacataaactgaaagacgtgagacaaattatatgaccttaatttt

SEQ ID NO: 32214 - DNA, 2338 bp, Homo sapiens
agcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcctttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaaaaaaaaaaaaaaaaaaaa

SEQ ID NO: 32215 - DNA, 6732 bp, Homo sapiens
agcattcaaaccttgcagagctttgctctcagagagtttgtaaaaagacacactcctcttacaagagttcatgctaccacatagcaaagaaccttaaatttttggaagaacaatatattcattttggcattgtgcagagcaaagtaaactcggtggcctcttcttctccacccctcaaaatgatagcaatctctgccgtcagcagtgcactcctgttctcccttctctgtgaagcaagtaccgtcgtcctactcaattccactgactcatccccgccaaccaataatttcactgatattgaagcagctctgaaagcacaattagattcagcggatatccccaaagccaggcggaagcgctacatttcgcagaatgacatgatcgccattcttgattatcataatcaagttcggggcaaagtgttcccaccggcagcaaatatggaatatatggtttgggatgaaaatcttgcaaaatcggcagaggcttgggcggctacttgcatttgggaccatggaccttcttacttactgagatttttgggccaaaatctatctgtacgcactggaagatatcgctctattctccagttggtcaagccatggtatgatgaagtgaaagattatgcttttccatatccccaggattgcaaccccagatgtcctatgagatgttttggtcccatgtgcacacattatacgcagatggtttgggccacttccaatcggataggatgcgcaattcatacttgccaaaacatgaatgtttggggatctgtgtggcgacgtgcagtttacttggtatgcaactatgccccaaagggcaattggattggagaagcaccatataaagtaggggtaccatgttcatcttgtcctccaagttatgggggatcttgtactgacaatctgtgttttccaggagttacgtcaaactacctgtactggtttaaataagtttaccttttcctccaggaaatataatgatttctgggaacatgggcatgtatatatatatatggagagagaattttgcacatattatacatattttgtgctaatcttgttttcctcttagtattcctttgtataaattagtgtttgtctagcatgtttgtttaatcctttgaaatatttgaaacatcaatttctattttctgacctctaagcctaaattaagatattgtatatgtaatgatgacatagttgatgcatccaatcctaaaacttacattccaaaggaattatatcattatgttcctaaggagtaaatatatatttgacctgtaagtgtgtgtatgtatacatatacatatgtatgtgtatggatttatatatgcacacaaacatataatatgtgatgtaacatgtagatgataatatgattcagtagtcaacttgagggaaatttttaaaaaactattctcaattatatacgaggtgatgggacttcttaacacacatttctataatacccatgaaatgataatttgtaaaataacacttagtgatatctggaaataataattcaattaagcaaccacgaatttcaccctggagatattttttcttatttgagtccaccaaaggataatgccaacttatataagttctcaaatcatgccttccgcttagtctcattttattcattcagtcgtcatgagttgagtgcttactacatgcaaggcactctgctagttatattctaataatgcagagataattagacatggttcccgccctcaagaagctcacaaaagtattcaggaaataatgcagactagtgattttgctataaaattatttttgaaggaagcagacacagcagtatttacctgtaggtggagcaagtaataagccatgctgtgcaatatatacataaagcttctgcttctcatgggaatttagttacagtgcttggaatgagaaggggaaggaaagaattaacaaatgccaagatttctggagcagattgtacagctgtgactttggaaaacagaaagtaagaccctcagaaaaccaatgaagtctaagagaaataaaatttagtggacaggtatgaaaagtgtaattgcgcctaactaccagatggagagcttcagaatgggctatccttagagtctagtacatcttgaggcctctcagcaggagacaaaggattccaaaaagagatgtggaggtgctgagggcacctctatctctttgttgtttagtctgtcattgaatcaatctacttatcatcttgggtctttgagtattgtatgaaagatccttcgtgcacaccacacacagtcatgattttgttaaagtagccttcttcagatgcttttctaagggctagttaccaactttatttctgtgtttctgtagaagaaacattttcagttcttcattgagtttgattatggaaatccattcaaagtcactatgaaaattttactcatgtagtttggaaatgcaacattttcctatcatgaaatctctttcagagaggagaatacaacatcttagtccagacatttaacatactgcatttcaagtacatgtgtgtgtgttttattcaggttgtgtaatgctcccgtagaattatagaacaattaaatatggttagttccagagtgcaaattacagaaggaagctacttgtttaaaattccatacacgtttgcagtttcttgtacacatttggatactttgaaagatgacagattgttaaatccattcaatggtaaagaaactcaccatctggagattgagtctacttgttaatgaatgactagcccaattatccttataaattgaatatggtgaccaaatgctttgatatcatactactctgcctttgtgggcacatatgtagacactactaaaaataaatatttttggagattaaaatggagaatagaagtaattacattatttaggtcttaatccaacttttttctaatatatctaaacaattgaaagggaagcttattcatggaatattggcttgatttatctagaaagtttttccttcttcaattttactatattcattctacaggaacagcaataagtactattaaacagaagatggctacactaagttccaattttgttgctgaattgcttctgtgagttcacttttcagttctaaggaagaataatatttgctacatatttcacaggggttcttatgaaggtaaatttaccagattaataaaaatttatgaatattaaaattatcattaataatataaaacacttatttgagattaaattaaatttttcatgagcccctctttggcaggaactctgtttaattctttgtatttatcccagcttcttaaatggtggctgtaacataataaatgtttaataaatgcttatatgaatggatttttagaattaactaagaagccaaaaatggcaacaatttacagaaatcccacctttccatgcttaagacaaaaatgtcttaaatataaagctgtgattatatcaaaaatccagataaatcatcaaatatatcagattaagaccagggtttacacacttaggcaatagtcctttccaaaccatgacaaaaactacaagtttatttataatttaacaactcagctgaaaatataacgggtatatttgttattctaactctattttttaaagttaataatataaagtggccatgtaaaatattttattttccaggctaaagcaaatgaaagtttgctggtatcaacacagcctgccatatttttcacagcatgcaacaatggtgctaggatagctatttcttactgtaattgccagaggcagaaatggtctgggtataagctatttcataaaagcagctttaaattgtcagtattaaggttttcatgtggaaaggtgtcattcaaaaaaaaagtaattggcatacatattccacatcatcgatcctctctgtggtgttaatttttttatatgaccagtagaaaaattttaatattctcacaatataggttttggggcttccatatcatcaaaagactgaaaaattataattttagaattaaactgatggatttcattatagaattatctgtgagttgtgtagacacagtcttaatgtttctggttatgacagataagtttgctcaaaaaatgtggatgaagccattattgttattattgttattgcttctgttcagttgtctaagtatcatcccttctgtggcccatcacgcagcagagttgccctacaaatttcatttggcagcgccataacattcatttaaaaagtttatgaaaacattcatttgaaagttccatgcagctttagcacagagttgaccaaacactggcgtaagttcaatttacacagaatatttgaattgaaacaatagaaatttttctcataatatatacctatgtgaaaccaacttatctgcataattaaatctaatacatatttaagccagtttaagtgctttgtgttgatgccatgcttatcaaatacatgcacaagctaaacataatttgaatgggtctatgaaggaaaaataatgcttagactttggtgtaggttcttcctgtgtagccatatacccaggctctgcagtatcgaaggatgcaaatgttgacatagatggaagctcttacctaccaaagtgtttaggaaggataaagttacatttgtcttaatttctaacattatctttgcttttatgtttcataaaaatttgtcattatttatgctggtgaaacgtataatcacatccaattatttgaacacatgcaaaataattttttaaattatgttattgtttaaatttgacttatgggagatcagtcaaaaacttagaaggtttaacacttcactgattaatggtgctgaaaacacgttacaattaccacatatccttgctataagttttgaagtttcttagcaattaaagtttttttattcagtgtgaactgtcagtatctattctggtgctaaatgtatggtgctaaatgaattgttagtgttgatggctttagtaatgctccttttattcattgctaaatttagtgttatccatttgattcctgattcagaaatatcaataaaatcctatgttaaattaatctttaccaaaaacaggcaagttaactctgttgttttaattcaacagtccaacattatttaggtgttacagagtgtaaatatatttctttgggagttattttctttttaaaatctttttatagcttggcaatgtccaaagtcaaatatcacctaaactggttagattacttctacagctaataatattgcaggcactggcgccctctggtggttatgaagacaaattcttaatggctacttgacctacagcaaaagccatttctgtaccataaaaatttgttgtgcaatattagaattatcatatgtttcctacatctgacagcacctaaaatgtttgataatattaacatgtatctaagaggaaaaaagagttaatatattctggcacccactttcctagtaatgttttccatgattttccagttctgaggcacttattaaagtgcttttttttttctgaattaattaggtattggtaaaatatatttttaaatttagttagctttataaacacaattagaattacaattaattaacagaggtataattgtctcactttcagaagtgatcatttatttttatttagcacaggtcataagaaaaatatatagaaaaataatcaatttcatatataaaaggattatttctccacctttaattattggcctatcatttgttagtgttatttggtcatattattgaactaatgtattattccattcaaagtctttctagatttaaaaatgtatgcaaaagcttaggattatatcatgtgtaactattatagataacatcctaaaccttcagtttagatatataattgactgggtgtaatctcttttgtaatctgttttgacagatttcttaaattatgttagcataatcaaggaagatttaccttgaagcactttccaaattgatactttcaaacttattttaaagcagtagaaccttttctatgaactaaatcacatgcaaaactccaacctgtagtatacataaaatggacttacttattcctctcaccttctccagtgcctaggaatattcttctctgagccctaggattgattctatcacacagagcaacattaatctaaatggtttagctccctcttttttctctaaaaacaatcagctaataaaaaaaaaatttgagggcctaaattatttcaatggttgtttgaaatattcagttcagtttgtacctgttagcagtctttcagtttgggggagaattaaatactgtgctaagctggtgcttggatacatattacagcatcttgtgttttatttgacaaacagaattttggtgccataatattttgagaattagagaagattgtgatgcatatatataaacactatttttaaaaaatatctaaatatgtctcacatatttatataatcctcaaatatactgtaccattttagatattttttaaacagattaatttggagaagttttattcattacctaattctgtggcaaaaatggtgcctctgatgttgtgatatagtattgtcagtgtgtacatatataaaacctgtgtaaacctctgtccttatgaaccataacaaatgtagctttttaaagtccattgtattgttttttctttcaataaaagagtataattaa

SEQ ID NO: 32216 - DNA, 1492 bp, Homo sapiens
gccatgtcactggctcaggctcagctgctgggtcaccaggagaatggacgcttcctccacctcagctcagagcacagtgatgattcgtgactttcccaatagaacttcaaatctctgaagacggggggtggggggatgtgcttgagtgtttgtactcatggtcttattctcggagtgacaaagctggaacacaatacctctatgcatgaaaaggttgtcacttgtcacaactaacaggctttcacctcatggaaatttttttaccttgtgtacttttcccctggcagtggacatggctgcactcttccaagaagcaagcagctgtcccgtctgctcagactatctggaaaaaccaatgtccctggagtgtggatgcgccgtctgcctcaagtgcattaattcactgcagaaggagccccatggggaggatctgctttgctgttactcttccatggtctctcggaagaacaaaatcaggcgcaatcggcagctagagaggctggcttcccacatcaaggaactggagcccaagctgaagaagattctgcagatgaacccaaggatgcggaagttccaagtggatatgaccttggatgccaacacagccaacaacttcctcctcatttctgacgacctcaggagcgtccgaagtgggcgcatcagacagaatcggcaagaccttgccgagagatttgacgtgtccgtttgcatcctgggctcccctcgctttacctgtggccgccactgctgggaggtggacgtgggaacaagcacagaatgggacctgggagtctgcagagaatctgttcaccgcaaagggaggatccagctgaccacagagcttggattctggactgtgagtttgagggatggaggccgcctctctgccagcaccgtgccgctgactttcctcttcgtagaccgcaagttacagcgagtggggatttttctggatatgggcatgcagaacgtttccttttttgatgctgaaggtggttcccatgtctatacattcaggagcgtatctgctgaggagccactgtgcccatttttggctccttcaattccacctaatggtgatcaaggtgtcttgagcatctgtcctttgatgaactcaggcactactgatgctccagtccgtcctggggaggccaaataagccctcactccaaaaaaacaaaaaacagggtaagaaaattacttgggtgggtagacttaggaacgctctacttcgtaaaagcattatacaaagtcacgggagaaaaatatgggacatttcttgattatacttaatctaatttgattagattatagagtcctaagtattaattattgccaccatcaaactcattgagtcctatggttcacatcttgtttcctatagaaatgtcctgtattctgggatcaatttccaaatgctttacttttttatttctgcaagttcaaattaatgtattatagaagttatgagttaaataaagattggaatatc

SEQ ID NO: 32217 - DNA, 2425 bp, Homo sapiens
gctccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaa

SEQ ID NO: 32218 - DNA, 1807 bp, Homo sapiens
gcacgagggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggcccccggagccatggggtgtcgggggctcctgtgcaggctcatgctgcaggcggccgaggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatggtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcac

SEQ ID NO: 32219 - DNA, 1712 bp, Homo sapiens
aagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcactgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtaatttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactaccatgttaaaaaaaaaaaaaaaaaaaaa

SEQ ID NO: 32220 - DNA, 4154 bp, Homo sapiens
gaaatctcgcgagggtaggtgcgcgtcggtattttgcgggcaactagctcttccagctgctgtaaattgctgctgcgggagaaactggagccgctgtagccggcgcgcccttcttcccttactgcgaggagccaccgcctctttcgcgctccttatacacctatcactgggagcggtggcagcaacattccctggaccaaccgccgcctcttcaggcggccgctttgccggtcattcccgaagcccggcaactgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataaatggcgtcggaaagcgacaccgaggaattctatgatgcccctgaagatgtgcacctagggggcggctaccccgtggggtctccaggaaaagttgggctttcaacattcaaggaaacagagaacactgcatacaaagttggaaatgagtcccctgtacaagaattgaaacaagatgtgtctaaaaagattattgaaagtattattgaggagagtcagaaagtactacagcttgaagatgactctttggattccaaaggaaaagaactctctgatcaagctactgccagtcctattgtggctagaacagatctgagcaatatacccggactgttagccatagatcaagtactaccggaagaatcccaaaaggcagagagtcagaatacatttgaagagactgaattagaattaaaaaaatgctttccttctgatgaaacctgtgagaaaccagtagatgaaaccacgaagttaactcaaacaagttcaactgagcagcttaatgtgcttgaaactgaaacagaagtattgaacaaggaagcagtggaagtcaaaggaggtggtgatgttttagagcctgtgtcctcagactccttatctactaaagattttgccgctgtggaagaagtggcccctgccaaacccccaagacaccttactccagagcctgatatagtggctagtacaaagaagcctgttccagcacgcccacctcctccaactaatttcccacctcctagacccccacctccttctcgacctgctccaccaccaagaaaaaggaaaagcgaattggaatttgagactctgaaaactcctgatatagatgttcccaaagagaatattacgtctgattctctcctaaccgcaagcatggcttcagaaagtacggttaaggattctcagccttctcttgatttggcaagtgctaccagtggagataaaatagttaccgcccaggaaaatggaaaagcacctgatgggcagactgtagcaggtgaagtgatgggccctcagagacctagatccaactctgggagagagcttactgatgaggaaattttagccagtgtaatgattaagaacctggatactggagaagaaatacctttgagtcttgcagaagagaaactaccaacaggcattaatcctctcactctacacatcatgagaaggacaaaagaatatgtaagtaatgacgcggcacagtcagatgatgaagagaagttacagtctcagccaacagatactgatggtggaaggttaaaacagaaaacgactcaactaaagaagtttcttggaaaatcagtaaagagagcaaagcaccttgctgaggaatatggtgaacgtgctataaataaagttaaaagtgttagagatgaagtgtttcatactgatcaagatgatccttcatcaagtgatgatgaaggaatgccatacacaagaccagttaaattcaaagcagcacacggtttcaaaggaccttatgattttgatcagatcaaagtggtgcaagatcttagtggtgaacatatgggagctgtttggaccatgaaattttctcactgtggccgattacttgcctcagctggacaagacaatgtagtgagaatatgggctttaaaaaatgcttttgactatttcaacaatatgcgaatgaaatacaatactgaaggacgtgtgtccccatcaccctctcaggaaagtctaagttcatcaaaatcggatacagatacaggggtatgcagtggaactgatgaagaccctgatgataaaaacgcaccctttcggcaacggccattttgcaaatataaaggacatactgctgatctccttgatctttcatggtctaaaaactactttcttctttcttcttcaatggataaaacagtcagattatggcacatttctcgaagagaatgcctttgctgttttcaacatatagattttgtcactgccatagcttttcatccaagagatgacaggtattttctaagtgggtctttggatggaaagctccgcctttggaacatacctgacaaaaaagtggctttgtggaatgaagtagatggtcagacaaaattgatcacagctgcaaatttctgtcagaatggcaaatatgcagtgattgggacatatgatggcagatgtattttctatgatacagagcatttgaaataccatacacaaatacatgtccgatctactagagggcgcaacaaggttggaagaaaaattactggcattgagcctttacctggagaaaataagatattggtaacctcaaatgactccagaatcagactatatgatttgagagatttgtcactatccatgaagtataagggttacgtcaatagcagcagccagatcaaagcaagtttcagccatgattttacttacctcgttagtggttcagaagataagtatgtttatatctggagtacctaccatgacctaagcaagtttacttcagtcaggagagatcgtaatgacttctgggaaggtattaaagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaaaaaaaattaagccacattaaggagtgagtcttcttttttacaataatgtaaaaattaaactgtttacatttttttaaagcattgtagtttttaaaaattaagctgttttgttttgtgttgttgaatttgaaagcctttgtaaatatcaatataatgtaccaatgaaataacatctggggcaatgaaaccctgatcatgttgttgatggttagcatatgtttctgaaaattaaatatgtattattaaaagttggtctccaacacttgtttaaaaaaaaaaaaaaaa

SEQ ID NO: 32221 - protein, 432 aa, Homo sapiens
MTHCACARDRAREGWGARCLGARRPPRPAKRRMGKNPVRPPRALPPVPSQDDIPLSRPKKKKPRTKNTPASASLEGLAQTAGRRPSEGNEPSTKELKEHPEAPVQRRQKKTRLPLELETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 32222 - protein, 319 aa, Homo sapiens
MGWRRKRVPQRGRKAPPPQLHGNINNLYFPIRWRDRLHWDSPNPAAECQRHEVTLVSRKPGPGRITWDELAASGLPSCDAAVNLAGENILNPLRRWNETFQKEVLGSRLETTQLLAKAITKAPQPPKAWVLVTGVAYYQPSLTAEYDEDSPGGDFDFFSNLVTKWEAAARLPGDSTRQVVVRSGVVLGRGGGAMGHMLLPFRLGLGGPIGSGHQFFPWIHIGDLAGILTHALEANHVHGVLNGVAPSSATNAEFAQTLGAALGRRAFIPLPSAVVQAVFGRQRAIMLLEGQKVIPQRTLATGYQYSFPELGAALKEIVA

SEQ ID NO: 32223 - protein, 329 aa, Homo sapiens
MTHFNKGPSYGLSAEVKNKIASKYDHQAEEDLRNWIEEVTGMSIGPNFQLGLKDGIILCELINKLQPGSVKKVNESSLNWPQLENIGNFIKAIQAYGMKPHDIFEANDLFENGNMTQVQTTLVALAGLAKTKGFHTTIDIGVKYAEKQTRRFDEGKLKAGQSVIGLQMGTNKCASQAGMTAYGTRRHLYDPKMQTDKPFDQTTISLQMGTNKGASQAGMLAPGTRRDIYDQKLTLQPVDNSTISLQMGTNKVASQKGMSVYGLGRQVYDPKYCAAPTEPVIHNGSQGTGTNGSEISDSDYQAEYPDEYHGEYQDDYPRDYQYSDQGIDY

SEQ ID NO: 32224 - protein, 333 aa, Homo sapiens
MRIWWLLLAIEICTGNINSQDTCRQGHPGIPGNPGHNGLPGRDGRDGAKGDKGDAGEPGCPGSPGKDGTSGEKGERGADGKVEAKGIKGDQGSRGSPGKHGPKGLAGPMGEKGLRGETGPQGQKGNKGDVGPTGPEGPRGNIGPLGPTGLPGPMGPIGKPGPKGEAGPTGPQGEPGVRGIRGWKGDRGEKGKIGETLVLPKSAFTVGLTVLSKFPSSDVPIKFDKILYNEFNHYDTAVGKFTCHIAGVYYFTYHITVFSRNVQVSLVKNGVKILHTRDAYVSSEDQASGSIVLQLKLGDEMWLQVTGGERFNGLFADEDDDTTFTGFLLFSSQ

SEQ ID NO: 32225 - protein, 146 aa, Homo sapiens
MDLTFPPISSFGGPTMKPLSLLQPYASAYSLSGPIQRWTHRGYRGWPSLLCFTDPTQDHTTSFHCLEMPCLLIPSSADEHLCCFHFLAITKMLLRASMIFAHLKKCFSPLLLWEISPWLCPFFVAQPSPRFWLSLSGSMSAPCLTS

SEQ ID NO: 32226 - protein, 146 aa, Homo sapiens; identical to SEQ ID NO: 32225

SEQ ID NO: 32227 - protein, 399 aa, Homo sapiens
MQSLSLGQTSISKGLNYLTIMAPGNLWHMRNNFLFGSRCWMTRFSAENIFKSVSFRLFGVKCHNTDSEPLKNEDLLKNLLTMGVDIDMARKRQPGVFHRMITNEQDLKMFLLSKGASKEVIASIISRYPRAITRTPENLSKRWDLWRKIVTSDLEIVNILERSPESFFRSNNNLNLENNIKFLYSVGLTRKCLCRLLTNAPRTFSNSLDLNKQMVEFLQAAGLSLGHNDPADFVRKIIFKNPFILIQSTKRVKANIEFLRSTFNLNSEELLVLICGPGAEILDLSNDYARRSYANIKEKLFSLGCTEEEVQKFVLSYPDVIFLAEKKFNDKIDCLMEENISISQIIENPRVLDSSISTLKSRIKELVNAGCNLSTLNITLLSWSKKRYEAKLKKLSRFA

SEQ ID NO: 32228 - protein, 417 aa, Homo sapiens
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 32229 - protein, 258 aa, Homo sapiens
MIAISAVSSALLFSLLCEASTVVLLNSTDSSPPTNNFTDIEAALKAQLDSADIPKARRKRYISQNDMIAILDYHNQVRGKVFPPAANMEYMVWDENLAKSAEAWAATCIWDHGPSYLLRFLGQNLSVRTGRYRSILQLVKPWYDEVKDYAFPYPQDCNPRCPMRCFGPMCTHYTQMVWATSNRIGCAIHTCQNMNVWGSVWRRAVYLVCNYAPKGNWIGEAPYKVGVPCSSCPPSYGGSCTDNLCFPGVTSNYLYWFK

SEQ ID NO: 32230 - protein, 288 aa, Homo sapiens
MAALFQEASSCPVCSDYLEKPMSLECGCAVCLKCINSLQKEPHGEDLLCCYSSMVSRKNKIRRNRQLERLASHIKELEPKLKKILQMNPRMRKFQVDMTLDANTANNFLLISDDLRSVRSGRIRQNRQDLAERFDVSVCILGSPRFTCGRHCWEVDVGTSTEWDLGVCRESVHRKGRIQLTTELGFWTVSLRDGGRLSASTVPLTFLFVDRKLQRVGIFLDMGMQNVSFFDAEGGSHVYTFRSVSAEEPLCPFLAPSIPPNGDQGVLSICPLMNSGTTDAPVRPGEAK

SEQ ID NO: 32231 - protein, 411 aa, Homo sapiens
MSKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 32232 - protein, 331 aa, Homo sapiens
MENPSPAAALGKALCALLLATLGAAGQPLGGESICSARAPAKYSITFTGKWSQTAFPKQYPLFRPPAQWSSLLGAAHSSDYSMWRKNQYVSNGLRDFAERGEAWALMKEIEAAGEALQSVHAVFSAPAVPSGTGQTSAELEVQRRHSLVSFVVRIVPSPDWFVGVDSLDLCDGDRWREQAALDLYPYDAGTDSGFTFSSPNFATIPQDTVTEITSSSPSHPANSFYYPRLKALPPIARVTLVRLRQSPRAFIPPAPVLPSRDNEIVDSASVPETPLDCEVSLWSSWGLCGGHCGRLGTKSRTRYVRVQPANNGSPCPELEEEAECVPDNCV

SEQ ID NO: 32233 - protein, 202 aa, Homo sapiens
MCYGKCARCIGHSLVGLALLCIAANILLYFPNGETKYASENHLSRFVWFFSGIVGGGLLMLLPAFVFIGLEQDDCCGCCGHENCGKRCAMLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQQYDC

SEQ ID NO: 32234 - protein, 913 aa, Homo sapiens
MASESDTEEFYDAPEDVHLGGGYPVGSPGKVGLSTFKETENTAYKVGNESPVQELKQDVSKKIIESIIEESQKVLQLEDDSLDSKGKELSDQATASPIVARTDLSNIPGLLAIDQVLPEESQKAESQNTFEETELELKKCFPSDETCEKPVDETTKLTQTSSTEQLNVLETETEVLNKEAVEVKGGGDVLEPVSSDSLSTKDFAAVEEVAPAKPPRHLTPEPDIVASTKKPVPARPPPPTNFPPPRPPPPSRPAPPPRKRKSELEFETLKTPDIDVPKENITSDSLLTASMASESTVKDSQPSLDLASATSGDKIVTAQENGKAPDGQTVAGEVMGPQRPRSNSGRELTDEEILASVMIKNLDTGEEIPLSLAEEKLPTGINPLTLHIMRRTKEYVSNDAAQSDDEEKLQSQPTDTDGGRLKQKTTQLKKFLGKSVKRAKHLAEEYGERAINKVKSVRDEVFHTDQDDPSSSDDEGMPYTRPVKFKAAHGFKGPYDFDQIKVVQDLSGEHMGAVWTMKFSHCGRLLASAGQDNVVRIWALKNAFDYFNNMRMKYNTEGRVSPSPSQESLSSSKSDTDTGVCSGTDEDPDDKNAPFRQRPFCKYKGHTADLLDLSWSKNYFLLSSSMDKTVRLWHISRRECLCCFQHIDFVTAIAFHPRDDRYFLSGSLDGKLRLWNIPDKKVALWNEVDGQTKLITAANFCQNGKYAVIGTYDGRCIFYDTEHLKYHTQIHVRSTRGRNKVGRKITGIEPLPGENKILVTSNDSRIRLYDLRDLSLSMKYKGYVNSSSQIKASFSHDFTYLVSGSEDKYVYIWSTYHDLSKFTSVRRDRNDFWEGIKAHNAVVTSAIFAPNPSLMLSLDVQSEKSEGNEKSEDAEVLDATPSGIMKTDNTEVLLSADFTGAIKVFVNKRKNVS

SEQ ID NO: 32235 - DNA, 17 bp, Homo sapiens
gatccttgtagccaagg

SEQ ID NO: 32236 - DNA, 17 bp, Homo sapiens
gatcttttattttgttt

SEQ ID NO: 32237 - DNA, 17 bp, Homo sapiens
gatctccgggcaggcac

SEQ ID NO: 32238 - DNA, 17 bp, Homo sapiens
gatctgaccctaacatt

SEQ ID NO: 32239 - DNA, 17 bp, Homo sapiens
gatcatagatgtctctt

SEQ ID NO: 32240 - DNA, 17 bp, Homo sapiens
gatctgaaaggaggcca

SEQ ID NO: 32241 - DNA, 17 bp, Homo sapiens
gatccacctacctggcc

SEQ ID NO: 32242 - DNA, 17 bp, Homo sapiens
gatcatttgcagttaag

SEQ ID NO: 32243 - DNA, 17 bp, Homo sapiens
gatcttataaaacaaat

SEQ ID NO: 32244 - DNA, 17 bp, Homo sapiens
gatcacctttgatgcct

SEQ ID NO: 32245 - DNA, 17 bp, Homo sapiens
gatctgaaaaacatctt

SEQ ID NO: 32246 - DNA, 17 bp, Homo sapiens
gatcaatgtcaaacttc

SEQ ID NO: 32247 - DNA, 17 bp, Homo sapiens
gatcctagttaccaaaa

SEQ ID NO: 32248 - DNA, 17 bp, Homo sapiens
gatcctttacctacttt

SEQ ID NO: 32249 - DNA, 17 bp, Homo sapiens
gatcatcaattttgcct

SEQ ID NO: 32250 - DNA, 17 bp, Homo sapiens
gatcacttctgaaagtg

SEQ ID NO: 32251 - DNA, 17 bp, Homo sapiens
gatcaatttccaaatgc

SEQ ID NO: 32252 - DNA, 17 bp, Homo sapiens
gatccaatgggtcctga

SEQ ID NO: 32253 - DNA, 17 bp, Homo sapiens
gatctgttttcttaaga

SEQ ID NO: 32254 - DNA, 17 bp, Homo sapiens
gatctctctgcgtttga

SEQ ID NO: 32255 - DNA, 17 bp, Homo sapiens
gatcccctgaggagctg

SEQ ID NO: 32256 - DNA, 17 bp, Homo sapiens
gatcctgcaattccaat

SEQ ID NO: 32257 - DNA, 17 bp, Homo sapiens
gatcattgccccttctc

SEQ ID NO: 32258 - DNA, 17 bp, Homo sapiens
gatctgcccgcctcttc

SEQ ID NO: 32259 - DNA, 17 bp, Homo sapiens
gatccaactctgggaga

SEQ ID NO: 32260 - DNA, 2727 bp, Homo sapiens
ctaggcgcgtttcctgaaggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaaattgtgtcaatgggaacaggaacaaaatgcataggacagtccaaaatgaggaagaacggagacatcctcaatgatagccatgctgaggtcatagccagaaggagtttccaaaggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgtcttcagaaattgggccaacaactcatcagtagaagccagtagtaacctggaagctcctggaaatgaaagaaaatgtgaagaccctgacagtcctgtaaccaaaaagatgaggcttgagcctgggactgcagccagggaggtcaccaacggagcagctcaccatcagagttttggcaagcagaaaagtggcccaatctcaccaggcatccacagctgtgatctcactgtagagggactggctactgtcaccagaatagcccctggtagtgccaaagtgacagacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgtcagaatgtgtctgctttaccaaaaggcttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggtgcagaagctggatacctaccaggagtacaaggaggctgcgtcctcttaccaggaagcctggagcacactccggaagcaggtgtttggatcctggatcagaaacccaccggattatcaccagttcaagtgagaaggaaatgtttgctctggtagcaggacccttcatcctgaactgccttcctccacgcaggacaagtcttagcttttttggtagttaaatcagggaacattctttctgagctttgcatctctgttgtgtaatacagatggaatctggaacttagagcaagctatacttgattgaagtagctctctgctaaaatggcatctcactaatgacctcactatctgacttccattgtgttttattgcttctctaaaatatgaaatcagagtttggaacatgatgctttgaaagtactctgcagcagctctgttttatgggttcctacattgattcagcaaatatttattgagctgaaatgatgtttgacgctctgcaagttttacagctttgcctagcatagcgaatatatattttgtattcccagcctttctttcttcagggagccattcttttcccattcttcagtggtcctgctctgtgcctcagacttggctgaagctaaccttactccctggctctaggaatagcctgtgagccagccctggactgccctggacttgttctcagaggtatcaggaaaggctttctgttttgatctggagctgtaagggtcacataatcatgggactgccggtggccatcttttcctactacctagagaaagccagcaaagaatgaaggcaacaaaggaaacagccaagagaatcaaagatctagtaacactgtttagatgtctcaattatgtgagacagattcctgttgttattttgattaagcctgtttgtgttggttttctgacttacaattgaaagagttctgtccaaaaagccaaaaggtggccaggcttggtggctcaggcctgtaatcccagcactttgggaagcccaggcaggcagatcacttgaggtcaggagttcaagaccagcctggccaacctggtgaaaccctgtctctactaaaaatgcaaaaactagccgggcatggtggcgcacacctgtaatcctagctactcgggaggctgaggcaggagaattgcttgaacccaggaggcggaggtagtggtgagcaaagatcgtaccgctgcactccagcctgggtgatagagcaagaccctatctc

SEQ ID NO: 32261 - DNA, 1671 bp, Homo sapiens
acggcgggtcgccagcgcctcagtagctcgcgcggtgcctgtcggtagtcgcgtgcggggcggcggggcggcggggcggccggcggcggccatgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattgagtgccacccatatcttactcagaagaatctgatcagtttttgccaatccagagatgtgtccgtgactgcttaccgtcctcttggtggctcgtgtgagggggttgacctgatagacaaccctgtgatcaagaggattgcaaaggagcacggcaagtctcctgctcagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccatgtaaatatggctccttctttttaaaacagagggaagaatatacagattgaatgattggtgtctgaatagaactaaaaatcacaaagactatcctttccacatagaatactgaggacgcttccccttccttgtttctgctcagcccagatgcacagacactattggcaatgttgaccctcctctgtcatcacagcgccagggcagctgtgcctgggacaggagccacacagtcagagggggatgtaagagccaccttctctgacaaatctggagaattgagtgtgttctaagtgaaggcaatggggtttctccaagacagcctgtgtggcctctactctgaacaaatacactgatgagtcatcagtgaaatttgccttcacattttaagaaaactttatcttatggagttatttaagccatctacagagctgaggaaacagtgtaatgtgtctctgccccattgcgcagctccacccattgtgccccaggccagcccgcgtcacctacacttccttctgtgccctgccagtgacccccaggttattctaaagcagagtccttcccttcccccagtgagaaggaaaatgggataagtctgggacactgtttcagttcaataaagaggcttttttcttccttaaaaaaaaaaaaaaaaaaaaa

SEQ ID NO: 32262 - DNA, 7333 bp, Homo sapiens
acttccttcgtctgggtggttgccccagcgacacgttgggccgaagagcggtgttgggtacccgagagacccggcggtggggaagtcacttcctcccgaagacgctgtttcctagcaaccgccctccgcctctgttattagcccctcctcctcgctcggtccaggaccggctctgcgggcgccgccaggcccagaccaagctactatcagaagttgaattctaataattagctattttataaaggtaacgagaaaaaatacactatgtctgatgaagtttttagcaccactttggcatatacaaagagtccaaaagttaccaaaagaactactttccaggatgagctaataagagcaattacagctcgctcagccagacaaaggagttctgaatactcagatgactttgacagtgatgagattgtttctttaggtgatttttctgacacttcagcagatgaaaattcagttaataaaaaaatgaatgactttcatatatcagatgatgaagaaaagaatccttcaaaactattgtttttgaaaaccaataaatcaaacggtaacataaccaaagatgagccagtgtgtgccatcaaaaatgaagaggaaatggcacctgatgggtgtgaagacattgttgtaaaatctttctctgaatctcaaaataaggatgaggaatttgaaaaagacaaaataaaaatgaaacctaaacccagaattctttcaattaaaagcacatcttcagcagaaaacaacagccttgacacagatgatcactttaaaccatcacctcggccaaggagtatgttgaaaaagaaaagtcacatggaggagaaggatggactagaagataaagaaactgccctcagtgaagaattggagttacattctgcaccttcttcccttccaacgccgaatggcatacaattagaagctgagaaaaaagcattctctgaaaaccttgatcctgaggattcatgcttaacaagtctagcatcatcatcacttaaacaaattcttggagattctttttcaccaggatctgagggaaacgcatctggaaaagatccaaatgaagaaatcactgaaaaccataattccttgaaatcagatgaaaataaagagaattcattttcagcagaccatgtgactactgcagttgagaaatccaaggaaagtcaagtgactgctgatgaccttgaagaagaaaaggcaaaagcggaactgattatggatgatgacagaacagttgatccactactatctaaatctcagagtatcttaatatctaccagtgcaacagcatcttcaaagaaaacaattgaagatagaaatataaagaataaaaagtcaacaaataatagagcatccagtgcatctgccagattaatgacctctgagtttttgaagaaatctagttctaaaaggagaactccatcgacaactacctcttctcactatttagggactttaaaagtcttggaccaaaaaccttcacagaaacagagcatagaacctgatagagcagataacataagggcagctgtttatcaggagtggttagaaaagaaaaatgtgtatttacatgaaatgcacagaataaaaagaattgaaagtgaaaacttaaggatccaaaatgaacagaaaaaagctgctaaaagagaagaagcattagcatcatttgaggcctggaaggctatgaaagaaaaggaagcaaagaaaatagctgccaaaaagaggcttgaagaaaaaaacaagaagaaaactgaagaagaaaatgctgcaagaaaaggagaagcactacaagcttttgaaaaatggaaagagaaaaagatggaatatcttaaagagaaaaatagaaaggagagagaatatgaaagagcaaagaaacagaaagaggaggaaactgttgccgagaaaaagaaagataatttaactgctgttgagaaatggaatgaaaaaaaggaagcttttttcaagcaaaaggaaaaagaaaaaataaatgagaaaagaaaggaagaactgaaaagagctgagaaaaaagataaagataaacaagctattaatgaatatgaaaaatggctggaaaataaggaaaaacaagaaagaattgaacgaaaacagaagaaacgtcattcctttcttgaaagtgaggcacttcctccgtggagccctccaagcagaactgtgttcgcaaaagtgttttgataattctagttcttacattatttggttatttatcggtttgccaatattagccatagatttaaaaccattcaattatttatagttagaggaatatattttaattaaatgccagacactcctgctgacaatgaaagaaatactttggaatgtaatcagtgaaagcatttttttgaactgtagataaactgcctcaaacaaagacctaataatcagattgtttttaccattaagatacataagattttatcatgtcctgataattcttatggtggagtgattcatgatctttttcattaagctctgtatgttatttaagtatatttaattccagtaataaaaaggaaatcatctaggtaccataatgatagaaattattccttttgtggatgattgtgaatctagattcaggtttttaaatgaagggtcgctgggaagtgcgcatatattattccttctgaaactgatgtttagctcaaagcagttgcatttgtactgtgctagttagaattttcatcagttgaggcagtagctcagtagaactctaatcatcaaggctttttatttaagaattttgccttatgttttaatatgagtgtactttatctgttccaggcttatgtgataatcataggtactttataatgagtccacctctgaaatttttctttctgaattctatctcactttattatttcagtgataccaaaagacatcaatgtcacagtagtgatatacttatgtattagttatggaaattccacaggagttcaaggtcattatcactataattattttcctgactaaagccataaaggtgatttaggcaattattgtcatcttagctagtcctgttttatagcttatattcagcagacagctgtatgggaaggtaaatatgttgacaatgtccacaaagcctttatttatttatttatttgatctctgcatgtcctcgtagtaactggtctcatacttgacctggtcatctggtttaagacagaccaagtgtatgctcacggagctgaaatgcattagtcagttgtgcaatgaggagatgatggatgagaatatatagttcctatttattgagcatctaatatataatctctactggacctttacaaatgtatttaacatctttacaacaacttttcagggtaggtgttaccggcttcatcttacatataaaaatactggcgctcagataaaccaagtaacttaccgtccatctggagtgtgcctgagttgagatcaaacgggattcagtacgtctgactgaatctgcctccttctgaaatctctatgctctttttcacacttctctgtagcctcagagactgccaagttctgtcaagacctctgcataatatcaacgttacaaacacgttttaacttttagagcctaaaatcatgtattgttatccaaagatgatctttctctacagaaatagctgcttgttcttagagatggtggaggtcattaaatctataaagtgagataaaaatccataagatttcatgagttactcaggcatcttataactactatcagaatatcagaaaactcagcaagttatgtgacaaaggctttgagatgatcactccagacgttccacatactgagcatcagccttcttgctgcagtgcatgtgcaagataagatgtcataggcagctttgtaagattgtatcagtgctatagacaattaagagaaatttcatagataaaactagaaccctttctatatggccagaactgtaatactttatgaaattgatctgattatcagcaatatgtagtatcagcatggaatttaggacctctcttactcattcctgtgtcccccatagtaccaaaaacagtgcctgccaaaatagattaaaagtgtttattgtattagctgtttagagctgaaaagatatttacaaattccagggaagtaaaaggaaaaaaactgaaaaaggtacagctacttttggggatgtgagatcatggatgtgtatcttatagatttcacattatttatttactttccattattttcttctacattatcatatttagtggctaaccattattacttcttaggttgttgtgagaaccgagttaattaatgtaaactatttgacacataataaggacttaaatgttcattgttgtcattattgatttattaccatgagccctacatttccccattcatgagtgtgcgaacattaacatagatagggttgataatggttatttgacattacacatttttaggaagaagaaatttctgtcttgctggccagtccaggctgtaacactcaaaaaaacaaaacaaaacaaaacaaaacaaaaaaacagaaagatgccttgtattagggccttcctaaaaagaaagctaagtaagtattaatttcttaggattgcttctgaggtaggatgaggtgtttgcatagacccaacaagtcattcacttcaaattttttttgtcttactatgataaataacatattatttcctgtttacagcaacctgcactgaaattaactagttgaataaaatcacctcttctagcacaaataaagctgagttcggggaggtgggtgaaaatacagtactgttgtttacttcctaagatccaagggagagaatcaagcttggtaatattctcttgaatatacatttacctatttaaaaggtatgattttcccatatttccttaggaagtatgtcatgtcaatatagatatttactcattaggtttacattaatttgtattataagggaatgtttaattcaaattaaggacattaaaagtatatagactttcatataaaagttccggttttataaattgcgttgatcacttaaagaatgcagagatctcaaagtaaagaaaacaaattttatgaatattttaaaacattacttaaaacaagtttccttagaaagcacatttgtggataaatttaaatattaatactaaataataaagtagtatacagaatttaaatttcataataatgaagaaagtggtaatgctatttaacttaaaagatgcaatatggcattttagatcaagaggttaaagttttcttaatgaaagaaagtaacgatttatgggataaaaatattccagtggtttgtatttgcttcatacttcaaaagtgttagtccatttattgtttaaagttatattgaaactgatattttcactgctgccaaagcagtacctgacagtagataggtatccacagtcttatgttccttagagttatagaactatgcctctgaaaggggttttaatactttaataaacctggcctaaactgttttatttctaagttgaagaaactgattgtcaagtactttgacttgtccaatctcatacaactaactatggtacatctagagttagatctcagtatcaggggtcccagttgtattctgctcaccattccacaatttcgatattgataaaactttcacactaacttttgaactgtggttattattaatttagttgattcatgtcctcttatttatctccttactcctccactgctgccttcataactgtccaccagatcaaagctatttgggtacctacactttaaagtgaggggaaataatgaagtttcttaaatcctgtgtcatggactaagatacaataaagaaaaggaatttcacaaagtaggggaaattacgtgttagttataatcattcccaagaataaactagtaaaagaaacttagatttccctaatttaatcttgactccgattttgatagtgctatataaaaaggtatttaaacccatatgcttccttttacataaaagaaagatatcaactttcctagtttgcatttacactggctaataggataataaaatgctgtgtaaatgttaaactggaagtttctctgagttatttttactttaaaatttcatgtgattatgccattttgaatatgtatattacatgtaattgtataatgttaactcgggtaggcaaaattcttggtattaaatttaggatgttttaaaaattattaagaagatattaatgtctgctttttgatagcatatattttcatgtaatgtttagtgtattaaaatcaaccattcaagatttattttattgggtgacactattgactgtgttccaaaatgcccatagtgttaggaaatgtggtgtgagttttatttgtgggctaaggataaaataatcatatgctaatataccttttattataaatgactaaaaatttggatataaaactgatgttttactacacaaattacagagagagataatataattatataattattaaataattagaaaatgcaaataagcaaaagtcacccatgttcccagttctcatctcctgaagatagttataactaacatattattttgtactcttcctgttaattagtttctagtgtactttctcctgtagctgaaattaagctgagaaaaaaggaagagatagttcctccctcctctttctctctcccactctgtctctctcctgtgctatctgtgtgtatatacaaatatgtatgcatatatatataatgatgtacataatatatataaaatacaaatactaatgtgcatattttcaaacatacacatattttttattatttgaaataagaatgagtcagactacatatttggtagccagatttttttcactcagtgatatatcatgaacatatttccatgctaatataattttctaataattttagatgctgtaactacaatttcattgttaatgggcaatttgttgctttacaaatggtaaattatatgataaataatatgatcattattcttgtagccaatatcattattagaaatgatggaccgcattaaagctataaaattaaataagaatttataaatgtaaggagttattcagacatcttgtatctagtattacaatatcagaaaactcagcaggttatatgacatatacactttgagatagtcactcagaggttttcacatacaggattaaccttgctgcagtgcgtgtgcaagattaaaaaagatgtcacgggtcactttgtaatgtcatatcgttgctgttgataaataaaggaaatgttataaataaaa

SEQ ID NO: 32263 - DNA, 1674 bp, Homo sapiens
gcggccgcccgccgccgcgctcctcctcctcctcctccagcgcccggcggcccgctgcctcctccgcccgacgccccgcgtcccccgccgcgccgccgccgccaccctctgcgccccgcgccgccccccggtcccgcccgccatgcccggcccggccgcgggcagcagggcccgggtctacgccgaggtgaacagtctgaggagccgcgagtactgggactacgaggctcacgtcccgagctggggtaatcaagatgattaccaactggttcgaaaacttggtcggggaaaatatagtgaagtatttgaggccattaatatcaccaacaatgagagagtggttgtaaaaatcctgaagccagtgaagaaaaagaagataaaacgagaggttaagattctggagaaccttcgtggtggaacaaatatcattaagctgattgacactgtaaaggaccccgtgtcaaagacaccagctttggtatttgaatatatcaataatacagattttaagcaactctaccagatcctgacagactttgatatccggttttatatgtatgaactacttaaagctctggattactgccacagcaagggaatcatgcacagggatgtgaaacctcacaatgtcatgatagatcaccaacagaaaaagctgcgactgatagattggggtctggcagaattctatcatcctgctcaggagtacaatgttcgtgtagcctcaaggtacttcaagggaccagagctcctcgtggactatcagatgtatgattatagcttggacatgtggagtttgggctgtatgttagcaagcatgatctttcgaagggaaccattcttccatggacaggacaactatgaccagcttgttcgcattgccaaggttctgggtacagaagaactgtatgggtatctgaagaagtatcacatagacctagatccacacttcaacgatatcctgggacaacattcacggaaacgctgggaaaactttatccatagtgagaacagacaccttgtcagccctgaggccctagatcttctggacaaacttctgcgatacgaccatcaacagagactgactgccaaagaggccatggagcacccatacttctaccctgtggtgaaggagcagtcccagccttgtgcagacaatgctgtgctttccagtggtctcacggcagcacgatgaagactggaaagcgacgggtctgttgcggttctcccacttttccataagcagaacaagaaccaaatcaaacgtcttaacgcgtatagagagatcacgttccgtgagcagacacaaaacggtggcaggtttggcgagcacgaactagaccaagcgaagggcagcccaccaccgtatatcaaacctcacttccgaatgtaaaaggctcacttgcctttggcttcctgttgacttcttcccgacccagaaagcatggggaatgtgaagggtatgcagaatgttgttggttactgttgctccccgagcccctcaactcgtcccgtggccgcctgtttttccagcaaaccacgctaactagctgaccacagactccacagtggggggacgggcgcagtatgtggcatggcggcagttacatattattattttaaaagtatatattattgaataaaaggttttaaaagaaaaaaaaaaaaaaaaaa

SEQ ID NO: 32264 - DNA, 3767 bp, Homo sapiens
ggctaggtttagcttcaggggcagcccagggcagtgttgctgcatattgcatggatgaaaggctgaaggctgcctcctcttgcaggctggcttctgagattgcaccttcttctcctgctactcctccaaatctatgacccttcaaggcagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagccccagcacgagggcctcaagtccaaggagcatcttccgcaacagcctgccgaaggcaagacggcgtcccgccgcgtcccacgcctccgggctgtggtcgagagccaggccttcaagaacatcctggtagacgagatggacatgatgcacgcccgtgcagccacgctcatccaagccaactggaggggctattggctccggcagaagctgatttcccagatgatggcggccaaggccatccaggaggcctggcggcgcttcaacaagagacacatccttcactccagcaagtcgttggtaaagaaaacgagggcggaggagggggacataccttatcacgccccacagcaggtgcgcttccagcatccggaagagaaccgccttctgtccccgcccatcatggtgaacaaggagacccagttcccttcctgtgacaatctggtcctctgcagaccccagtcgtcccccctcctgcagcccccagcagctcagggtaccccagagccctgtgtgcagggtcctcatgctgccagagtccgggggctggccttcctgccacaccagacggtcaccatcagatttccctgcccagtgagtttggacgcaaaatgccagccatgcctgctgaccagaaccatcagaagcacctgcctcgtccacatagagggtgactcagtgaagaccaaacgtgtaagtgcccggaccaacaaagccagggctccggagacaccattgtccagaaggtatgaccaggcagttacgagaccatccagagcccaaacccagggccctgtgaaagcagagacccccaaagcccccttccagatatgtccagggcccatgatcaccaagactctactccagacatatccagtggtctccgtgaccctgccacagacatatccagcgtccacgatgaccaccaccccacccaagactagcccagttcccaaagtaacaataatcaagaccccagcccagatgtatccggggcccacagtgaccaaaactgcacctcacacatgccccatgcccacaatgaccaagatccaggtacaccccacagcctccagaactggcaccccacggcagacatgccctgcgaccatcacggcaaagaaccgacctcaggtttcccttctggcttccatcatgaagagcctgccccaggtatgcccggggcctgcgatggcaaagaccccaccccagatgcacccggtcaccaccccagccaaaaacccattgcaaacatgtctgtcagccacaatgtccaagacttcatcccagaggagcccagttggggtgaccaagccctcaccccagacccgcctgccagccatgataaccaagaccccagcccagttacgctcggtggccaccatcctcaagactctgtgtctggcctctccaacagtggcaaatgtcaaggctccaccccaagtggcggtagcagccggaactcccaacacctcaggctccatccatgagaacccacccaaggccaaggccaccgtgaatgtgaagcaggctgcaaaggtggtgaaagcctcatccccctcctatttggctgaggggaagatcaggtgcctggctcaaccacatccgggaactggggtccccagggctgcagctgagcttcctttggaagccgagaaaatcaagactggcacccagaaacaggcgaaaacagacatggcatttaagaccagtgtggcagtggaaatggctggggctccatcctggacaaaagttgctgaggaaggggacaagccacctcacgtgtatgtgcctgtagacatggctgtcaccctgccccggggacagctggctgccccactgaccaatgcctcatcccagagacatccaccctgcctgtcccagagaccactggccgccccgctgaccaaggcctcatctcagggacatctgcccactgagctgaccaagaccccatccctggcccatctggacacctgtctgagcaagatgcattcccagacacatctggccacaggtgccgtgaaggtccagtcccaagcgcctctagccacctgtctgaccaagacgcagtcccgggggcagccgatcacagacataaccacgtgcctcatcccagcgcaccaggctgctgatctcagcagcaacacccactcccaggtgctcctaacagggtccaaggtgtccaaccacgcctgccagcgcctcggtggcctcagcgccccaccctgggccaagccagaggacagacagacccagccacagccccacggacacgtgccggggaagaccactcaggggggaccatgcccggcagcctgtgaggtccagggtatgctggtgccgccgatggcacccaccggccattccacatgcaacgttgagtcctggggagacaacggagccacacgtgcccagccatcaatgcccggccaggcggtgccctgccaggaggacacgggccccgcggacgctggtgtggttggtggccaatcgtggaaccgcgcatgggagccagccaggggtgctgcgtcctgggacacctggcgcaacaaggcggtggtgcctcccaggcggtccggggagccaatggtgtccatgcaggctgcagaggagatccgcatcctcgcagtgatcactatccaggcgggcgtccgtggctacctggcgcgtcgcaggatccggctgtggcaccggggggccatggtcatccaagctacttggcgcggctaccgtgtgcggcggaacctggcacacctctgcagagccaccacgaccatccagtctgcctggcgcggctacagcacccgccgggaccaagcccggcactggcagatgctccaccccgtcacgtgggtggagctgggcagccgggccggggtcatgtctgaccgaagctggttccaggatggcagagccaggacagtatctgaccatcgctgcttccagtcctgccaggcacacgcttgcagcgtctgccactccctgagctccaggatcgggagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcgaggccaccatacccggagctgtctgaagaacacagaggcgctcttgggaccagcagacccctcggccagctcacggcacatgcattggcctggcatctaggaccctggctccctgcagtggggacttcgtgggaggcactcatggctctctgggtctaatgaataaagtcctccacagcctaaaaaaaaaa

SEQ ID NO: 32265 - DNA, 2034 bp, Homo sapiens
atgccggaccgcgcatgcgccgtcggcagcgtcgcgcgcgccctgtcgcgcagccggcgctacgtgtgcgcccgggacgcggacgcaagccgccgacggaggaggccttttaactacggcctctccatcgaagaaaaaaatgaaaatgatgaaaactcattaagcagttcctctgacagtagtgaagacaaggatgaaaaaataagtgaagaatgtgatattgaagaaaagactgaagtgaaagaagaaccggagcttcaaacaaaaagggaaatggaagaaagaacagtaactctagaaatccctgaagttctgaagaggcagctggaggatgattgttactacattaatcggaggaaacggttagtgcaacttccatgccacaccaacatcataacgattttggaatcctatgtgaagcattttgctatcagtgcagccttttcagccaatgagaggcctcgtcaccatcacgctatgccacatgccagcatgaacgtgccttatatcccagcagaaaagaatattgacctttgtaaggagatggtggatggattaagaataacctttgattacactctcccgttggttttactctatccctatgaacaagctcagtataaaaaggtgactgcatctaaggtttttcttgcaattaaggaaagtgccacaaatactaataggagccaggagaagctctctcccagcttacgtttgttgaatccatccaggccgcagtctacagagagtcagtcgaccagcggtgaaccagccacccctaaaaggcgcaaagccgagccgcaagcagtgcagtctctgaggcggtcctcgccccacaccgccaactgtgacaggctttctaagagcagcacctcacctcagcccaagcgctggcagcaggacatgtccaccagtgtgcccaagctgttcctgcacctggaaaagaagacacctgtgcatagcagatcatcttcacctactctgactcctagccaggaagggagtcctgtgtttgctggctttgaagggagaagaactaatgaaataaatgaggtcctctcctggaagctcgtacctgacaattacccaccaggtgaccagccacctccaccctcttacatttacggggcgcaacatttgctgcgattgtttgtcaaacttccagaaattcttggaaaaatgtcctttactgagaagaatctgaaggctttattgaagcactttgatctctttgtgaggtttttagcagaataccacgatgacttcttcccagagtcagcttacgtcgctgcctctgaggtgcattacagcaccaggaacccccaggcagtcaataagtgttgatggttctgtaagaacaactgctccatctagcatggtgttctgagttccaggtaaaaaattaacaaggtggtgggtttttatccagagcacaaaacaaagtgcccaccagggggctttgacagaggtgtgccctgttgtttgagttccccatgtactgtagttactctgtttagaattatttcctaggtgcctgaaagtgttctgacatgacacttgctactttgtaggccatctgtgatggcaggtaaaaagcaactgttcacagtgaaatgttcatggaagtgtacataggttaggccatttcagcagacattgcagttagtcagcaagaaccacattgtttcgttatttgttagcattaaacaaaattttttttgcaaattggtttcattctcttgatgaagctgagcaactgtccaacaaggtttagtttgtacttgaaaactgcaaagtagtctcaaagtattttagagggaatccatattgatggcaaaagaaaatttgcagctataatttgcttctgacggttccttctctgtgaaacattatttttggtgatctaaagaaagcattgcctttcttgtttgcaattttacagctatacttttttgtgtaatgttacggttccctttctgtaaaatgttctttttggtgatctaaataaagcctctcttgtttgaaaaaaaaatt

SEQ ID NO: 32266 - DNA, 1836 bp, Homo sapiens
atgaccatccacatcgcggggggcacccgcccccctgcgatgggggtcctaagagccggggggcggagaggggttggctcttactccctacattgcggctgtggctatggctctggctctggctgtggctatggaactggcttcggctgtgggtatggctgtggttatggaactggctatggctgtggatgtggctctggctctggctactgtggctaccggccattttgctttagaagatgctattcttcctgctaaaacatcactgtcagaggacaatttgcttctaaaatgacacggctaaagataatactgattcaaggattcatactccaagatttctatatccaagaattacatgcttgacagagtcttggacctctagcctcacatttctttgaatgaaatcatggccataggatccacggtgtcatctgactgttttccaaatgttatcttttgctcccttaatctctgactctctgttatgactgtgttaatgatcataacatctacaattggggaagtcaatcatttgtaataaaaatggttctttattccaaaaaaaaatgttttagtacaaaagagtcaaaaagctaaaataaaatatagtttataaagcaaaaaattatcagtaagctaagtttaatgtattattgaagaaataaaatgtattttatacatttaccctaatgcctaatgtttaagacatctactgtagtgtacagtaatatcccaggccttcacattcactcactaatcactcactgatccacccagaacaattttcagccctgtaagtgccattcgtgctaagtggtctatataggtactgttttattattattattattattattattattattttatactgtgtttttactgtatcttttctagatttcaataagttgagatacacaaatatttattattgtgttacaattgcctatattatccaatatggtaacatgctgtgcaggtttgtattctagaagcaataggctataccttataatctaggtgtgttctaagctatatcatacaggtttatgtaagtacactgtgaaatctgcatggcaaacatcattgccttatgatacatttctcaaattttcagaacatatccctgttgtttagcagcacgtgaatgtatttgatttattgtcttgatgtccctttgctttccccatgtgttaccatcaactgcctaatgaaacagcctgggattgtgtaatgactaacttagtgctttgagtttaattctttttcagccactgtggtatgttgattactatattaataatgtgtctcctttatgtgtttttaaatagttacttggtcatgaactatttataagctttggaaacatgatttcatttattctgcaggataacttcaggaagtgggtattaattctcactgtataagtgaagacattaagcaccagagtttaagtagcttgatccactgaaagagattcaactgtgtggaacctatgccgcggagaattgctttctgccattgttattgtccagcagttgccgaatagctctgacctgagcaaagcagtgaaacgcggtgctgttgagtgggttgccactgcacctttttcaactactctagtcttgtggagaaaacaccccttctaaattttttcttcattgaatactctccctcagctccagggtaccatatagagttttcttgtattttagagttactgttttatcaaagtgtaccagtcttttgtattacatttctcctgtctaaatcaactgtgtggtttctactcattatggatatagattgacacaaactcaataaatatttttg

SEQ ID NO: 32267 - DNA, 1844 bp, Homo sapiens
atgtctatagaatattacaactcatatcactgtgtgactctgtgtacaccccgtgtgactttaggagtaacatcccacaaaactatgatgaaaaatatcacaggctgtggctatggctctggctctggctgtggctatggaactggctacggctgtgggtatggctgtggttatggaactggctatggctgtggatgtggctctggctctggctactgtggctaccggccattttgctttagaagatgctattcttcctgctaaaacatcactgtcagaggacaatttgcttctaaaatgacacggctaaagataatactgattcaaggattcatactccaagatttctatatccaagaattacatgcttgacagagtcttggacctctagcctcacatttctttgaatgaaatcatggccataggatccacggtgtcatctgactgttttccaaatgttatcttttgctcccttaatctctgactctctgttatgactgtgttaatgatcataacatctacaattggggaagtcaatcatttgtaataaaaatggttctttattccaaaaaaaaatgttttagtacaaaagagtcaaaaagctaaaataaaatatagtttataaagcaaaaaattatcagtaagctaagtttaatgtattattgaagaaataaaatgtattttatacatttaccctaatgcctaatgtttaagacatctactgtagtgtacagtaatatcccaggccttcacattcactcactaatcactcactgatccacccagaacaattttcagccctgtaagtgccattcgtgctaagtggtctatataggtactgttttattattattattattattattattattattattttatactgtgtttttactgtatcttttctagatttcaataagttgagatacacaaatatttattattgtgttacaattgcctatattatccaatatggtaacatgctgtgcaggtttgtattctagaagcaataggctataccttataatctaggtgtgttctaagctatatcatacaggtttatgtaagtacactgtgaaatctgcatggcaaacatcattgccttatgatacatttctcaaattttcagaacatatccctgttgtttagcagcacgtgaatgtatttgatttattgtcttgatgtccctttgctttccccatgtgttaccatcaactgcctaatgaaacagcctgggattgtgtaatgactaacttagtgctttgagtttaattctttttcagccactgtggtatgttgattactatattaataatgtgtctcctttatgtgtttttaaatagttacttggtcatgaactatttataagctttggaaacatgatttcatttattctgcaggataacttcaggaagtgggtattaattctcactgtataagtgaagacattaagcaccagagtttaagtagcttgatccactgaaagagattcaactgtgtggaacctatgccgcggagaattgctttctgccattgttattgtccagcagttgccgaatagctctgacctgagcaaagcagtgaaacgcggtgctgttgagtgggttgccactgcacctttttcaactactctagtcttgtggagaaaacaccccttctaaattttttcttcattgaatactctccctcagctccagggtaccatatagagttttcttgtattttagagttactgttttatcaaagtgtaccagtcttttgtattacatttctcctgtctaaatcaactgtgtggtttctactcattatggatatagattgacacaaactcaataaatattttt

SEQ ID NO: 32268 - DNA, 5858 bp, Homo sapiens
tcccatgaagtgaccaggatagagaagcaccagaaccgccaaaagtatgggctgtgcgtcatcttcctttcctgtaccatgatgcccaactttaaagagctgatccatttcgaggtcagcatcggtcactatgggaacaagatggacctgaattacaagcctctagtctcaagcacaccgtacagcccagtgatatatgatgggaacatctaccattatgtgccctggtacaacaccaagcctgtcgtggccgtgacctccaactgggaggacgtcagcttccgcatgaactgcctcaacctcctccacttcactcgggaccgcctgaaagccaacctggacaccctgaaatccacgcggaatccgaaggatccagctctcctctaccagtgggagaaactgctgagggagctggcagaggactgcaagcgccctctgccctgcatgacctatcagcccaaagccaccagcctggacaggaagaggtggcagctccgcagcctcctcctgcaggaactggcccaaaaggccaagcaagccaagcccaaggacatggtggccacagcggaggactggctgtaccgcctcaacaccgtgctccctgagccccagatgggcctccctgacgtgatgatttggctggtggccaaggagcagcgagtggcctatgcacagtacccagagggtgaaggacagaaggatgtgctcccagctcacctccgggtctgcatgtggcttggcaatgtcacagacagcaaggacctgcagctgctccgccagggtgacacagcggtgtacgccgagatggtgagtgtatgagaatcaggccaagtataaagaccagtgggggcagcaggggctgtatcactgccccaacttctcggatgtcatggggaacaagaccctccccatgacggatttccaaccacccctgggatggcactggcaggacagctggacagtggaacctcagagaaggctcctcctggacatagacatcaacaagagccaggtgctggaggaggtatatgagaaccagggccgtgacaccagaggggcctgggggcctgccgccatcccaaacacagacgtgaatggacagcccatggaggcccgggagaacgtgaagtgcccccaaggctggcactttaagaaggactgggtggtggagctgaaccacgcagtggacagtaagggctgggagtatggagtggggatcccaccgtcgggcctgccccaggtctggagcccggtggagaagacctaccactcgtgccgccgccggcgctgggcgcgtgtgcgcttcaggaaccatggggagctgagccacgagcaggagaccctctccttcctgcagctgggcctggccaagggcgaggaggagggctgggagtatgacaccttcggctccaagttccacctcaaccctcagccccagagccggttccgccgccgctgctggcgccgcaggctggcccccaacaaggacaagggcatcgcgcccatattcctcctggaggggtccttggctatggatctgaaataccacgctgggaaggaagaggacagcaagacatggccatggggtctggacagacagttcagggacccccagaggcaggacacccggccccccaacttgcccttcatctactgcaccttcaataagccccactactaccagctcttctgctacatctaccaggcccggaacctggtgtccaatcagatcctgacattccaagggcccttcattcgggtggtcttcctgaaccacagccagtgcacccaaaccctgaggagctctgcaggccccacatgggcccagacactcatcttccagcacctccttctgtacgagaacccacaggacaccaaagagagcccaccgcttgtggtgctggagctgtggcagcgtgacttctggggcaaggagagcttgtggggacggagcgtgtggcccccaatggtctggctggatctccaggaccggatcctgccccccatgaggtggcatccccttgtaaaggagttggggaaggaagagggcgagatcttggcatcctgtgagctgatcctccagactgagaagcttggagagaagcagctgcctatcttaagcgttccctggaagaatggggcatacacactccccaagagcatccagcccacgataaagaggatggccattgaggtgctggcgatgtgggatggggacggtgggcaggacaggcgggggtggtctggagtgcgctgcagccttctgctggtcctccctgactactggatccaaagctcacaccccgaaaaagactacctgggaggtggagggagacaggagagaaacgaagaggttctggtgtaacactggaaatcattttaccacaaacctctgcagtgaggagtaggcaaagggctgtagcatgcatgatcacttgtgggactcacgctgcccctgcgcagtagcaactactttgcagagaaggaaatagaggctccaagagataacacattccacgcacagtgatgcagggactaactgacagggccatttaggcccagccctgtctgactgcagatgccaggatgttgctcacctctcttctgagagtagcatgagggtcctcattcagaagctgtgtgccctgccgcaaatgtggcaaagagcacaagacggtcaggcctctgggactgaaggcttccccaagatcaggcaacttggctggttcccgctttaggccccgaggaggcccaaagtcagggtgcagctatttcctggcaggatgccaggtcactgaatggccatggggtcctcaatgagctagacggcacaggggccctgagaaatccaggcacttcctgcttcttcaggcctcagaggcagtcggcttcaggaactcctacctgagaactgatgaggccagacaaggcagcgggtgaggaggggcaatgcctgcgggctatggaggtcagtggaggatgcagccagtggccagaggtcacctccctcatgggttgggggacagcgtcccagccccgagggcaagcactgatccctcacaggacggggaagcctgtccttgtgcgccttcagacactggctcctctgcagccccattccctggccctgcaggctcctgctgcaccgctattgcccctcagcccccttctctggccaggaccccattacagaggcgctgcctgccccttgtcctgccctccttctttgttctggtagatcctggcctggggccttcggaacatgaagaaggcgagctccccccagctcctggtggaattcggggaagagtccctgaggacagaacccatcagggactttcagaccaaccccaacttccccgagtctgagtctgtcctagtcctcacagtgctcatgccgacggaggaggcctatgcactgcccctcgtggtgaaggtggtagacaactgggccttcggccagcagaccgtgacgggccaggccaacatcgacttcctccagccctacttctgtgacccctgggctcaagactatatgcacccaaagcttccaacgctgtctgagaagaagcaccaagacttcctaggctacctctacagaaagttctggttcaagtccagtaaagcagaggatgagtatgagcatgaggtggactggtggagcaagctgttctgggccacagatgagcacaagtccctgaagtacaagtacaaagactaccacaccctcaaggtgtatgagtgtgagctggaggccgtgccagccttccagggcctgcaggacttctgccagaccttcaaactctaccaggagcagcccaagttggacagccccgtggtaggggagttcaagggccttttccgcatctacccctttcctgagaatccagaagccccaaagcccccgctgcagttcttggtttggccagagagagaggacttcccccagccgtgcttggtgcgggtgtacatggtacgagccatcaacctgcagccccaggactacaatggcctgtgtgacccttatgtgatcctgaaactgggcaagacagagcttggcaaccgggacatgtaccagcccaacactctggatcccatctttggcatgatgtttgaactcacctgcaacatacccctggagaaggacctagagatccagctctatgacttcgacctattttcacctgatgataagataggaaccacagtcatcgaccttgaaaaccgactcctatctggctttggagctcattgtgggctctccaaatcctactgccagtcagggccctttagatggcgggatcagatgcccccaagctacctcctagaacgctatgccaagcggaaagggctacctccgcctctgttcagtcctgaggaagatgctgttttctataatgggaaaaagttcaagctgcaaagctttgagcccaaaacccctactgttcatggtttgggacccaagaaggaacgccttgcactgtacctcctgcacacccaggggctggtacctgagcacgtggagacccgcacactgtacagccacagccagccaggcatcgaccagggaaaggtgcaaatgtgggtggacatcttccccaagaagctggggcctcctggcccccaagtcaacatcaaccccagaaagcctaaacggtatgagctgcgatgcatcatctggaagactgccaatgtggacctggtggatgacaatttaagtagagagaagacgagcgacatctacatcaaagggtggttatacgggctggagaaggacatgcagaagacagacatccactaccactcgctgactggggaggccgacttcaactggcggttcatctttaccatggactacctggcggcggagcgcacgtgtgtccagagccagaaggattacatatggagcctggatgccacgtccatgaagttcccagcccgacttatcatccaggtctgggacaatgacatcttctcccccgacgacttcctaggggtcctggagctggatttgtctgacatgcccctcccggctcggcacgccaagcagtgctccatcaggatgatggacgccgaccccaagtggccctatttcatccaatacaagcacttctccctctttaagaagaagactgtgactggctggtggccttgccaggtcctcgatggtggcaaatggcgcttgtcgggcaaggtgaagatgagcctggagattctgtcagagaaggaagccttaatcaagccagccgggcgaggccagtcggaacccaaccagtaccccacacttcatcctcccctacgcaccaacacctctttcacgtggctgcggtcaccagttcaaaacttctgctatattttctggaaacgctatcgcttcaaactcatagcctttatggtcatatcgattatagcacttatgctgtttaacttcatctattcagctccgcactatttggccatgagctggatcaaacctcaacttcagctgtatcctcccattaaaatattcaatatcatcaattcactaaacaccagcaacgccagctcttccatccttcccacccaggatccaaacctaaagcctacaatagaccatgagtggaaactccacccaggacccacaaatcacctgagtgatattttcccagaacttccagccccaggagactaattagtccatgctgcctggctttcctcctgctaccaacagccctccccttgggctggctaccagttctttgtttctatcttctagaatatatgcaagatgctaggaatattctggctattgtgttcagaaatcactttcaacaagacgagcagagctgtaattttccactgaaataaacaagttctat

SEQ ID NO: 32269 - DNA, 6864 bp, Homo sapiens
atgctgcggcttgtggtgcagtcggccaagattgacccaccactagccccactacccaggccctgcatgtccatcgacttcagagatatcaagaaaagaactcgtgtggtggaagggaatgatcccgtgtggaatgagaccctaatctggcacctctggaaccgccccctggaaaatgactccttcctgcaagtcacccttcaggacatgggctcacaaaagaaagaaagattcattggcctggccacagtactgctcaagccattgttgaaacaaccaagtgaggtcctttttgtgaaggacttgaccctgctcaaccattccatgaagcccacagattgtactgtcaccctacaggtggcccacatgagcaaccaggatattgagaagacaggagctgaagaccacctgggcataacggcaagagaggcagccagtcagaaactgatggtccctggctccactgcgcacagggctctgtcctcaaagcctcagcactttcaggttcgagtgaaggtgtttgaagcccgacagctcatgggcaacaacatcaaaccagtggtgaaggtgtccatcgcaggccagcagcaccagacacgcatcaagatgggaaacaaccctttctttaatgagatcttcttccagaattttcatgaggttcctgcaaagttctttgatgagaccatcttaatccaggtggtgaactcctcagcaatgagatacaaagcagagatcgggagatttcaaacagatattgggtttatctaccattctccaggtcacacactcctaaggaaatggctaggcctctgccagccaaataaccctggcagtggtgtgacaggctacctgaaagtcaccatctatgccctcggtgtgggagaccaggccctgatagatcaaaagctgctctatggcaccgatgacaccgatattcagatcttcaagtcagcggtagtcccgatcaacatggcttacttacagctcttcatctactgcgcagaggaccttcacctcaagaaacaccagtcagtgaatcctcagttggaggtggaactaattggggaaaagctcaggacacacatgcagacccaaaccgacaacccgatatggaaccagatcctgaccttccggattcagctaccctgcctctccagctacatcaagttcagagtcttggactgccgcaagaaggactgcccggatgagattgggactgccagcctgtccctcaaccagatctcgtccaccggagaagagatagaaggagtgtactccggcttcctgccctgctttggccccagcttcctgactctgcatgggggtaaaaaggcccctttcaggatccaggaagaaggcgcttgtattcccgactctgttagggatggtttagcttatcgaggccgagtcttcctggagttaatcacccaaatcaagtcctatcaagactccacgataaaggatctctcccatgaagtgaccaggatagagaagcaccagaaccgccaaaagtatgggctgtgcgtcatcttcctttcctgtaccatgatgcccaactttaaagagctgatccatttcgaggtcagcatcggtcactatgggaacaagatggacctgaattacaagcctctagtctcaagcacaccgtacagcccagtgatatatgatgggaacatctaccattatgtgccctggtacaacaccaagcctgtcgtggccgtgacctccaactgggaggacgtcagcttccgcatgaactgcctcaacctcctccacttcactcgggaccgcctgaaagccaacctggacaccctgaaatccacgcggaatccgaaggatccagctctcctctaccagtgggagaaactgctgagggagctggcagaggactgcaagcgccctctgccctgcatgacctatcagcccaaagccaccagcctggacaggaagaggtggcagctccgcagcctcctcctgcaggaactggcccaaaaggccaagcaagccaagcccaaggacatggtggccacagcggaggactggctgtaccgcctcaacaccgtgctccctgagccccagatgggcctccctgacgtgatgatttggctggtggccaaggagcagcgagtggcctatgcacaggtgcctgcccactccgtcctcttctccccggcaggggctctgcactccggcaggctctgtgggaagatacagacactcttcctacaggtgggaatcagggactcctcaggggaggacagggctgagaaatgcccccaggggagccccctgaactcgcagggcagcccctatggggcctgttttcctggtcccttaaccacatggaatggggttgaaacagtccccagaggaagagaggggtctgtggctgtcagcatgttgggtgatgccaagtccatgtacctcctaaatgttccccaaatccacctcctcgctgggcacggtggctcacagtacccagagggtgaaggacagaaggatgtgctcccagctcacctccgggtctgcatgtggcttggcaatgtcacagacagcaaggacctgcagctgctccgccagggtgacacagcggtgtacgccgagatggtttattccgagctttctcctagttcatcaacagcacgtgaagtgagcaaggctctgacttgcaggggcctcacccatcaccaacagggcagcccgggacccctgcaggccccagtggggtcccaggagtatgagaatcaggccaagtataaagaccagtgggggcagcaggggctgtatcactgccccaacttctcggatgtcatggggaacaagaccctccccatgacggatttccaaccacccctgggatggcactggcaggacagctggacagtggaacctcagagaaggctcctcctggacatagacatcaacaagagccaggtgctggaggaggtatatgagaaccagggccgtgacaccagaggggcctgggggcctgccgccatcccaaacacagacgtgaatggacagcccatggaggcccgggagaacgtgaagtgcccccaaggctggcactttaagaaggactgggtggtggagctgaaccacgcagtggacagtaagggctgggagtatggagtggggatcccaccgtcgggcctgccccaggtctggagcccggtggagaagacctaccactcgtgccgccgccggcgctgggcgcgtgtgcgcttcaggaaccatggggagctgagccacgagcaggagaccctctccttcctgcagctgggcctggccaagggcgaggaggagggctgggagtatgacaccttcggctccaagttccacctcaaccctcagccccagagccggttccgccgccgctgctggcgccgcaggctggcccccaacaaggacaagggcatcgcgcccatattcctcctggaggggtccttggcttgcgagggtggcagtgtgagggaggagggtgactgggcctgggctagaggaaacaggagcagcacccaagagcctcaggggagactgtcctgggtacaggctatggatctgaaataccacgctgggaaggaagaggacagcaagacatggccatggggtctggacagacagttcagggacccccagaggcaggacacccggccccccaacttgcccttcatctactgcaccttcaataagccccactactaccagctcttctgctacatctaccaggcccggaacctggtgtccaatcagatcctgacattccaagctgctcagcagtgtaaagacaggggcatggatgagggtgacaaagacgcagacccctctcccaagcagctcatggtcctgtggctgcagcagcagaggagaggaaagcccctcttcccagctcaagacactgctaccttctcctctacccctccagggcccttcattcgggtggtcttcctgaaccacagccagtgcacccaaaccctgaggagctctgcaggccccacatgggcccagacactcatcttccagcacctccttctgtacgagaacccacaggacaccaaagagagcccaccgcttgtggtgctggagctgtggcagcgtgacttctggggcaaggagagcttgtggggacggagcgtgtggcccccaatggtctggctggatctccaggaccggatcctgccccccatgaggtggcatccccttgtaaaggagttggggaaggaagagggcgagatcttggcatcctgtgagctgatcctccagactgagaagcttggagagaagcagctgcctatcttaagcgttccctggaagaatggggcatacacactccccaagagcatccagcccacgataaagaggatggccattgagatcctggcctggggccttcggaacatgaagaaggcgagctccccccagctcctggtggaattcggggaagagtccctgaggacagaacccatcagggactttcagaccaaccccaacttccccgagtctgagtctgtcctagtcctcacagtgctcatgccgacggaggaggcctatgcactgcccctcgtggtgaaggtggtagacaactgggccttcggccagcagaccgtgacgggccaggccaacatcgacttcctccagccctacttctgtgacccctgggctcaagactatatgcacccaaagcttccaagtacggcccttcctccgtgcctttccccaggcctcacaagcgagcctgcactgggagtggggcaggccctgctaccccgtgggttcctaggctacctctacagaaagttctggttcaagtccagtaaagcagaggatgagtatgagcatgaggtggactggtggagcaagctgttctgggccacagatgagcacaagtccctgaagtacaagtacaaagactaccacaccctcaaggtgtatgagtgtgagctggaggccgtgccagccttccagggcctgcaggacttctgccagaccttcaaactctaccaggagcagcccaagttggacagccccgtggtaggggagttcaagggccttttccgcatctacccctttcctgagaatccagaagccccaaagcccccgctgcagttcttggtttggccagagagagaggacttcccccagccgtgcttggtgcgggtgtacatggtacgagccatcaacctgcagccccaggactacaatggcctgtgtgacccttatgtgatcctgaaactgggcaagacagagcttggcaaccgggacatgtaccagcccaacactctggatcccatctttggcatgatgtttgaactcacctgcaacatacccctggagaaggacctagagatccagctctatgacttcgacctattttcacctgatgataagataggaaccacagtcatcgaccttgaaaaccgactcctatctggctttggagctcattgtgggctctccaaatcctactgccagtcagggccctttagatggcgggatcagatgcccccaagctacctcctagaacgctatgccaagcggaaagggctacctccgcctctgttcagtcctgaggaagatgctgttttctataatgggaaaaagttcaagctgcaaagctttgagcccaaaacccctactgttcatggtttgggacccaagaaggaacgccttgcactgtacctcctgcacacccaggggctggtacctgagcacgtggagacccgcacactgtacagccacagccagccaggcatcgaccagggaaaggtgcaaatgtgggtggacatcttccccaagaagctggggcctcctggcccccaagtcaacatcaaccccagaaagcctaaacggtatgagctgcgatgcatcatctggaagactgccaatgtggacctggtggatgacaatttaagtagagagaagacgagcgacatctacatcaaagggtggttatacgggctggagaaggacatgcagaagacagacatccactaccactcgctgactggggaggccgacttcaactggcggttcatctttaccatggactacctggcggcggagcgcacgtgtgtccagagccagaaggattacatatggagcctggatgccacgtccatgaagttcccagcccgacttatcatccaggtctgggacaatgacatcttctcccccgacgacttcctaggggtcctggagctggatttgtctgacatgcccctcccggctcggcacgccaagcagtgctccatcaggatgatggacgccgaccccaagtggccctatttcatccaatacaagcacttctccctctttaagaagaagactgtgactggctggtggccttgccaggtcctcgatggtggcaaatggcgcttgtcgggcaaggtgaagatgagcctggagattctgtcagagaaggaagccttaatcaagccagccgggcgaggccagtcggaacccaaccagtaccccacacttcatcctcccctacgcaccaacacctctttcacgtggctgcggtcaccagttcaaaacttctgctatattttctggaaacgctatcgcttcaaactcatagcctttatggtcatatcgattatagcacttatgctgtttaacttcatctattcagctccgcactatttggccatgagctggatcaaacctcaacttcagctgtatcctcccattaaaatattcaatatcatcaattcactaaacaccagcaacgccagctcttccatccttcccacccaggatccaaacctaaagcctacaatagaccatgagtggaaactccacccaggacccacaaatcacctgagtgatattttcccagaacttccagccccaggagactaa

SEQ ID NO: 32270 - DNA, 3958 bp, Homo sapiens
ttttcaagaggctgcagctgacaagaagcttcaagcataggttaatatcagagaagcacatgacctgggcaatctgcatgtgatgccaaccaagccttggaaagacagtgcaaccacagaagtgccgagctgggtaaaggccctgctggacaagcagttggagtgagaatcaagacagccggaccacaggaccagacccaccaggatccacatgacagtggtatcttccggtatcatcctattcaaacaacgtgttcaagcatccttggaaaattgaggtggagaacaggccacacaagctgtaaaccctttgtagtcataagacgaaagaggatttgttaagagtattgttttgggtagaacttgcattagcagtgacaaagatagccacctcaacctttggtaataacccttggcacacaaatataaaccataatggagtctgagtatgtcctatgcgactggaaagaccagttgtggccagcaaaagttttgtccagatctgaaacttcatcaaacagtaagaggaaaaaggcattttctctagaagttcaaatactctcactagatgaaaaaattaaattggacagcacagaaacaaagatcctaaataaatctcaaattgaagccattgctgcctcattaggactacagtcagaggacagtgctccacctacagaggaaactgcctatggaagatcactaaaagtggcactgggtattctgaatgagagaacaaatttgagtcaagcaagcacttcagatgaagaggagatcactatgctgtctcaaaatgtaccacaaaaacagtccgattcaccccctcataaaaaataccggaaggatgaaggtgacttaccagggtgtcttgaggaaagggaaaactcagcatgcttgttagcatcttcagagagtgatgattccctgtatgatgataaatcacaagcacccacaatggtcgatactattccaagtgaagtggaaacaaagtcattacaaaactctagctggtgcgagactttcccttcactttcggaagataatgatgaaaaagagaacaagaataagattgatatctcagcagttatgtctgtgcattctgcagtcaaagaggaaagtgcatgtgttaaagatgaaaagtttgctccacctttgtcacctttgtcatcagatatgctcattatgcccaaagctttgaaagaagagagcgaggatacctgcctagagaccctggctgttccctctgaatgctctgctttctcagagaatattgaggatcctggagagggtccctcaaatccatgcttagataccagccagaatcaaccttccatggaatcagagatgggggctgcagcatgccctgggagttgttcaagggaatgcgaggtttcatttagtgcctctaaccctgtctgggattattcacatcttatgagtagtgaaagaaattttcagagactggattttgaagaacttgaggaagaaggtcaagcctctgacaagtcattgcttccaagtcgcattaatctttctctattagatgatgatgaggaagacgaagaacttccacgcttcattttacattatgagacacatccgtttgaaacaggaatgatagtctggtttaaatatcagaaatatccattttggccagcagtgataaaaagtatcagacgaaaagagaggaaagcaagtgtgctttttgttgaggcaaacatgaattctgaaaagaagggcattagagtaaattttagaagattaaagaaatttgattgtaaagagaaacaaatgctagtggacaaagccagggaggattatagtgagagtattgactggtgcatctcactaatttgtgactacagagttagaataggttgtggttctttcacgggctctttgcttgagtattatgctgctgatattagttacccagttaggaaagaaacaaaacaggatactttcaggaacaaatttccaaagctgcataatgaagatgccagggaaccgatggctgtaacttcccagaccaagaaaatgtccttccaaaaaattctccctgaccggatgaaggctgctcgggaccgagccaacaagaacctggtggacttcattgtgaatgcaaagggaacagagaaccatcttctggccattgtaaatggcacaaaaggatccagatggctgaaatcatttttgaatgcaaataggttcacaccctgtattgaaacatactttgaggatgaagatcagttggatgaagtggtgaaatatttacaagaagtctgcaatcaaatagatcaaataatgccaacttggataaaagatgataaaattaaatttatcctataagttcttctgccagaagcaattatttgttcaatttctgctgttgatgggttagattacgaggcagctgaagcaaagtatctaaaaggaccatgtctaggctacagggaaagagaattatttgatgcaaaaataatatatgaaaagagacgaaaagcaccaacaaatgaagctcactaaatgtgctgaaagttgaaaccatgacagggagctctcatagatactagttgaaaaaagtctctgaacaattctctctaatacatattttctgcaaatgggagcatggataatgtgttcacttttttttgagatctctaggatctgtggttataattacatctttatttccttttcttgcgcttcttcaaagttaattttgtcaacatatttcagcagttctactttcccgtacattttttagaaagcataattcctaaatgattttgaagggaaagtactattttgttttatgacacttttgagtctatgctgtattgttaaatatattgtgcacaattattttaatgttaaaattgcactggtgttagatattaacgaagatgattggaaaaaagtctgaaagatacatcatttctatattccttgcttaatttttataaaatattgggttttcccttaagatagttgaagtatttttcttgccatgcctatttatttttgcaaaaaaattatctgctatatagaaccaaagatagattcgctttgctatatattataactatacttgcttttgcaataaaacaacttgtaattcaaaaatgaagattatctgcatatagtatttatgtgtgtgaataacatcttggcatgcagaaaataattttggctgctttgaacaggattgttcattctacacttccctgaaattccatttttgggagtgtctatccttcaatggctgaatagttccttaaatcagacaagctcctggctatcttcataaccagcagtgagtagatcttcttaatatagctgtctgaccacatgtggaaggcagctagacttattgtatttacagcctggccactctagacatatgaatccaggctgactgcttaagtgcccatctcgtttgatataaactgtagaaaaggcaagcactttgttctgagtcttttatctccaaatacatagttgtctcaaaccaagcaagctttatcaaaatggcttatttgcagaatagttccaatgatataaatgccaactggcaagtcattccaaactgcttgaaggagtagatgaaccagaatctgagaatttggaaataggtcacagaaaaagcctccatttggctaaatatgacaattatctgagtatggttaaatacatacaattaaatgtctgaagccaatgagttgtttattctaacttgaaatatatttttgtgagaataaatgttagaaaagttagtttattttggaaacctgccgtgaaaggaaattctaaaggcttaacatgaaactgtctgcatttctacctgttagacaatggttgctcttgggctcttgttatacagtcatatggctacacgtttatgtaaagtttgcaaaagtttggtgttttgatttataataaaactgttatattattc

SEQ ID NO: 32271 - DNA, 4255 bp, Homo sapiens
cagcctcctcctgggacccttgccctgcccccctcccatgggcacggaccccccaccgcctccacccactgccgcgggggggcccgttggggcccagggctggcgggccatgtaaccagggctgctgctgggagcgcggaggggaagggagcccccagccctgctgggccggcccaggcccctccgcggctcccccttccactacccacctgcccggcaccccctccccagtggttgttaaccccgggactccccaagcccagcctctgtgtgcagcagccccaggcgggctaagtctccaagatgcccttggtggatttcttctgcgagacctgctctaagccttggctggtgggctggtgggaccagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaaggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtcccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccga

SEQ ID NO: 32272 - DNA, 2183 bp, Homo sapiens
gagcgcacgcgtacacgcgtgcgcaggggaagaccgagtgccaggggctgaaccgcagggaagggggcgcggcgcacgcagtatggcgcccaacatctacttggttcgccagcggatcagtcgactcggccagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaaaaaaaaaaaaaaaaaaaaaaa

SEQ ID NO: 32273 - DNA, 2149 bp, Homo sapiens
gcgccagccccgcctgcccttcctcgccaccgggctgctctggtctcgtcggtcccctcctccgccccgtcgtcctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaaaaaaaaaaaaaaaaaaaaa

SEQ ID NO: 32274 - protein, 502 aa, Homo sapiens
MWTADEIAQLCYEHYGIRLPKKGKPEPNHEWTLLAAVVKIQSPADKACDTPDKPVQVTKEIVSMGTGTKCIGQSKMRKNGDILNDSHAEVIARRSFQRYLLHQLQLAATLKEDSIFVPGTQKGVWKLRRDLIFVFFSSHTPCGDASIIPMLEFEDQPCCPVFRNWANNSSVEASSNLEAPGNERKCEDPDSPVTKKMRLEPGTAAREVTNGAAHHQSFGKQKSGPISPGIHSCDLTVEGLATVTRIAPGSAKVTDVYRTGAKCVPGEAGDSGKPGAAFHQVGLLRVKPGRGDRTRSMSCSDKMARWNVLGCQGALLMHLLEEPIYLSAVVIGKCPYSQEAMQRALIGRCQNVSALPKGFGVQELKILQSDLLFEQSRSAVQAKRADSPGRLVPCGAAISWSAVPEQPLDVTANGFPQGTTKKTIGSLQARSQISKVELFRSFQKLLSRIARDKWPHSLRVQKLDTYQEYKEAASSYQEAWSTLRKQVFGSWIRNPPDYHQFK

SEQ ID NO: 32275 - protein, 307 aa, Homo sapiens
MGDIPAVGLSSWKASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQIECHPYLTQKNLISFCQSRDVSVTAYRPLGGSCEGVDLIDNPVIKRIAKEHGKSPAQILIRFQIQRNVIVIPGSITPSHIKENIQVFDFELTQHDMDNILSLNRNLRLAMFPM

SEQ ID NO: 32276 - protein, 647 aa, Homo sapiens
MSDEVFSTTLAYTKSPKVTKRTTFQDELIRAITARSARQRSSEYSDDFDSDEIVSLGDFSDTSADENSVNKKMNDFHISDDEEKNPSKLLFLKTNKSNGNITKDEPVCAIKNEEEMAPDGCEDIVVKSFSESQNKDEEFEKDKIKMKPKPRILSIKSTSSAENNSLDTDDHFKPSPRPRSMLKKKSHMEEKDGLEDKETALSEELELHSAPSSLPTPNGIQLEAEKKAFSENLDPEDSCLTSLASSSLKQILGDSFSPGSEGNASGKDPNEEITENHNSLKSDENKENSFSADHVTTAVEKSKESQVTADDLEEEKAKAELIMDDDRTVDPLLSKSQSILISTSATASSKKTIEDRNIKNKKSTNNRASSASARLMTSEFLKKSSSKRRTPSTTTSSHYLGTLKVLDQKPSQKQSIEPDRADNIRAAVYQEWLEKKNVYLHEMHRIKRIESENLRIQNEQKKAAKREEALASFEAWKAMKEKEAKKIAAKKRLEEKNKKKTEEENAARKGEALQAFEKWKEKKMEYLKEKNRKEREYERAKKQKEEETVAEKKKDNLTAVEKWNEKKEAFFKQKEKEKINEKRKEELKRAEKKDKDKQAINEYEKWLENKEKQERIERKQKKRHSFLESEALPPWSPPSRTVFAKVF

SEQ ID NO: 32277 - protein, 350 aa, Homo sapiens
MPGPAAGSRARVYAEVNSLRSREYWDYEAHVPSWGNQDDYQLVRKLGRGKYSEVFEAINITNNERVVVKILKPVKKKKIKREVKILENLRGGTNIIKLIDTVKDPVSKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRREPFFHGQDNYDQLVRIAKVLGTEELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 32278 - protein, 1180 aa, Homo sapiens
MTLQGRADLSGNQGNAAGRLATVHEPVVTQWAVHPPAPAHPSLLDKMEKAPPQPQHEGLKSKEHLPQQPAEGKTASRRVPRLRAVVESQAFKNILVDEMDMMHARAATLIQANWRGYWLRQKLISQMMAAKAIQEAWRRFNKRHILHSSKSLVKKTRAEEGDIPYHAPQQVRFQHPEENRLLSPPIMVNKETQFPSCDNLVLCRPQSSPLLQPPAAQGTPEPCVQGPHAARVRGLAFLPHQTVTIRFPCPVSLDAKCQPCLLTRTIRSTCLVHIEGDSVKTKRVSARTNKARAPETPLSRRYDQAVTRPSRAQTQGPVKAETPKAPFQICPGPMITKTLLQTYPVVSVTLPQTYPASTMTTTPPKTSPVPKVTIIKTPAQMYPGPTVTKTAPHTCPMPTMTKIQVHPTASRTGTPRQTCPATITAKNRPQVSLLASIMKSLPQVCPGPAMAKTPPQMHPVTTPAKNPLQTCLSATMSKTSSQRSPVGVTKPSPQTRLPAMITKTPAQLRSVATILKTLCLASPTVANVKAPPQVAVAAGTPNTSGSIHENPPKAKATVNVKQAAKVVKASSPSYLAEGKIRCLAQPHPGTGVPRAAAELPLEAEKIKTGTQKQAKTDMAFKTSVAVEMAGAPSWTKVAEEGDKPPHVYVPVDMAVTLPRGQLAAPLTNASSQRHPPCLSQRPLAAPLTKASSQGHLPTELTKTPSLAHLDTCLSKMHSQTHLATGAVKVQSQAPLATCLTKTQSRGQPITDITTCLIPAHQAADLSSNTHSQVLLTGSKVSNHACQRLGGLSAPPWAKPEDRQTQPQPHGHVPGKTTQGGPCPAACEVQGMLVPPMAPTGHSTCNVESWGDNGATRAQPSMPGQAVPCQEDTGPADAGVVGGQSWNRAWEPARGAASWDTWRNKAVVPPRRSGEPMVSMQAAEEIRILAVITIQAGVRGYLARRRIRLWHRGAMVIQATWRGYRVRRNLAHLCRATTTIQSAWRGYSTRRDQARHWQMLHPVTWVELGSRAGVMSDRSWFQDGRARTVSDHRCFQSCQAHACSVCHSLSSRIGSPPSVVMLVGSSPRTCHTCGRTQPTRVVQGMGQGTEGPGAVSWASAYQLAALSPRQPHRQDKAATAIQSAWRGFKIRQQMRQQQMAAKIVQATWRGHHTRSCLKNTEALLGPADPSASSRHMHWPGI

SEQ ID NO: 32279 - protein, 447 aa, Homo sapiens
MPDRACAVGSVARALSRSRRYVCARDADASRRRRRPFNYGLSIEEKNENDENSLSSSSDSSEDKDEKISEECDIEEKTEVKEEPELQTKREMEERTVTLEIPEVLKRQLEDDCYYINRRKRLVQLPCHTNIITILESYVKHFAISAAFSANERPRHHHAMPHASMNVPYIPAEKNIDLCKEMVDGLRITFDYTLPLVLLYPYEQAQYKKVTASKVFLAIKESATNTNRSQEKLSPSLRLLNPSRPQSTESQSTSGEPATPKRRKAEPQAVQSLRRSSPHTANCDRLSKSSTSPQPKRWQQDMSTSVPKLFLHLEKKTPVHSRSSSPTLTPSQEGSPVFAGFEGRRTNEINEVLSWKLVPDNYPPGDQPPPPSYIYGAQHLLRLFVKLPEILGKMSFTEKNLKALLKHFDLFVRFLAEYHDDFFPESAYVAASEVHYSTRNPQAVNKC

SEQ ID NO: 32280 - protein, 85 aa, Homo sapiens
MTIHIAGGTRPPAMGVLRAGGRRGVGSYSLHCGCGYGSGSGCGYGTGFGCGYGCGYGTGYGCGCGSGSGYCGYRPFCFRRCYSSC

SEQ ID NO: 32281 - protein, 87 aa, Homo sapiens
MSIEYYNSYHCVTLCTPRVTLGVTSHKTMMKNITGCGYGSGSGCGYGTGYGCGYGCGYGTGYGCGCGSGSGYCGYRPFCFRRCYSSC

SEQ ID NO: 32282 - protein, 802 aa, Homo sapiens
MKKASSPQLLVEFGEESLRTEPIRDFQTNPNFPESESVLVLTVLMPTEEAYALPLVVKVVDNWAFGQQTVTGQANIDFLQPYFCDPWAQDYMHPKLPTLSEKKHQDFLGYLYRKFWFKSSKAEDEYEHEVDWWSKLFWATDEHKSLKYKYKDYHTLKVYECELEAVPAFQGLQDFCQTFKLYQEQPKLDSPVVGEFKGLFRIYPFPENPEAPKPPLQFLVWPEREDFPQPCLVRVYMVRAINLQPQDYNGLCDPYVILKLGKTELGNRDMYQPNTLDPIFGMMFELTCNIPLEKDLEIQLYDFDLFSPDDKIGTTVIDLENRLLSGFGAHCGLSKSYCQSGPFRWRDQMPPSYLLERYAKRKGLPPPLFSPEEDAVFYNGKKFKLQSFEPKTPTVHGLGPKKERLALYLLHTQGLVPEHVETRTLYSHSQPGIDQGKVQMWVDIFPKKLGPPGPQVNINPRKPKRYELRCIIWKTANVDLVDDNLSREKTSDIYIKGWLYGLEKDMQKTDIHYHSLTGEADFNWRFIFTMDYLAAERTCVQSQKDYIWSLDATSMKFPARLIIQVWDNDIFSPDDFLGVLELDLSDMPLPARHAKQCSIRMMDADPKWPYFIQYKHFSLFKKKTVTGWWPCQVLDGGKWRLSGKVKMSLEILSEKEALIKPAGRGQSEPNQYPTLHPPLRTNTSFTWLRSPVQNFCYIFWKRYRFKLIAFMVISIIALMLFNFIYSAPHYLAMSWIKPQLQLYPPIKIFNIINSLNTSNASSSILPTQDPNLKPTIDHEWKLHPGPTNHLSDIFPELPAPGD

SEQ ID NO: 32283 - protein, 2287 aa, Homo sapiens
MLRLVVQSAKIDPPLAPLPRPCMSIDFRDIKKRTRVVEGNDPVWNETLIWHLWNRPLENDSFLQVTLQDMGSQKKERFIGLATVLLKPLLKQPSEVLFVKDLTLLNHSMKPTDCTVTLQVAHMSNQDIEKTGAEDHLGITAREAASQKLMVPGSTAHRALSSKPQHFQVRVKVFEARQLMGNNIKPVVKVSIAGQQHQTRIKMGNNPFFNEIFFQNFHEVPAKFFDETILIQVVNSSAMRYKAEIGRFQTDIGFIYHSPGHTLLRKWLGLCQPNNPGSGVTGYLKVTIYALGVGDQALIDQKLLYGTDDTDIQIFKSAVVPINMAYLQLFIYCAEDLHLKKHQSVNPQLEVELIGEKLRTHMQTQTDNPIWNQILTFRIQLPCLSSYIKFRVLDCRKKDCPDEIGTASLSLNQISSTGEEIEGVYSGFLPCFGPSFLTLHGGKKAPFRIQEEGACIPDSVRDGLAYRGRVFLELITQIKSYQDSTIKDLSHEVTRIEKHQNRQKYGLCVIFLSCTMMPNFKELIHFEVSIGHYGNKMDLNYKPLVSSTPYSPVIYDGNIYHYVPWYNTKPVVAVTSNWEDVSFRMNCLNLLHFTRDRLKANLDTLKSTRNPKDPALLYQWEKLLRELAEDCKRPLPCMTYQPKATSLDRKRWQLRSLLLQELAQKAKQAKPKDMVATAEDWLYRLNTVLPEPQMGLPDVMIWLVAKEQRVAYAQVPAHSVLFSPAGALHSGRLCGKIQTLFLQVGIRDSSGEDRAEKCPQGSPLNSQGSPYGACFPGPLTTWNGVETVPRGREGSVAVSMLGDAKSMYLLNVPQIHLLAGHGGSQYPEGEGQKDVLPAHLRVCMWLGNVTDSKDLQLLRQGDTAVYAEMVYSELSPSSSTAREVSKALTCRGLTHHQQGSPGPLQAPVGSQEYENQAKYKDQWGQQGLYHCPNFSDVMGNKTLPMTDFQPPLGWHWQDSWTVEPQRRLLLDIDINKSQVLEEVYENQGRDTRGAWGPAAIPNTDVNGQPMEARENVKCPQGWHFKKDWVVELNHAVDSKGWEYGVGIPPSGLPQVWSPVEKTYHSCRRRRWARVRFRNHGELSHEQETLSFLQLGLAKGEEEGWEYDTFGSKFHLNPQPQSRFRRRCWRRRLAPNKDKGIAPIFLLEGSLACEGGSVREEGDWAWARGNRSSTQEPQGRLSWVQAMDLKYHAGKEEDSKTWPWGLDRQFRDPQRQDTRPPNLPFIYCTFNKPHYYQLFCYIYQARNLVSNQILTFQAAQQCKDRGMDEGDKDADPSPKQLMVLWLQQQRRGKPLFPAQDTATFSSTPPGPFIRVVFLNHSQCTQTLRSSAGPTWAQTLIFQHLLLYENPQDTKESPPLVVLELWQRDFWGKESLWGRSVWPPMVWLDLQDRILPPMRWHPLVKELGKEEGEILASCELILQTEKLGEKQLPILSVPWKNGAYTLPKSIQPTIKRMAIEILAWGLRNMKKASSPQLLVEFGEESLRTEPIRDFQTNPNFPESESVLVLTVLMPTEEAYALPLVVKVVDNWAFGQQTVTGQANIDFLQPYFCDPWAQDYMHPKLPSTALPPCLSPGLTSEPALGVGQALLPRGFLGYLYRKFWFKSSKAEDEYEHEVDWWSKLFWATDEHKSLKYKYKDYHTLKVYECELEAVPAFQGLQDFCQTFKLYQEQPKLDSPVVGEFKGLFRIYPFPENPEAPKPPLQFLVWPEREDFPQPCLVRVYMVRAINLQPQDYNGLCDPYVILKLGKTELGNRDMYQPNTLDPIFGMMFELTCNIPLEKDLEIQLYDFDLFSPDDKIGTTVIDLENRLLSGFGAHCGLSKSYCQSGPFRWRDQMPPSYLLERYAKRKGLPPPLFSPEEDAVFYNGKKFKLQSFEPKTPTVHGLGPKKERLALYLLHTQGLVPEHVETRTLYSHSQPGIDQGKVQMWVDIFPKKLGPPGPQVNINPRKPKRYELRCIIWKTANVDLVDDNLSREKTSDIYIKGWLYGLEKDMQKTDIHYHSLTGEADFNWRFIFTMDYLAAERTCVQSQKDYIWSLDATSMKFPARLIIQVWDNDIFSPDDFLGVLELDLSDMPLPARHAKQCSIRMMDADPKWPYFIQYKHFSLFKKKTVTGWWPCQVLDGGKWRLSGKVKMSLEILSEKEALIKPAGRGQSEPNQYPTLHPPLRTNTSFTWLRSPVQNFCYIFWKRYRFKLIAFMVISIIALMLFNFIYSAPHYLAMSWIKPQLQLYPPIKIFNIINSLNTSNASSSILPTQDPNLKPTIDHEWKLHPGPTNHLSDIFPELPAPGD

SEQ ID NO: 32284 - protein, 637 aa, Homo sapiens
MESEYVLCDWKDQLWPAKVLSRSETSSNSKRKKAFSLEVQILSLDEKIKLDSTETKILNKSQIEAIAASLGLQSEDSAPPTEETAYGRSLKVALGILNERTNLSQASTSDEEEITMLSQNVPQKQSDSPPHKKYRKDEGDLPGCLEERENSACLLASSESDDSLYDDKSQAPTMVDTIPSEVETKSLQNSSWCETFPSLSEDNDEKENKNKIDISAVMSVHSAVKEESACVKDEKFAPPLSPLSSDMLIMPKALKEESEDTCLETLAVPSECSAFSENIEDPGEGPSNPCLDTSQNQPSMESEMGAAACPGSCSRECEVSFSASNPVWDYSHLMSSERNFQRLDFEELEEEGQASDKSLLPSRINLSLLDDDEEDEELPRFILHYETHPFETGMIVWFKYQKYPFWPAVIKSIRRKERKASVLFVEANMNSEKKGIRVNFRRLKKFDCKEKQMLVDKAREDYSESIDWCISLICDYRVRIGCGSFTGSLLEYYAADISYPVRKETKQDTFRNKFPKLHNEDAREPMAVTSQTKKMSFQKILPDRMKAARDRANKNLVDFIVNAKGTENHLLAIVNGTKGSRWLKSFLNANRFTPCIETYFEDEDQLDEVVKYLQEVCNQIDQIMPTWIKDDKIKFIL

SEQ ID NO: 32285 - protein, 647 aa, Homo sapiens
MPLVDFFCETCSKPWLVGWWDQFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 32286 - protein, 259 aa, Homo sapiens
MAPNIYLVRQRISRLGQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 32287 - protein, 241 aa, Homo sapiens
MSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 32288 - DNA, 17 bp, Homo sapiens
gatcagaaacccaccgg

SEQ ID NO: 32289 - DNA, 17 bp, Homo sapiens
gatctgttcattgccac

SEQ ID NO: 32290 - DNA, 17 bp, Homo sapiens
gatccttaagttttcac

SEQ ID NO: 32291 - DNA, 17 bp, Homo sapiens
gatcaccaggaaggagc

SEQ ID NO: 32292 - DNA, 17 bp, Homo sapiens
gatcagcatgtgtttcc

SEQ ID NO: 32293 - DNA, 17 bp, Homo sapiens
gatcttctggacaaact

SEQ ID NO: 32294 - DNA, 17 bp, Homo sapiens
gatcacaaagaactgaa

SEQ ID NO: 32295 - DNA, 17 bp, Homo sapiens
gatctggaatgcatacc

SEQ ID NO: 32296 - DNA, 17 bp, Homo sapiens
gatcatacaagactgag

SEQ ID NO: 32297 - DNA, 17 bp, Homo sapiens
gatccgccagcagatga

SEQ ID NO: 32298 - DNA, 17 bp, Homo sapiens
gatctaaataaagcctc

SEQ ID NO: 32299 - DNA, 17 bp, Homo sapiens
gatccactgaaagagat

SEQ ID NO: 32300 - DNA, 17 bp, Homo sapiens
gatccaaacctaaagcc

SEQ ID NO: 32301 - DNA, 17 bp, Homo sapiens
gatcactcatcaaagga

SEQ ID NO: 32302 - DNA, 17 bp, Homo sapiens
gatcttcttaatatagc

SEQ ID NO: 32303 - DNA, 17 bp, Homo sapiens
gatccacatgtgggtgt

SEQ ID NO: 32304 - DNA, 17 bp, Homo sapiens
gatctgtaaaataaaaa

SEQ ID NO: 32305 - DNA, 17 bp, Homo sapiens
gatccccagacctctgt

SEQ ID NO: 32306 - DNA, 17 bp, Homo sapiens
gatctttttttcctata

SEQ ID NO: 32307 - DNA, 17 bp, Homo sapiens
gatccctaaatgtatct

SEQ ID NO: 32308 - DNA, 17 bp, Homo sapiens
gatcggccatggatatg

SEQ ID NO: 32309 - DNA, 17 bp, Homo sapiens
gatcagtcacaacaagc

SEQ ID NO: 32310 - DNA, 17 bp, Homo sapiens
gatctaaaacaaagttc

SEQ ID NO: 32311 - DNA, 2692 bp, Homo sapiens
ccctaggacacctttctaaaaagactccctgtggtgttcagaatcactcctacagtcaggttctccacaatggatctcagtgctgcaagtcaccgcatacctctaagtgatggaaacagcattcccatcatcggacttggtacctactcagaacctaaatcgacccctaagggagcctgtgcaacatcggtgaaggttgctattgacacagggtaccgacatattgatggggcctacatctaccaaaatgaacacgaagttggggaggccatcagggagaagatagcagaaggaaaggtgcggagggaagatatcttctactgtggaaagctatgggctacaaatcatgtcccagagatggtccgcccaaccctggagaggacactcagggtcctccagctagattatgtggatctttacatcattgaagtacccatggcctttaagccaggagatgaaatataccctagagatgagaatggcaaatggttatatcacaagtcaaatctgtgtgccacttgggaggcgatggaagcttgcaaagacgctggcttggtgaaatccctgggagtgtccaattttaaccgcaggcagctggagctcatcctgaacaagccaggactcaaacacaagccagtcagcaaccaggttgagtgccatccgtatttcacccagccaaaactcttgaaattttgccaacaacatgacattgtcattactgcatatagccctttggggaccagtaggaatccaatctgggtgaatgtttcttctccacctttgttaaaggatgcacttctaaactcattggggaaaaggtacaataagacagcagctcaaattgttttgcgtttcaacatccagcgaggggtggttgtcattcctaaaagctttaatcttgaaaggatcaaagaaaattttcagatctttgacttttctctcactgaagaagaaatgaaggacattgaagccttgaataaaaatgtccgctttgtagaattgctcatgtggcgcgatcatcctgaatacccatttcatgatgaatactgactgcagggagttcctgaacagatttttcactcccacgagtgccaagacggtgcaatgggtagtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataactcttaggaaattatcaactaattttttcagatcagtatcttctagattccagacagaaaaaaattacacttcagaaaagacatcaaaggcaacatatgacaacaagtaatttatgaatctgggtagtagcgttggtaatctgagttctttaagggttaacaggacaacgaagtgcatgtggcagtgtgctggcagtggccttgaggctttggaccattggttacaaaacagacacagccaagataagatccacacacacattattaacaaggaagtgatttgctgcaccttgagttgagagggctacatgtagaaaagtcttaaaatagagctaaacaccacagtggtcaacaaagccatcataatgttggtgtttgtttccctccaatgtatgtatgtttagtttttatccaacctgaggaatgaaaacttaactggatctctcttgcatccttaaagggcctgagtctcaacatggctgctgatccatacttacacatcttactgtcaatcttgcctacattgattatagaaccactattacgtgaaaaggcttgaaacaaccaacatatacaaataaaaccctgccttgtaaaatagtaaaagagaagccatatattggcttttcttcttaacttgggagatatattgaaacaaggtgctttataagattattgtacttaagactttaatagtgttacttggatagcttatatgaattttgagaattttatatgaattttgagaaagcaagttcaaaagaactctggtaattttcctgtatgtacaatttaaagagtgaataagattattagaattcagcaatagagatatatctattttcaattcaactacagaaatatattttattggccgggtgcggtggctcatgcctataatcccagcactttgggaggccaaggtgggcagatcaggaggtcaggagatcgagaccatcttggctaacaaggtgaaaccccgtctctactaaaaatacaaaaaattagccaggcgcggtggcgggggcctgtaatcccagctactcaggaggctgaggcagaagaatggcatgaacccgggaggaggagcttgcagtgagccgagatagcgccactgcagtccggcctgggtgaaagagcgagactccgtctcaaaaacaaaaaaaaaagaaaagaaatatattttattcattcacattaggtcactgtcatactgtcataggctgagagagttcttcaaaaattatgttttcccaagatcagttgcttatagataatgttcaatgacctcaagacatatatttttgagaaattatcattttaaaaaatttggtctatactgattgttttcactgattccaatattattacttataacactgacctctggaaaatattttgttcacaagaaataataaagtataatgatttgttgcatc

SEQ ID NO: 32312 - DNA, 4386 bp, Homo sapiens
tccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaaggtcagtgcagcagacagggccagactggggtgtggggggctgagctgggcacatgagtgagggctctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctctttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaaaaaaaaaaaaaaaaaaaa

SEQ ID NO: 32313 - DNA, 1549 bp, Homo sapiens
tccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaaaaaaaaaaaaaaaaaaaa

SEQ ID NO: 32314 - DNA, 3805 bp, Homo sapiens
tccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaaaaaaaaaaaaaaaaaa

SEQ ID NO: 32315 - DNA, 4000 bp, Homo sapiens
tccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattctatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaaaaaaaaaaaaaaaaaaaa

SEQ ID NO: 32316 - DNA, 3781 bp, Homo sapiens
tccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaaaaaaaaaaaaaaaaaaaa

SEQ ID NO: 32317 - DNA, 3758 bp, Homo sapiens
tccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaaaaaaaaaaaaaaaaaaaa

SEQ ID NO: 32318 - DNA, 2770 bp, Homo sapiens
gtgcttgcggcaaccctgtaaccgccggtgcgcaagttggaggggcaaggggctgccgtgtcctggtctggaggcggcccaggctgccttggtgattctggcttcgcggcctcatggcttgcggccggtttgcgcaacggcctgcgaaccaccaggcgcgtccccgccggcttgggtccgccccgaagcccagtccctcggcctggcccgctatgccctgcacactggcggagtctggcgtggcgcagcccggcgtggggttcggccccgccaggtggtcagcccttcctcggagtccaggtggctgggggcgcttcggagagtggccaggggcccccaaacccggggccgcagagcagtaccagtccgtggcctgttaggaaccaggctacagagcaggagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataaggccacgggaagaatctctggcagaaaagaagtacacctctcaagggcagggggacttagacagtgtgctctcccagttgaattttacccatactagtgaggaccttctgcaggcagaggtgacttgtcttgaaggcagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgaggcaaaagagatttcactagcagacctccaggagaattatattgaggcattaaataaattagtgtctgaaaatcaacaactacagaaagatttgatgaataccaaatctcagctggagatttctactcagatgtgcaaaaaacaaaatgacaggatctttaaaccaacacacagcagaacaactgagttcaagaatacagagttcaagccaacccatggccagcacagacatgatggaataaagactgagcactacaaaacagatcttcattctccaagaggacaagcgtcggatagtataaaccccatgtctagggtgctaagccccctgagtcctcaaatcagcccttgcagctccaccaggtctttgacttcctactctctatgtaaaactcattctttgccttcagcgctagatacaaatgaagccaatttttctgacactatgtctgagagtatgaatgaccaagaagagtttatatcttcgtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctag

SEQ ID NO: 32319 - DNA, 1488 bp, Homo sapiens
acattcactacaccttttccatttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagactgaaactcagagttcaattaaaacaacagaaataccaggtagtgttctacaaccagatgcatcaccttctaaaactggtacattaacctcaataccagttacaattccagaaaacacctcacagtctcaagtaataggcactgagggtggaaaaaatgcaagcacttcagcaaccagccggtcttattccagtattattttgccggtggttattgctttgattgtaataacactttcagtatttgttctggtgggtttgtaccgaatgtgctggaaggcagatccgggcacaccagaaaatggaaatgatcaacctcagtctgataaagagagcgtgaagcttcttaccgttaagacaatttctcatgagtctggtgagcactctgcacaaggaaaaaccaagaactgacagcttgaggaattctctccacacctaggcaataattacgcttaatctccagcttctatgcaccaagcgtggaaaaggagaaagtcctgcagaatcaatcccgacttccatacctgctgctggactgtaccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcggtgttcttatattacctactgttagtatttattgtttaccactatgttaatgcagggaaaagttgcacgtgtattattaaatattaggtagaaatcataccatgctactttgtacatataagtattttattcctgctttcgtgttacttttaataaataactactgtactcaatactctaaaaaaaaaa

SEQ ID NO: 32320 - DNA, 5075 bp, Homo sapiens
aaattgtttggaaaacaagccttggagaggaagagcagttgggcaggtggccttagaagcagagacagacgtccctgttgataccactgttgatggagaagcactcggctctcctccatcaggggaaaccaaacctgccaccccacctgggatgtggcctccccagggaaagagtagagaggctggagctctggcagaacaggcctggcaagggggctggaggccaaggctggtgttggggctcagatcaaagccatcatgctgcatggagcccaatcagctgccaacactcttggtgacacagagccctcacgcctctggtggaagaagccagggctggatgaagctgtggcgtgcagcttctgcacagtctccgtggaatctctcctactctcccgtgagcctttggaggccttgcaggagctcagcctttcagcagaaggactgggttcaaccgcccctgcaggagcagctccttggcctcccaggcaccagtggttgggggctgcatcctctgtgagcctcaggtcaagcccatacagtgccctagactcctccctgctctgaccctgggcccaggagaaaggccgagcacctggccctctggagacaaggacatggccattcctcagaggtccttcccctgacaagctgggccccctgttgtggggcgcaccactggacatggtaggggagtggtggcggccttgcccgaaggcaggctgcgggaggggcggggctggctcaccacagttggttgattcaagtgaggcctggggtcctgctctccttccagcttccatctcaggatggctctcagccccccacattgaagaccaagaaggtgaggggcaaaccaagggccctgcctatggaagcttcctgtgatgggctgcaggtagcaggggctggagagggctgtggttggggccacaccaggctcccccaacctgagcatcctggaaggtgacagctcacccttggcagtggcaacccccaggccagcagccccatctgaggacagttgtcttcagtgccattggctgtggcagcacagatggggggtgtgaagacctgaggccctgcgactgtagcacctacagccactggagccagctctgcacaactcagacctgggtggcgaggacatagctttgcaggtgggcagccacatcccagggggagcctgcaggccagtggcagggtgggggcaggcagagcagggtctccccactgttgccgctgggctcctgcggcttgtggagaaagatgggtgggcccacacatattgctgctccctgaatctgagcctcggtttccctacctgtgaaacgggtacccatggcagctcagaagtgtctggcagtggggctgctggggcacagtcatgggggacccgagtcctgctctccatgtgctcgcttccctcagtggtccctgatgccagcagaactttctcccaaaaagagaagggcgttcctgtgagttcttgtgtggggggtgggtcacagagcctctccaagtgcagggcagggtgaagggaggctgaggggtggttgaatggccctgggaagagctctcttgggctcctcgtgtctgggtggcctggggagcatgcttttgggcaggcggctggcagggctggtggctgagccactgtggctcaggatccccagcccaggcctgaatagggtaggcagggagaggggagggtgagtgcatggtgcaggacagtgtgtctcctggacagaaacagccctggtcactcacggccatggcatagccatggctacaggaaagtgctgctgtgtgttgcagcccctggggccggctcccaatggacacccagcagcatctcccccactgtgctgaggggagttgtgccagtggggtgctggcagcagtcctgggaactgggggaagagccttggcaagcccatccctcctcgggcatcagggatgggctcacgtgaccaatttctcccatggaagatgtttggggtgtgcccagaaaatggggagggccctgtggggcaggattgtattattaaatccagaaagtctgggcttccatttttagcacaaggcaggcagcccacgtgccccagcccagtggccagcctgtgtgggagaggggagtgggggccagagggagtgaggcttctgttactgcagccagccagggtggccagtgtggactggacagcgagcactgcaccaggggcactggtactgaccttgggccatgcacctgatgcctgtgagagtgatctctaggaaccactgcacaagggggcagatgaggggaccctgacatgggacagctgagggttacgccaacacgggggggaaagctgtgtccaggctccaccggactccgccgaggacagagcactgccctgactctagggtgcggggtcactgagggttaggacagtctggagttgggagagggccatgctgcagctggggcacatcccacctgcacctctccagatcttggagatgggacccccacccacatgctccccaggtgggtcccatcctggggggtgcaggagggagctccatgtgcccctgctgatctgcccatctgagcctcaggggtcctgggcactgagagctgggctgggctcagcgggggtatgcattgacattggggacagagaggggatgctgaagcgggtgctgtctgggtggggcctgcctgatcgacccagcaggtgcacccagcagccggaggtgcttctagcagagtgaacgccctgtccttaggggcatgtgagctgaggctgggggcctggagctgcagggggaggaattggggagagcagaggtcccaaagatgtcccaaggccccaagaccctggtgaaggaatggaggagccagcattggtcagcgagaggggagtgggagttggatggcctggctctgggctggacacacggtttgcagccacagctgagctgtgctgtggagcccagttcccacctgggcatgtcctgtcctctgaggcttccgggagccggacggccaccgcggtgcaggcgcgcactcaagggctttcgaggctcactctgtcggagaggtcagagactgagtgtcgctgctgaaggctgtggtggaccgggctggatcgcggattctaggttagatcgcagatttgggatcgcggattggggattggattggggatttggggttggatcagggatgtgggggctggataggggatttgaggattggatcggggatttggggttggatcctggatttggggccgggtcggcggtggggggcagtgaaaaggtgacagagagcagcccctgctcgggagccggtggttgggggtctgagaagtcaccaccaccaagaagttcttcggcttcgggagccgcgggggcgagatggcccgggctccatagaccacgtctgcacggttccgggtaccgaatccgggacgcggaacagcggaaaatccaagggcggctgtcaaggaccggaggtggagcgcggcctggagcgcaggagccggagacctggaggcccgggacaagcagcacagaactgctctacatttggcctgtgccagcggccatgtggaagtggtcactctcctggtgaacagacaatgccaaattgacatctgtgacaaagaaaagagtgtgcctttgatacaggcacaggctgtgcattgccaagaagaggcttgtgccattattctgctggaacgtggcgccaatccaaaccttaaggatgtctacagcaacactgctctccagtatgctgtgtatagtgagagcacatcactggcaaaaaaactgctttcccatgatgcaaatactgaagcactggacaaggatctcactctgtcactcaggctggaataaagtggcacaactgtggctcactgcagcctcaaccccctgagctcaggtcatcctgctacctcagcctcttcagttgctgagactataggctcccacctccactcctagcctcagacggagtctcactctgtcgccaggctggagtgcagcggcatgatctcggctcgctgcaaacctctgtctcccgagttcacgtgattctcctacctcagcctcccgagtagctgggactacaggcgtacgccacaacgccaggctaatttttttttatttttggtagagacgggggtttcaccatgttggccaggatggtctcaatctcttgacctcgtaatctgcctaccttggcctcccaaagtgctgtgattacaggcgtgagccaccgtgcccagcccgacatagatggtttttttagggttacagcgacttcttgttgaagttgtctcacaactacctgataaagtatttttgatactgattttgtaaatcaccttattattaaattttcaataatatctaactctaacatacacttggaaaaatatcacctcatacacaattcaccttcttttcctcatgtgtacatattcctatttattactgaatccagttaaggacacagcaggtgttatcttcctgccaaatagatattctgttactagacgacagttttagcccaccattcagtcatctgctgataattcggcgatgcttaacaacctgctgaagtctcaagaaagcagtggatatgtgagtgaggctggcagtggtcaattctacactgaggaacgtttccctctttttcctctttttttattaggagctcaaatcaacctcaggggtcctcagttattcacttgcctgtccaaatctttccaatagattcctgtctcagaataaaagaaaaattccaatggcttttaaggccctgtaggtaacctcctgacctcagctgctatgagtctctctcctacttatggcatttctactatatgtgaatcccacctcccctcatttgtctgaaaaaggtcacagataactacacttatcattgctggacaaagctctatccaaatgatggtcagtgagccttcaaataaaaattataagcaaattatatgtaataatagtaaattatgtataccagtgggaaaaataaatcaaatatggttttggtaaaattc

SEQ ID NO: 32321 - DNA, 8680 bp, Homo sapiens
acggggcctgaagcggcggtaccggtgctggcggcggcagctgaggccttggccgaagccgcgcgaacctcagggcaagatgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagagatgagtcaagaggagtctactcgcttctatgaccaactgaaccatcacatttttgaattggtttccagctcagatgccaatgagaggaaaggtggcatcttggccatagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacaggcacacatttgaagaagcagagaagggatttgatgagaccttggccaaagagaagggcatgaatcgggatgatcggatccatggagccttgttgatccttaacgagctggtccgaatcagcagcatggagggagagcgtctgagagaagaaatggaagaaatcacacagcagcagctggtacacgacaagtactgcaaagatctcatgggcttcggaacaaaacctcgtcacattacccccttcaccagtttccaggctgtacagccccagcagtcaaatgccttggtggggctgctggggtacagctctcaccaaggcctcatgggatttgggacctcccccagtccagctaagtccaccctggtggagagccggtgttgcagagacttgatggaggagaaatttgatcaggtgtgccagtgggtgctgaaatgcaggaatagcaagaactcgctgatccaaatgacaatccttaatttgttgccccgcttggctgcattccgaccttctgccttcacagatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagaggcagaaggcaatgcaggtggatgccacagtcttcacttgcatcagcatgctggctcgagcaatggggccaggcatccagcaggatatcaaggagctgctggagcccatgctggcagtgggactaagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctgaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccagattttgacagagttggagcacagtgggattggaagaatcaaagagcagagtgcccgcatgctggggcacctggtctccaatgccccccgactcatccgcccctacatggagcctattctgaaggcattaattttgaaactgaaagatccagaccctgatccaaacccaggtgtgatcaataatgtcctggcaacaataggagaattggcacaggttagtggcctggaaatgaggaaatgggttgatgaactttttattatcatcatggacatgctccaggattcctctttgttggccaaaaggcaggtggctctgtggaccctgggacagttggtggccagcactggctatgtagtagagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaacgtcattcgagtctgtgatggggccatccgggaatttttgttccagcagctgggaatgttggtgtcctttgtgaagagccacatcagaccttatatggatgaaatagtcaccctcatgagagaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaagttactggctgcaatccagctgtttggcgccaacctggatgactacctgcatttactgctgcctcctattgttaagttgtttgatgcccctgaagctccactgccatctcgaaaggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaagtaccaaattttcattccaatggtgaataaagttctggtgcgacaccgaatcaatcatcagcgctatgatgtgctcatctgcagaattgtcaagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcctggggcgctgccaggagggtctccaaagatgactggctggaatggctgagacggctgagcctggagctgctgaaggactcatcatcgccctccctgcgctcctgctgggccctggcacaggcctacaacccgatggccagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggggtcaactccaccagcagtgctgtgaaaagtggaccctggttaatgatgagacccaagccaagatggcccggatggctgctgcagctgcatggggtttaggtcagtgggacagcatggaagaatacacctgtatgatccctcgggacacccatgatggggcattttatagagctgtgctggcactgcatcaggacctcttctccttggcacaacagtgcattgacaaggccagggacctgctggatgctgaattaactgcgatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaagatcgatgccttccagcacatgcagcattttgtccagaccatgcagcaacaggcccagcatgccatcgctactgaggaccagcagcataagcaggaactgcacaagctcatggcccgatgcttcctgaaacttggagagtggcagctgaatctacagggcatcaatgagagcacaatccccaaagtgctgcagtactacagcgccgccacagagcacgaccgcagctggtacaaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggttatacctcagctcattgcaagaattgatacgcccagacccttggtgggacgtctcattcaccagcttctcacagacattggtcggtaccacccccaggccctcatctacccactgacagtggcttctaagtctaccacgacagcccggcacaatgcagccaacaagattctgaagaacatgtgtgagcacagcaacaccctggtccagcaggccatgatggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggcagcaacggacatgagtttgttttccttctaaaaggccatgaagatctgcgccaggatgagcgtgtgatgcagctcttcggcctggttaacacccttctggccaatgacccaacatctcttcggaaaaacctcagcatccagagatacgctgtcatccctttatcgaccaactcgggcctcattggctgggttccccactgtgacacactgcacgccctcatccgggactacagggagaagaagaagatccttctcaacatcgagcatcgcatcatgttgcggatggctccggactatgaccacttgactctgatgcagaaggtggaggtgtttgagcatgccgtcaataatacagctggggacgacctggccaagctgctgtggctgaaaagccccagctccgaggtgtggtttgaccgaagaaccaattatacccgttctttagcggtcatgtcaatggttgggtatattttaggcctgggagatagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcgagataagctcactggtcgggacttctctcatgatgacactttggatgttccaacgcaagttgagctgctcatcaaacaagcgacatcccatgaaaacctctgccagtgctatattggctggtgccctttctggtaactggaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacaatagtaataccacgtaaatcaagccattcattttggggaacagaagatccataactttagaaatacgggttttgacttaactcacaagagaactcatcataagtacttgctgatggaagaatgacctagttgctcctctcaacatgggtacagcaaactcagcacagccaagaagcctcaggtcgtggagaacatggattaggatcctagactgtaaagacacagaagatgctgacctcacccctgccacctatcccaagacctcactggtctgtggacagcagcagaaatgtttgcaagataggccaaaatgagtacaaaaggtctgtcttccatcagacccagtgatgctgcgactcacacgcttcaattcaagacctgaccgctagtagggaggtttattcagatcgctggcagcctcggctgagcagatgcacagaggggatcactgtgcagtgggaccaccctcactggccttctgcagcagggttctgggatgttttcagtggtcaaaatactctgtttagagcaagggctcagaaaacagaaatactgtcatggaggtgctgaacacagggaaggtctggtacatattggaaattatgagcagaacaaatactcaactaaatgcacaaagtataaagtgtagccatgtctagacaccatgttgtatcagaataatttttgtgccaataaatgacatcagaattttaaacata

SEQ ID NO: 32322 - DNA, 1580 bp, Homo sapiens
tttggggtcaagtttgaggcagttgtaactgtactgagtttagttttgctaataatggtattctacgtgtgtcagcctcgtgtggacttctgtaatgactaatggatatgtttatatcctgagcatttgctgtaggaattttaaatgcaatcccaaaactcaagattaccttatttggagaaatattcgtgttactatgtttaaaatttaatagaaccatattttacctttcactttgggactcgcacaggatgtttgcagctcttgatatacaggaactagaacgtgtcttttaagagcatgcggttttataattacgtggaagtatgctacgcaagggaaaaaagcctcttgctagtgttaagggtcttcataaacagaaaccgcaaggaacctgggatctgacagctgttggaggaatgcctgtgaggaaggaggaggaacagaagaatgctttgatgtcttaaatggtacatccaaacttaagtgaaatagagctgtgaggacattttggggagaagtgacctagataagcactgactgttgcattcatctctcttcttgctgattgtgatgatttcctgtgccatagccattcaaagtctgccaaaaaaggccttgcctcctggatggcatttttgaacccaccctgggccagaggggagcccacttctttgaagacagaaacacaggactggcaacatttaccataagctgactgagcagccattgggccttgagtgaacattggtggtagccaggcagtacttgtctcagtacttgcctcaggcctggggtgtcggtgaccacagggagagcatccatctgcttgaggaaaggagaacaaagaaaataaagggcttaatcttgcacttgattgccagctcagccatagtagaatacagcaccaagtaaattcctaaggatcctgattccaggtcctggctcccagatgacattttaggacttgtcttgggcttagggggagctcgtcatactgaagggaaaaacacaagcctggctggatttgccaccagctgaataaagagtgcttgggccttgagtgaacattggcaatagccaaggagtggtcaccatggaccttaggcaagaaacccggtgccgtgctggctttggatctgacccagcataatctcactggtattttacttcttgtccatttactttttagtttatcatacacaccatgtttactagtactaaaactgtcttaaaatattgcaattttgaccctttttctaattgacctttatgtttttacaagcacattttattacatatgaatgagactttactatgttatatgtaactcttaattctgtaaataatagattgcttatctgaaatatagctgatatttgtttcttaattatttggctattccctatatgttatactctactaaagatcatgggatttagattcagaaaacttacttcctagctcttattatttctgtgatcttgcaaaagaaaacaaaaatgaaccattgtttttttatctgtaacaggaaatgtacttcacaggattgtaatgagaattaaattagataatataca

SEQ ID NO: 32323 - DNA, 1580 bp, Homo sapiens; identical to SEQ ID NO: 32322

SEQ ID NO: 32324 - DNA, 1021 bp, Homo sapiens
cccaggtggttgccccctccctctcctgagatgtcaggaaggagggggccacctgtgtcctccacaggggccccccgaagcctggggactcccagccccagagctccgaggcggaggaggtgctgacaggtgctccgagagatgctccctctcccctcatgctccctccccatcctcctccttttcctcctccccagtgtgccaattgagtcccaacccccaccctcaacattgcccccttttctggcccctgagtgggaccttctctccccccgagtagtcctgtctaggggtgcccctgctgggccccctctgctcttcctgctggaggctggggcctttcgggagtcagcaggtgccccggccaaccgcagccggcgtggggtgagcgaaactgcaccagcgagtcgtcggggtgagctggctgtgtgcgatgcagtcagtggctgggtgacagaccgccggaccgctgtggacttgcgtgggcgcgaggtggaggtgttgggcgaggtgcctgcagctggcggcagtcccctccgccagtacttctttgaaacccgctgcaaggctgataacgctgaggaaggtggcccgggggcaggtggagggggctgccggggagtggacaggaggcactgggtatctgagtgcaaggccaagcagtcctatgtgcgggcattgaccgctgatgcccagggccgtgtgggctggcgatggattcgaattgacactgcctgcgtctgcacactcctcagccggactggccgggcctgagacccatgcccaggaaaataacagagctggatgctgagagacctcagggatggcccagctgatctaaggaccccagtttgggaactcatcaaataatcacaaaatcacaattctctgattttgagctcaatctctgcaggatgggtgaaaccacatggggttttggaggttgaataggagttctcctggagcaacttgagggtaataatgatgatgatataataaaaaaaaaaaaaaaaaaaaaaaa

SEQ ID NO: 32325 - DNA, 1881 bp, Homo sapiens
cctgcatctttttggaaggattctttttataaatcagaaagtgttcgaggttcaaaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggtaacaggcttctctggcccgtagcctcagcggggtgctctcagctgggttttggagcctcccttctgccttggcttggacaaacctagaattttctccctttatgtatctctatcgattgtgtagcaattgacagagaataactcagaatattgtctgccttaaagcagtacccccctaccacacacacccctgtcctccagcaccatagagaggcgctagagcccattcctctttctccaccgtcacccaacatcaatcctttaccactctaccaaataatttcatattcaagcttcagaagctagtgaccatcttcataatttgctggagaagtgtgtttcttccccttactctcacacctgggcaaactttcttcagtgtttttcatttcttacgttctttcacttcaagggagaatatagaagcatttgatattatctacaaacactgcagaacagcatcatgtcataaacgattctgagccattcacactttttatttaattaaatgtatttaattaaatctcaaatttattttaatgtaaagaacttaaattatgttttaaacacatgccttaaatttgtttaattaaatttaactctggtttctaccagctcatacaaaataaatggtttctgaaaatgtttaagtattaacttacaaggatataggtttttctcatgtatctttttgttcattggcaagatgaaataatttttctagggtaatgccgtaggaaaaataaaacttcacatttatgtggcttgtttatccttagctcacagattgaggtaataatgacactcctagactttgggatcaaataacttagggccaagtcttgggtctgaatttatttaagttcacaacctagggcaagttactctgcctttctaagactcacttacatcttctgtgaaatataattgtaccaacctcatagagtttggtgtcaactaaatgagattatatgtggactaaatatctgtcatatagtaaacactcaataaattgcaacatattaaaaaaaaa

SEQ ID NO: 32326 - DNA, 1862 bp, Homo sapiens
ctggttcgcaaagaagctgacttcagagggggaaactttcttcttttaggaggcggttagccctgttccacgaacccaggagaactgctggccagattaattagacattgctatgggagacgtgtaaacacactacttatcattgatgcatatataaaaccattttattttcgctattatttcagaggaagcgcctctgatttgtttcttttttccctttttgctctttctggctgtgtggtttggagaaagcacagttggagtagccggttgctaaataagtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggtaacaggcttctctggcccgtagcctcagcggggtgctctcagctgggttttggagcctcccttctgccttggcttggacaaacctagaattttctccctttatgtatctctatcgattgtgtagcaattgacagagaataactcagaatattgtctgccttaaagcagtacccccctaccacacacacccctgtcctccagcaccatagagaggcgctagagcccattcctctttctccaccgtcacccaacatcaatcctttaccactctaccaaataatttcatattcaagcttcagaagctagtgaccatcttcataatttgctggagaagtgtgtttcttccccttactctcacacctgggcaaactttcttcagtgtttttcatttcttacgttctttcacttcaagggagaatatagaagcatttgatattatctacaaacactgcagaacagcatcatgtcataaacgattctgagccattcacactttttatttaattaaatgtatttaattaaatctcaaatttattttaatgtaaagaacttaaattatgttttaaacacatgccttaaatttgtttaattaaatttaactctggtttctaccagctcatacaaaataaatggtttctgaaaatgtttaagtattaacttacaaggatataggtttttctcatgtatctttttgttcattggcaagatgaaataatttttctagggtaatgccgtaggaaaaataaaacttcacatttatgtggcttgtttatccttagctcacagattgaggtaataatgacactcctagactttgggatcaaataacttagggccaagtcttgggtctgaatttatttaagttcacaacctagggcaagttactctgcctttctaagactcacttacatcttctgtgaaatataattgtaccaacctcatagagtttggtgtcaactaaatgagattatatgtggactaaatatctgtcatatagtaaacactcaataaattgcaacatattaaaaaaaaa

SEQ ID NO: 32327 - DNA, 1650 bp, Homo sapiens
atggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttag

SEQ ID NO: 32328 - DNA, 2359 bp, Homo sapiens
ctcccgtgggctccggccggctaagccgcggcggacaactatgctgaaagccaagatcctcttcgtggggccttgcgagagtggaaaaactgttttggccaactttctgacagaatcttctgacatcactgaatacagcccaacccaaggagtgaggatcctagaatttgagaacccgcatgttaccagcaacaacaaaggcacgggctgtgaattcgagctatgggactgtggtggcgatgctaagtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttgggtttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattcacccaacaaataccgactggctgagcacctgctgtgtgtgcactgctgttctagctgctgaccatagacagcataaatgaaaaagacagaaattcccaccttcgtggaactctccattttcctaaatgttaggttggtgcaaaactaatcgtggtttttgccatttttaatttttaatggcaggggccactattacttttgcaccaacctaataggccgattcagaaacttgagtgcaatgtcttggatatgcaaaaaagaaaatcaaaacgcattcttcattctctataagagttctaggcggggcgtggtggctcacacttgtaatcccagcactttgggaggccaaggtgggcggatcatgaggtcaggagatcgagaccatcctggccaacgtggtgaaaccccatctctactaaaaatagaaaaatcagctgggtgtggtgccgcgtgcctgtaatcccagctacttgggaggctgaggcataagaattgtttgagcctgggaggcagaggttgcagtgagccaagattgcgccactgtactccagcttgggcaacagagcaagactccatctcaaaaaaaaaagagttctagcccaggagcggtggctcacacttgtaatcccagcactttgggatgctgaggcgggcggatcacttgaggccaggagttcaagaccagcctggccaacatggcaaaatcccatctctactaaaaatacagaaattcacagggtgtgttggcacacgcctgtaataccagctactcaggtggctgaggcataagaattgcttgagcctgggaggcagagattgcactgagccgagatcgcgccactatactccagcctgggcaacagacatcctgtctcaaataaattacattaaatgtttaagaagaagtctaaataagtttcatatgctgccctccctcagataatgagggaacctggggtacttaaaatgccaaatgaacgtatacttgatccttattcatagattttgtatttgagaatttgcctactcactaaaatatgtttgtaacccccaaatcaatactgtggcactttctcagttattcgcagacacacagagacaaaaaatttgaagtgcctggctgggcgtggtggctcacgcctgtaatcccagcactttgggaggccgaggcaggcggatcacaaggtccagagatcgagaccatcctggccaacatggtgaaaccccgtctctactaaaaatacaaaaattagctgggcatggtggggcatgcctgtagtcccagctactcagaagggtgaggcagaattgcctgaacccgcgaggcggagactgcagtgagccgagatcgcaccactgcactccagcctggtgacagagc

SEQ ID NO: 32329 - protein, 326 aa, Homo sapiens
MDLSAASHRIPLSDGNSIPIIGLGTYSEPKSTPKGACATSVKVAIDTGYRHIDGAYIYQNEHEVGEAIREKIAEGKVRREDIFYCGKLWATNHVPEMVRPTLERTLRVLQLDYVDLYIIEVPMAFKPGDEIYPRDENGKWLYHKSNLCATWEAMEACKDAGLVKSLGVSNFNRRQLELILNKPGLKHKPVSNQVECHPYFTQPKLLKFCQQHDIVITAYSPLGTSRNPIWVNVSSPPLLKDALLNSLGKRYNKTAAQIVLRFNIQRGVVVIPKSFNLERIKENFQIFDFSLTEEEMKDIEALNKNVRFVELLMWRDHPEYPFHDEY

SEQ ID NO: 32330 - protein, 1075 aa, Homo sapiens
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRIREFSLAGGIWHGRAEGLQVGQDARVLGGE

SEQ ID NO: 32331 - protein, 399 aa, Homo sapiens
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPHRGQGQGPAGVGGSCSAPARPHPVLPSHPLIYSPAGDGRSFIFYYL

SEQ ID NO: 32332 - protein, 1062 aa, Homo sapiens
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRIPPLPPPGELKIVLAAT

SEQ ID NO: 32333 - protein, 1097 aa, Homo sapiens
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRILCRVGRSHSRRRQGLAPGSVLCFPPSSLSCDPAAPLPTASPALSDPDCLLT

SEQ ID NO: 32334 - protein, 1044 aa, Homo sapiens
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQVQSHPSQQLPFHPPGN

SEQ ID NO: 32335 - protein, 1044 aa, Homo sapiens
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQAPLPPPGELKIVLAAT

SEQ ID NO: 32336 - protein, 703 aa, Homo sapiens
MEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAIRPREESLAEKKYTSQGQGDLDSVLSQLNFTHTSEDLLQAEVTCLEGSLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHEAKEISLADLQENYIEALNKLVSENQQLQKDLMNTKSQLEISTQMCKKQNDRIFKPTHSRTTEFKNTEFKPTHGQHRHDGIKTEHYKTDLHSPRGQASDSINPMSRVLSPLSPQISPCSSTRSLTSYSLCKTHSLPSALDTNEANFSDTMSESMNDQEEFISSCSLPVSPLGSIATRFLEEEELRSHHILERLDAHIEELKRESEKTVRQFTALK

SEQ ID NO: 32337 - protein, 261 aa, Homo sapiens
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGSVLQPDASPSKTGTLTSIPVTIPENTSQSQVIGTEGGKNASTSATSRSYSSIILPVVIALIVITLSVFVLVGLYRMCWKADPGTPENGNDQPQSDKESVKLLTVKTISHESGEHSAQGKTKN

SEQ ID NO: 32338 - protein, 259 aa, Homo sapiens
MSQGPKTLVKEWRSQHWSARGEWELDGLALGWTHGLQPQLSCAVEPSSHLGMSCPLRLPGAGRPPRCRRALKGFRGSLCRRGQRLSVAAEGCGGPGWIADSRLDRRFGIADWGLDWGFGVGSGMWGLDRGFEDWIGDLGLDPGFGAGSAVGGSEKVTESSPCSGAGGWGSEKSPPPRSSSASGAAGARWPGLHRPRLHGSGYRIRDAEQRKIQGRLSRTGGGARPGAQEPETWRPGTSSTELLYIWPVPAAMWKWSLSW

SEQ ID NO: 32339 - protein, 2549 aa, Homo sapiens
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 32340 - protein, 46 aa, Homo sapiens [sequence omitted]

SEQ ID NO: 32341 - protein, 46 aa, Homo sapiens [sequence omitted]

SEQ ID NO: 32342 - protein, 210 aa, Homo sapiens
MLPLPSCSLPILLLFLLPSVPIESQPPPSTLPPFLAPEWDLLSPRVVLSRGAPAGPPLLFLLEAGAFRESAGAPANRSRRGVSETAPASRRGELAVCDAVSGWVTDRRTAVDLRGREVEVLGEVPAAGGSPLRQYFFETRCKADNAEEGGPGAGGGGCRGVDRRHWVSECKAKQSYVRALTADAQGRVGWRWIRIDTACVCTLLSRTGRA

SEQ ID NO: 32343 - protein, 175 aa, Homo sapiens
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSR

SEQ ID NO: 32344 - protein, 175 aa, Homo sapiens; identical to SEQ ID NO: 32343

SEQ ID NO: 32345 - protein, 549 aa, Homo sapiens
MARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDPPTTTTLQPTIQWHPSTADIEDLATEPKKLPFPLSTLATIKDDTIATIIASVVGGALFIVLVSVLAGIFCYRRRRTFRGDYFAKNYIPPSDMQKESQIDVLQQDELDSYPDSVKKENKNPVNNLIRKDYLEEPEKTQWNNVENLNRFERPMDYYEDLKMGMKFVSDEHYDENEDDLVSHVDGSVISRREWYV

SEQ ID NO: 32346 - protein, 185 aa, Homo sapiens
MLKAKILFVGPCESGKTVLANFLTESSDITEYSPTQGVRILEFENPHVTSNNKGTGCEFELWDCGGDAKFESCWPALMKDAHGVVIVFNADIPSHRKEMEMWYSCFVQQPSLQDTQCMLIAHHKPGSGDDKGSLSLSPPLNKLKLVHSNLEDDPEEIRMEFIKYLKSIINSMSESRDREEMSIMT

SEQ ID NO: 32347 - DNA, 17 bp, Homo sapiens
gatcatcctgaataccc

SEQ ID NO: 32348 - DNA, 17 bp, Homo sapiens
gatcagaaattatttca

SEQ ID NO: 32349 - DNA, 17 bp, Homo sapiens
gatcatgctcctacctc

SEQ ID NO: 32350 - DNA, 17 bp, Homo sapiens
gatctagttctttgctt

SEQ ID NO: 32351 - DNA, 17 bp, Homo sapiens
gatctgtgttaattttt

SEQ ID NO: 32352 - DNA, 17 bp, Homo sapiens
gatctcctttgctcttg

SEQ ID NO: 32353 - DNA, 17 bp, Homo sapiens
gatctctgtgacccact

SEQ ID NO: 32354 - DNA, 17 bp, Homo sapiens
gatcagaagcaggccac

SEQ ID NO: 32355 - DNA, 17 bp, Homo sapiens
gatccactgtatggtat

SEQ ID NO: 32356 - DNA, 17 bp, Homo sapiens
gatcaaatgcatacttg

SEQ ID NO: 32357 - DNA, 17 bp, Homo sapiens
gatcagatttctccacc

SEQ ID NO: 32358 - DNA, 17 bp, Homo sapiens
gatcttgcaaaagaaaa

SEQ ID NO: 32359 - DNA, 17 bp, Homo sapiens
gatcatttgagttcatc

SEQ ID NO: 32360 - DNA, 17 bp, Homo sapiens
gatctaaggaccccagt

SEQ ID NO: 32361 - DNA, 17 bp, Homo sapiens
gatcaggtcctaaaaca

SEQ ID NO: 32362 - DNA, 17 bp, Homo sapiens
gatcaaataacttaggg

SEQ ID NO: 32363 - DNA, 17 bp, Homo sapiens
gatccccacctttgcct

SEQ ID NO: 32364 - DNA, 17 bp, Homo sapiens
gatctgaaatcacatac

SEQ ID NO: 32365 - DNA, 17 bp, Homo sapiens
gatctttgtacgtaagt

SEQ ID NO: 32366 - DNA, 17 bp, Homo sapiens
gatcactttaggtctgg

SEQ ID NO: 32367 - DNA, 1759 bp, Homo sapiens
gcgtccgcccacgcgtccgggcggggacggagctcggcgtgcttgctgctggagggtgatggccctgcaaggctgtgggctccgacctcaccgggagtcgacagcgagaggttcgccgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctgggatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacagatacatccattccaaagaaaaacccttcaaatgtcaggagtgtgggaaaggattttgtcagtctagaactctagcagttcacaaaactttacacatgcagacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtctcctacccagggggtcgcatccctagcccttcactgaccccagctcttcccttgctgcagccgcacctgcagctccagggagttaactcttcttctgggggactgagaactgtagaaagccacacactactacatcccttcacaaagagtatatgctagtttcttgtagatattcacagctcattttagagctctgtacataatgttgtgggtctttgttttgttgttttgtttgctttgggatcttgttggatgcacttagatatggaaaatggaagccaaattttatctttaaagactgtattttcaaaataaaactttttcttgtttgtttcaaaaaaaaaa

SEQ ID NO: 32368 - protein, 276 aa, Homo sapiens
MGSKALPAPIPLHPSLQLTNYSFLQAVNTFPATVDHLQGLYGLSAVQTMHMNHWTLGYPNVHEITRSTITEMAAAQGLVDARFPFPALPFTTHLFHPKQGAIAHVLPALHKDRPRFDFANLAVAATQEDPPGMGDLSKLSPGLGSPISGLSKLTPDRKPSRGRLPSKTKKEFICKFCGRHFTKSYNLLIHERTHTDERPYTCDICHKAFRRQDHLRDHRYIHSKEKPFKCQECGKGFCQSRTLAVHKTLHMQTSSPTAASSAAKCSGETVICGGTA

SEQ ID NO: 32369 - DNA, 17 bp, Homo sapiens
gatctgccacttatcag

SEQ ID NO: 32370 - DNA, 17 bp, Homo sapiens
gatctgaagtatgtata

SEQ ID NO: 32371 - DNA, 17 bp, Homo sapiens
gatcttgttggatgcac

SEQ ID NO: 32372 - DNA, 17 bp, Homo sapiens
gatcattccatattaca

SEQ ID NO: 32373 - DNA, 17 bp, Homo sapiens
gatcttatttgtaaagg

SEQ ID NO: 32374 - DNA, 4533 bp, Homo sapiens
cactgggagacagtccacttaaatgcagctccagggttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcagtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactggcttcaagtgaaaagccatggattgtgcctacagctaaaatatctgaagattccaaagttctgcagcctcaaactgcaacttatgatgttttctcaagccctacaacatcagatgagcctgagatatcagattcctacacagcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctgctccccagcaaactacatctatcccttctacacctaaacgacgcccccggcccaaaccgccaagaaccaaacctgaaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacaatgagattgcctaccattttataggatatttactatgtatttatacgttaagacctctatgaatgaatgtatcagagaatgtctttgtaactaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaggtataaattctgcaataaagagatgtagtttttttttaaaaaaaaaaaaaaaaaaaaaaaaaaaaaaaaaaaaaaaaaaaaaaaaaaaaaaaaaaaaaaaaaaaaaaaaaaaaaa

SEQ ID NO: 32375 - DNA, 7137 bp, Homo sapiens
cggccaggtgtgtgggactgaagttcttggagaagggagtccaactcttcaaggtgaactatgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcggctgggtgcccggctggccaccacgggccacgtctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgccctggcacgggggcggtcattgcctcgccggagcagctccaggccgcctacgaagcaggctatgagcagtgtgacgccggctggctgcgggaccagaccgtcagataccccattgtgagcccacggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgccactgccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcctactggcgccgaaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcagaagagccgtatacaccttcaccccccgagcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgactgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggagttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtgttagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccacggtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacattagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaaccttgagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaaaaaaaaa

SEQ ID NO: 32376 - DNA, 7434 bp, Homo sapiens
cggccaggtgtgtgggactgaagttcttggagaagggagtccaactcttcaaggtgaactatgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcggctgggtgcccggctggccaccacgggccacgtctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgccctggcacgggggcggtcattgcctcgccggagcagctccaggccgcctacgaagcaggctatgagcagtgtgacgccggctggctgcgggaccagaccgtcagataccccattgtgagcccacggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgccactgccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcctactggcgccgaaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcagaagagccgtatacaccttcaccccccgagcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgactgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggagttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtgttagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccacggtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacgttagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaacctcgagagatcctctggcctaggagtgagcggcagcactttgacatttcaagaaggcgaggcgtccgctgccccagaagtgagtggagaatccaccaccaccagtgatgtggggacagaggcaccaggcttggcttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcgtccatcccagcttctccggaatggaaacgtgaatcagaatcaactgctgcagcccccgccaggtcctgtgcagaggagccctgtggagctgggacctgcaaggagacagagggacacgtcatatgcctgtgcccccctggctacactggcgagcactgtaacatagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcggatcacctgcacagaccccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaaaaaaaaa

SEQ ID NO: 32377 - DNA, 1428 bp, Homo sapiens
ttttcttgcctgagtctgaggtgaacagtgaacatatttacatttgatttaacagtgaaccttaattctttctggcttcacagtgaaacaagtttatgcaatcgatcaaatattttcatccctgaggttaacaattaccatcaaaatgttttgtggagactatgtgcaaggaaccatcttcccagctcccaatttcaatcccataatggatgcccaaatgctaggaggagcactccaaggatttgactgtgacaaagacatgctgatcaacattctgactcagcgctgcaatgcacaaaggatgatgattgcagaggcataccagagcatgtatggccgggacctgattggggatatgagggagcagctttcggatcacttcaaagatgtgatggctggcctcatgtacccaccaccactgtatgatgctcatgagctctggcatgccatgaagggagtaggcactgatgagaattgcctcattgaaatactagcttcaagaacaaatggagaaattttccagatgcgagaagcctactgcttgcaatacagcaataacctccaagaggacatttattcagagacctcaggacacttcagagatactctcatgaacttggtccaggggaccagagaggaaggatatacagaccctgcgatggctgctcaggatgcaatggtcctatgggaagcctgtcagcagaagacgggggagcacaaaaccatgctgcaaatgatcctgtgcaacaagagctaccagcagctgcggctggttttccaggaatttcaaaatatttctgggcaagatatggtagatgccattaatgaatgttatgatggatactttcaggagctgctggttgcaattgttctctgtgttcgagacaaaccagcctattttgcttatagattatatagtgcaattcatgactttggtttccataataaaactgtaatcaggattctcattgccagaagtgaaatagacctgctgaccataaggaaacgatacaaagagcgatatggaaaatccctatttcatgatatcagaaattttgcttcagggcattataagaaagcactgcttgccatctgtgctggtgatgctgaggactactaaaatgaagaggacttggagtactgtgcactcctctttctagacacttccaaatagagattttctcacaaatttgtactgttcatggcactattaacaaaactatacaatcatattttctcttctatctttgaaattattctaagccaaagaaaactatgaatgaaagtatatgatactgaatttgcctactatcctgaatttgcctactatctaatcagcaattaaataaattgtgcatgatggaataatagaaaaattgcattggaatagattttatttaaatgtgaaccatcaacaacctacaacaa

SEQ ID NO: 32378 - DNA, 5585 bp, Homo sapiens
gggcgggcggtgcggccgtggcggtagctgcaggggcggtggcggctgcagtggtggtggtgcctgtggctgtggctgcggctgcggctgcggctgagatttggccgggcgtccgcaggccgtgggggatgggggcagcgagctccagccctcggcggtggcggcggccgtaggtgtggggcgggcgtccgcgtccggcacgcgagatggagcgccgtggatttcagtttttctgactgttacatgaaaggatgattgctcacaaacagaaaaagacaaagaaaaaacgtgcttgggcatcaggtcaactctctactgatattacaacttctgaaatggggctcaagtccttaagttccaactctatttttgatccggattacatcaaggagttggtgaatgatatcaggaagttctcccacatgttactatatttgaaagaagccatattttcagactgttttaaagaagttattcatatacgtctagaggaactgctccgtgttttaaagtctataatgaataaacatcagaacctcaattctgttgatcttcaaaatgctgcagaaatgctcactgcaaaagtgaaagctgtgaacttcacagaagttaatgaagaaaacaaaaacgatctcttccaggaagtgttttcttctattgaaactttggcatttacctttggaaatatccttacaaacttccttatgggagatgtaggcaatgattcattattgcgactgcctgtttctcgagaaactaagtcgtttgaaaatgtttctgtggaatcagtggactcatccagtgaaaaaggaaatttttcccctttagaactagacaacgtgctgttaaagaacactgactctatcgagctggctttgtcatatgctaaaacttggtcaaaatatactaagaacatagtttcatgggttgaaaaaaagcttaacttggaattggagtccactagaaatatggtcaagttggcagaggcaactagaactaacattggaattcaggagttcatgccactgcagtctctgtttactaatgctcttcttaatgatatagaaagcagtcaccttttacaacaaacaattgcagctctccaggctaacaaatttgtgcagcctctacttggaaggaaaaatgaaatggaaaaacaaaggaaagaaataaaagagctttggaaacaggagcaaaataaaatgcttgaagcagagaatgctctcaaaaaggcaaaattattatgcatgcaacgtcaagatgaatatgagaaagcaaagtcttccatgtttcgtgcagaagaggagcatctgtcttcaagtggcggattagcaaaaaatctcaacaagcaactagaaaaaaagcgaaggttggaagaggaggctctccaaaaagtagaagaagcaaatgaactttacaaagtttgtgtgacaaatgttgaagaaagaagaaatgatctagaaaataccaaaagagaaattttagcacaactccggacacttgttttccagtgtgatcttacccttaaagctgtaacagttaacctcttccacatgcagcatctgcaggctgcttcccttgcagacagtttacagtctctctgtgatagtgccaaactctatgacccaggccaagagtacagtgaatttgtcaaggccacaaattcaactgaagaagaaaaagttgatggaaatgtaaataaacatttaaatagttcccaaccttcaggatttggacctgccaactctttagaggatgttgtacgccttcctgacagttctaataaaattgaagaggacagatgctctaacagtgcagatataacaggtccttcctttataagatcatggacatttgggatgtttagtgattctgagagcactggagggagcagcgaatctagatctctggattcagaatctataagtccaggagactttcatcgaaaacttccacgaacaccatccagtggaactatgtcctctgcagatgatctagatgaaagagagccaccttccccttcagaaactggacccaattcccttggaacatttaagaaaacattgatgtcaaaggcagctctcacacacaagtttcgcaaattgagatcccccacgaaatgtagggattgtgaaggcattgtagtgttccaaggtgttgaatgtgaagagtgtctccttgtttgtcatcgaaagtgtttggaaaatttagtcattatttgtggtcatcagaaacttccaggaaaaatacacttatttggagcagaattcacacaagttgcaaaaaaggaaccagatggtatcccttttatactcaaaatatgtgcctcagagattgaaaatagagctttgtgtctacagggaatttatcgtgtgtgtggaaacaaaataaaaactgaaaaattgtgtcaagctttggaaaatggaatgcacttggtagatatttcagaatttagttcacatgatatctgtgacgtcttgaaattataccttcggcagctcccagaaccatttattttatttcgattgtacaaggaatttatagaccttgcaaaagagatccaacatgtaaatgaagaacaagagacaaaaaagaatagtcttgaagacaaaaaatggccaaatatgtgtatagaaataaaccgaattcttctaaaaagcaaagaccttctaagacaattgccagcatcaaattttaacagtcttcatttccttatagtacatctaaagcgggtagtagatcatgcagaagaaaacaagatgaactccaaaaacttgggggtgatatttggaccaagtctcattaggccaaggcccacaactgctcctatcaccatctcctcccttgcagagtattcaaatcaagcacgcttggtagagtttctcattacttactcacagaagatcttcgatgggtccctacaaccacaagatgttatgtgtagcataggtgttgttgatcaaggctgttttccaaagcctctgttatcaccagaagaaagagacattgaacgttccatgaagtcactatttttttcttcaaaggaagatatccatacttcagagagtgaaagcaaaatttttgaacgagctacatcatttgaggaatcagaacgcaagcaaaatgcgttaggaaaatgtgatgcatgtctcagtgacaaagcacagttgcttctagaccaagaggctgaatcagcatcccaaaagatagaagatggtaaaacccctaagccactttctctgaaatctgataggtcaacaaacaatgtggagaggcatactccaaggaccaagattagacctgtaagtttgcctgtagatagactacttcttgcaagtcctcctaatgagagaaatggcagaaatatgggaaatgtaaatttagacaagttttgcaagaatcctgcctttgaaggagttaatagaaaagacgctgctactactgtttgttccaaatttaatggctttgaccagcaaactctacagaaaattcaggacaaacagtatgaacaaaacagcctaactgccaagactacaatgatcatgcccagtgcactccaggaaaaaggagtgacaacaagcctccagattagtggggaccattctatcaatgccactcaacccagtaagccatatgcagagccagtcaggtcagtgagagaggcatctgagagacggtcttcagattcctaccctctcgctcctgtcagagcacccagaacactgcagcctcaacattggacaacattttataaaccacatgctcccatcatcagtatcagggggaatgaggagaagccagcttcaccctcagcagcagtgcctcctggcacagatcacgatccccacggtctcgtggtgaagtcaatgccagacccagacaaagcatcagcttgtcctgggcaagcaactggtcaacctaaagaagactctgaggagcttggcttgcctgatgtgaatccaatgtgtcagagaccaaggctaaaacgaatgcaacagtttgaagacctcgaagatgaaattccacaatttgtgtagggatgtcaaatttcagggtttttttgttgttgttgtgttattttgtggtattgtgcttgttttgtgaaagaatgttttgacagggccccttttgtataggactgccaaatcatgggttttgccttttgttgttgtatttatcctctgttggtaatactgaatggtagaatgttttgatagggtcacatttgtgcctcactggaattatctttaaattctgtatttttaaagttgtgaataagataggtggattcgtattttttaaagttcagttgactttccccaccaaatggtccatttgaatgcatccctaatatatgatatagtctcaactaataggtgcaatttgggaaaatcaggtttattttttggagtggaactgttataagtgcttatttataaaaggaatgtttctgaatgcaagtgcctaaaaagatctttgttggtatgcatatgttttgtcacacaattttatagtgcatctttcaccatttgtgcttttttaagatacgtatgtaagctcttatttttcaattggcaattcagttaatttttaaatgtttacataatggccagaaggcttgcaaatctgtatttaattgcattttaattaattgccagtttttacatgtgatagtcagttgtacaaagaaaatgcacttaaacctgtttctaaattatatattcagttatattatatttggctttagatggttttaatacatttgatagtttttcaccccttggctttattttatataaacttttgtttttcagcagttctgaactttttagtattttataaatggtccaaaaaatgcctgtttcagaagtttttgaattcagtgcatttcctcttgatttgtctgggttaaaaccattccttttgtatgaaatgttttgacttaggaatcattttatgtacttgttctacctggattgtcaacaactgaaagtacatatttcatccaaatcaagctaaaatttatttaagttgattctgagagtacaggtcagtaagcctcattatttggaatttgagagaaggtataggtgatcggatctgtttcatttataaaaggtccagtttttaggactagtacattcctgttattttctgggttttatcattttgcctaaaataggatataaaagggacaaaaaataagtagactgtttttatgtgtgaattatatttctactaaatgtttttgtatgactgtgttatacttgataatatatatatatatatatatcaacttgttaaattatttcatgttcccgtggcttcttttcagttgttgcctattacagtatgagagtttaaggttattaaccattggcttagaagtcaacacctaggatcatacatccgttgactacaatgtggaatgaattttatggaaacctgttttatagttctatgtgatgtaaaggtctagggagcaataaccagcccttttttttctgaaggcttgtttttagtcctcattgtacaaaatataaaataatcatattgctatgaatacctaaaaaaaaaaaaaaaaa

SEQ ID NO: 32379 - DNA, 815 bp, Homo sapiens
agagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaatctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagatcaaaaaaaaaa

SEQ ID NO: 32380 - DNA, 2809 bp, Homo sapiens
tttttttttttttttgctttcccgtttcttaaacattggcgttcccaagtttctccttggtcctcctgtcatttttatctactctcgtagcttcaaataccatctagtttatagtttatttagcatgttgtccaagccaccgtcttgggcccagggctctacctgtagcttttcatccacacttctcaggttgcttcttacacagcgccatagtagttaaaatacggtctggggatagtcgtctcttcatcagtctcccccgacgacctgcgcaggcgtggcttgaggaaacgcccgctgtgggcggagccacccgaaaggctccggtcgggggcgggaacaggatcggcccgcgggctggcgtcgataggctgccgcagagacagggcgggctctgctaagggacgcgcctcgccgtggggcggtgcctgcgcctgagcctctacgagagggaaggaacgctgctccgagctccgcgtcgcgtcgcgtagattcgcgtcgccgtcgacctcagaggcggggccggaagcgctacggtttgacccccgagtccctctgttcccgaaggggcggccgtctttctcccgacccgctccgcctcctctccttcttccccattacccggaggccgaagcccccagccagggcggggcggcgcagcccgagctcccggacccggaagaagcgccatctcccgcctccaccatggagcccaccgcaccgtccctcaccgaggaggacctcactgaagtgaagaaggacgccttagaaaatttacgtgtatacctgtgtgagaaaatcatagctgagagacattttgatcatctacgtgcaaaaaaaatactcagtagagaagacactgaagaaatttcttgtcgaacatcaagtagaaaaagggctggaaaattgttagactacttacaggaaaacccaaaaggtctggacacccttgttgaatctattcggcgagaaaaaacacagaacttcctgatacagaagattacagatgaagtgctgaaacttagaaatataaaactagaacatctgaaaggactaaaatgtagcagttgtgaaccttttccagatggagccacgaacaacctctccagatcaaattcagatgagagtaatttctctgaaaaactgagggcatccactgtcatgtaccatccagaaggagaatccagcacgacgccctttttttctactaattcttctctgaatttgcctgttctagaagtaggcagaactgaaaataccatcttctcttcaactacacttcccagacctggggacccaggggctcctcctttgccaccagatctacagttagaagaagaaggaacttgtgcaaactctagtgagatgtttcttcccttaagatcacgtactgtttcacgacaatgacactttattgccttttaatttttaatgatgacaaaaaatgttttaaagaatatgactttttataaaatggctgtaatcatttgtttacatttgatgcatgtcttttaaaatgcaatgtaagcatactttgtaaataggatttttagaattaaaaaagcatacttctaggatagctaactgtaaatcatgttgatcatgtactttttagtaatttctttttttcctttttaaggtctttcagtacttttttaaatattttctattttaagactgattttaatagggaatatatctctatttgagaatagacccttactaggaagaacgttttttcctcagtgcatttgtgctagaaattttcaagagtctaatagtctttgccagtcattcagcagcaaattttcagcattaagctgttcctgttcagtaataaaaccggtcactgatgggaaaactgccaatatagaaaaataaaaatctcttttccactccattgtcgtataggcatgtaaacagcctctttttgatactggaggaacacttgatggagtgtgagccacctaagatctcggtttgccaaaattcatttctaattaaccttactaattatactactttgttaggattttcacattcttggcttaatcattttcattcctaaagaaaaatatcttggcctaaacctcagttattacatgtaatttgatgaggtattttttccttttttcttttttttttttttgagacagtcttgctctatcgcccaggctggagtgcagtggcgcattctaggctcactgcaacttctgcctcccatgcttacgtgatcctctcacctcagcctctcaagtaatatagctgagactacaagtgtgtgccaccatgcctcactaatttttgtattatttttgtagagacggtgttttgccatgttggccaggctggtcttgaactcctggactcaagcaacctacccagcgtggcctcccaaagtgctgggattacagacacgagccacctcacctagcctgatgagatttttaaaaaatattttctctgtacttttcattctcttttaatgaggaccaatgtacagttgaaataactggaacaaattatttttggtgtgtgtgacaattctgtttttaatgctatttgaacaagtgggccattagccagatttgtctttttgttgtaaaacaaaatttgactaattttacatgtttataaatcttatgctctcactgtttgtttttatttaaattacaattttatctgtttcctgacattgtctcctatatatttctattattaattgcaaaaacatagaaatggaaattttgctatcaacaataaaatttttttaaagtaaaaaaaaaaaaaaaaaaaaaaaaaaaaaaaa

SEQ ID NO: 32381 - DNA, 1258 bp, Homo sapiens
gcccgcgaaccaacggttagcggtggcaggggctgactgagagcgtctgcttgataatggattctgaattaatgcatagtatagtaggaagctatcataaacctccagaaagagtatttgttccctcattcacccagaatgaaccatctcagaattgccatcctgcgaacttagaagttacctctcctaagatacttcatagcccaaatagccaagctcttattttagccttaaaaactcttcaggaaaaaattcattgtttagagctggagagaacacaagctgaagatgacctgaacattctttccagagaagcagcacagtataagaaggccttagagaatgaaacaaatgagagaaatctagcacatcaggagctgataaagcagaaaaaagatgtaagtatacagttaagctcagcccagtctcgttgcactcttctagagaagcaactagaatatacaaagagaatggttctcaatgtagagcgagaaaagaacatgatcctagaacaacaggcccagcttcagagggaaaaagaacaagatcagatgaagctgtatgcaaaacttgacaagcttgatgtcttagaaaaagagtgttttagacttacaacaactcagaaaactgctgaggacaagattaaacatttagaagaaaaacttaaggaagaagaacatcagcgtaagctatttcaagacaaagcttctgagcttcaaactggacttgaaatcagtaaaattatgtcttcagtttcaaatttaaagcactccaaggaaaagaagaaatcttcaaagaaaactaaatgtataaagagaggaccaccttggcaaatttgttcaaagtttggagcactgccttttgtggctgaaaagatgaggcaacatcgtgacccacatatccttcagaaaccttttaacgtgactgagactagatgtctccccaagccttctagaacaactgcctggtgtaaagctattactcctgactcagaaaagtccatttccatttgtgacaatttatctgaacttttgatggcaatgcaagatgagctggaccaaatgagcatggagcactaagaactactcaaacaaatgaaggaaactgaaagccattcagtctgtgacgagatagaatgtgaactagagtgtttagtcaagaaaatggaaattaaaggagaacaaatctccgaactcaagaagcatcaagacagtgtaagaaggctttagtaagagattttaataaaaagataaaatat

SEQ ID NO: 32382 - DNA, 1258 bp, Homo sapiens; identical to SEQ ID NO: 32381

SEQ ID NO: 32383 - DNA, 9350 bp, Homo sapiens
gaggccccgagagcaaagctggatggtgcacggctggagggtgacctgtccctggccgacaaggatgtgactgccaaagacagcaagttcaaaatgcccaagttcaagatgccgtcgttcggggtgtctgccccaggcaagtccattgaggtctcggtggatgtgtctgcgccgaaggtggaggccgaagtgagcctcccctccatgcagggggacctgaagaccactgacatcagcattgagcccccctctgcccaactggaggtccaggctggccaggtggacctgaagctcccagagggccacgttcccgagggagctggcctcaaagggcacctgcccaagttgcagatgcccagtttcaagatgcccaaagtagatcgcaagggaccccagatagatgtcaagggccccaagctggacctgaaaggcccgaagacggacgtgacggcccccgacgtggaggtgtctcagcccggcatggaggtggatgtcgaggccccaggagccaagttggatggtgcacggctggagggggacctgtccctggccgacaaggatgtgactgccaaagacagcaagttcaaaatgcccaagttcaagatgccgtcgttcggggtgtctgccccaggcaagtccattgaggtcttggtggatgtgtctgcgccaaaggtggaggccgacctgagcctcccctccatgcagggggacctgaagaacactgacatcagcattgagcccccctctgcccaactggaggtccaggctggccaggtggacgtgaagctcccagagggccacgttctcgagggagctggcctcaaagggcacctgcccaagttgcagatgcccagtttcaagatgcccaaagtagatcgcaagggcccccagatagacatcaagggccccaagctggacctgaaaggcccgaagatggatgtgacggcccccgacgtggaggtgtctcagcccagcatggaggtggacgtcgaggccccaggagccaagttggatggtgcacggctggagggggacctgtccctggccgacaaggatgtgactgccaaagacagcaagttcaaaatgcccaaattcaagatgccgtcgtacagggcgtctgccccaggcaagtccatccaggcctcggtggatgtgtctgcgccgaaggcggaggccgacgtgagcctcccctccatgcagggggacctcaagaccactgacctcagcattcagctcccttctgtggacctggaggtccaggctggccaggtggacgtgaagctcccggagggccacgtgcccgagggagctggcctcaaagggcacctgcccaaggtggagatgcccagtttcaagatgcccaaagtggacctcaagagcccccaggtggacatcaagggccccaagctggacctaaaagtccccaaggcggaagtgacagtccctgatgtggaggtgtctctgcccagcgtggaggtggacgtccaggccccgagagccaagctggatggtgcgcggctggagggggacctgtccctggctgaaaaggatgtgactgccaaagacagcaagttcaaaatgcccaagttcaagatgccctccttcggggtgtcggccccaggcaggtccatcgaggcctcgctggatgtgtctgcgccgaaggtggaggccgacgtgagcctctcctccatgcagggggacctcaaggccactgacctcagcattcagcccccttccgctgacctggaggtccaggctgtccaagtggatgtggaactcctggagggccccgtgcccgagggagccggcctcaaagggcacctgcccaaagtggagatgcccagtttaaagacgcccaaagtggacctcaagggcccccagatagatgttaagggccccaagctggacctgaaaggccccaaggcagaagtgagagtccccgatgtcgaggtgtctctgcccagcgtggaggtggatgtccaggccccgaaggccaagctggatgctgggcggctggagggagacctgtccctggctgacaaggacgtgactgccaaagacagcaagttcaaaatgcccaaattcaagatgccgtcattcagggtatcggccccagggaagtccatggaggcctcggtggatgtgtctgcacccaaggtggaagccgatgtgagtctcccctccatgcagggggacctgaagaccactgacctcagcattcagcccccttctgccgacctgaaggtccaggctggccagatggatgtgaagctcccggagggccaggtgcccgagggagccggcctcaaagagcacctgcccaaggtggagatgcccagtttgaagatgcccaaagtggacctcaagggcccccaggtggacatcaagggccccaagctggacctaaaagtctccaaggcggaagtcacagcccctgatgtggaggtgtctctgcccagcgtggaggtggacgtccaggccccaagagccaaactggatagtgcacagctggagggggacctgtccctggccgacaaggatgtgactgccaaagacagcaaattcaaaatgcccaagttcaagatgccgtcatttggggtgtctgccccaggcaagtccattgaggcctcggtgcacgtgtctgcacccaaggtggaggccgatgtgagtctcccctccatgcagggggacctcaagaccactgacctcagcattcagccccattctgccgacctgacggtccaagctcgccaggtggacatgaaactcctggagggccacgtgcccgaggaagccggcctcaaaggacacctgcccaaggtgcagatgcccagtttcaagatgcccaaagtcgacctcaagggccctgaaatagacatcaagggccccaagctggacctaaaagaccccaaggtggaagtgacagcccctgatgtggaggtttctctgcccagcgtggaggtggacgtcgaggccccaggagccaagctggatggtgcgcggctggagggggacctgtccctggccgacaaggacatgacggccaaagacagcaagttcaaaatgcccaagttcaagatgccgtcgttcggggtgtctgccccaggcaagtccatggaggcatcagtggatgtgaccgcgccaaaggtggaggccgacgtgagcctcccttccatgcagggggacctcaaggccactgacctcagcgttcagcccccttccgctgacctggaggtccaggctggccaagtggacgtgaaactcccagagggccccgtgcccgagggagccagcctcaaagggcacctgcccaaggtgcagatgcccagtttcaagatgcccaaagtggacctcaagggcccccagatagatgttaagggccccaagctggacctgaaaggccccaaggcggaagtgacagcccctgatgtgaagatgtctctgtccagcatggaggtggacgtccaggccccgagagcaaagctggatggtgtgcagctggagggggacctgtccctggccgacaaggatgtgactgccaaagacagcaagttcaaaatgcccaagttcaagatgccatcattcggggtgtcggccccaggcaagtccatggaggcgtccgtggatgtgtctgagctgaaggcgaaagccgacgtgagcctcccctccatgcagggggacctcaagaccactgacctcagcattcagtccccttccgccgacctggaggtccaggctggccaagtggacgtgaaactcccggagggccccctgcccaagggagccggcctcaaagggcacctccccaaggtgcagatgccctgtttgaagatgcccaaagtggccctcaagggcccccaggtggatgtcaagggccccaagctggacctgaaaggccccaaggcggatgtgatgacccccgtcgtggaggtgtctctgcccagcatggaggtggacgtcgaggccccgggagccaagctggacagtgtgcggctggagggtgacctgtccctagccgacaaggacatgactgccaaagacagcaagttcaaaatgcccaagttcaagatgccgtcgttcggggtgtctgccccaggcaagtccatcgaggcctcgttggatgtgtctgcgctgaaggtggaggctgacgtgagcctcccctccatgcagggggacctgaagaccactcacctcagcattcagcccccttccgctgatctggaggtccaggctggccaagaggatgtgaaactcccagagggccctgtgcatgagggagccggcctcaaagggcacctgccgaagctgcagatgcccagtttcaaggtacccaaagtggacctcaagggtccccagatagacgttaatgtccccaagctggacctgaaaggccccaaggtggaggtgacgtcccccaacctggacgtgtctctgcccagcatggaggtggacatccaagccccaggagccaagctggacagtacgcggctggagggggacctgtccctggctgacaaggacgtgactgccaaagacagcaagttcaaaatgcccaagttcaagatgccatcctttgggatgttgtccccaggcaagtccatcgaggtctcggtggatgtgtctgcgccaaagatggaggccgacatgagcattccctccatgcagggggacctcaagaccactgacctccgcattcaggccccttccgccgacctggaggtccaggctggccaggtggacttgaaacttccagaaggccacatgcccgaggtagccggcctcaaagggcacctgcccaaggtggagatgcccagtttcaagatgcccaaagtggacctcaagggcccccaggtggacgtcaagggccccaagctggacctgaaaggcccaaaggcagaggtgatggcccccgatgtggaggtgtctctgcccagcgtggagacggatgtccaggccccaggatccatgctggatggtgcgcggcttgagggggacctgtccctggcccacgaggatgtagctgggaaagacagtaagtttcaaggaccaaaactgagcacgtctggttttgaatggtcgtcaaagaaagtttccatgtcttcctctgaaatcgaaggaaatgttacattccatgagaagacttccacatttcccattgtggaatctgttgttcatgaaggtgatcttcatgatccatctcgcgatggtaacttggggcttgctgttggagaagttggaatggattcgaagtttaagaaactgcattttaaagtgcccaaagtttcattttcttctaccaaaactcctaaagatagtttagtcccaggtgcaaagtctagcataggtctttccacgattcctttatcatcttcagaatgctcaagttttgaattacaacaggtttcggcttgttcagagccatccatgcagatgcctaaggtgggttttgctgggtttccatcatcccggcttgatctcactggtcctcactttgaatcttctattctctctccctgtgaggatgttacacttacaaaataccaggtgactgttcccagagctgccttggcccctgagcttgctctggaaattccttctgggtctcaggctgatattcctcttcccaagacagagtgctccactgacctgcagcctccagagggagttccaacatctcaagctgagagtcactctggcccactgaattccatgattcctgtttctcttggtcaggtatcttttcctaaattctataaaccaaagtttgtgttttcagtcccccaaatggcagttcctgagggagacctacatgcagcagtgggtgccccagtcatgtctcctcttagccctggagaaagagtgcagtgccccttgccaagcacccagctgccatccccaggcacctgtgtgtctcagggcccagaagagcttgtggcctccttgcagacatcagtagtggcccctggagaagccccttctgaagatgctgaccacgaagggaaagggagtcccttgaaaatgcctaagattaagcttccatcatttaggtggtccccgaagaaggaaacagggccaaaggtggacccagaatgcagcgtggaggactcaaaactcagcctggttttagacaaggatgaagtggccccgcagtctgccatccacatggatctgcctcctgagagggatggagagaaggggaggagcacaaagcctggctttgccatgccaaaacttgcacttcccaaaatgaaggcttctaagagtggggtcagcctgccacagagagacgtggatccttccctttctagtgccacagcagggggtagctttcaagacacagaaaaggccagcagtgacggtggtaggggaggacttggtgcaacagcaagtgccacaggaagtgagggtgtgaacctccaccggccacaggtccacattcccagtttgggctttgccaaacctgatctcagatcctccaaggccaaggtggaggtgagccagcctgaagctgacctgcctcttcccaaacatgatctgtctaccgaaggtgacagcagaggatgtgggctcggggatgtcccagtgagccagccttgtggggaggggatagcccccacacctgaagatcccctccagccatcctgtagaaaaccagatgctgaagtcctcacagtggaaagcccagaggaggaagccatgaccaagtactcgcaggaaagctggtttaaaatgcccaagttccgcatgcccagccttaggcgctctttcagggacagaggcggggctggaaagctggaagtggctcagacacaggcaccggcagcaacagggggtgaagcagcagctaaagtcaaagagttccttgtttctgggtcaaacgtggaggcagctatgtccctacagctcccagaggcagatgcagaagtgacagcttctgagagcaaatcatccacagatattctaaggtgtgatcttgacagcacaggcttgaagctgcacctctccactgctgggatgactggggatgagctttccacttctgaggtcaggatccatccatccaaaggacctctcccttttcagatgcctggcatgaggcttccagaaacccaggttcttccaggagaaatagatgagactcctctttccaagccaggacatgaccttgccagcatggaggataaaacagagaaatggtcttcccagcctgaaggtccacttaaattgaaagcttcaagtactgatatgccatcccagatttctgtggttaatgtggatcaactgtgggaagattctgtcctaactgtcaaattccccaaattaatggtaccaaggttctccttccctgcccccagctcagaggatgatgtgttcatccccactgtgagggaagtgcagtgtccagaggccaatattgatacagccctttgtaaggaaagtccggggctctggggagccagcatcctgaaggcaggtgctggggtccctggggagcagcctgtggaccttaacctgcctttggaagctcccccaatttcaaaggtcagagtgcatattcagggtgctcaggttgaaagtcaagaggtcactatacacagcatagtgacaccagagtttgtagatctctcagtacccaggactttttccactcagattgtgcgggaatcagagatccccacgtcagagattcaaacaccttcgtacggattttccttattaaaagtgaaaatcccagagccccacacgcaggctagagtgtacacaacaatgactcaacactctaggactcaggagggcacagaagaggctcccatacaagccaccccaggagtagactccatttctggagatctccagcctgacactggagaaccatttgagatgatctcttccagcgtcaatgtactgggacagcaaacactcacatttgaagttccttctggccaccagcttgcagacagctgttcagatgaggagccagcagaaattcttgagtttccccctgatgatagccaagaggcaaccacaccactggcagatgaaggcagggctccaaaagacaaaccagaaagtaaaaaatctggtctgctctggttttggcttccaaacattgggttttcctcttctgttgatgagacaggtgttgattccaaaaatgacgtccagagatctgctcccattcaaacacagcctgaggcacgaccagaggcagaactgcctaaaaaacaggagaaggcaggctggttccgatttcccaaattagggttctcctcatctcctaccaagaaaagcaaaagcaccgaagatggggcagagctggaagaacaaaaacttcaagaagaaacaatcacgttttttgatgcccgagaaagtttctcccctgaagagaaggaagagggtgaactgatcgggcctgtgggcactgggctggactccagagtgatggtgacatccgcggcaagaacagagttaatcctgcccgagcaggacagaaaagctgacgatgaaagcaaagggtcaggcctgggaccaaatgaaggctgagaggtatggctcatcagtacaagagagatgcaaaaaactaagttggaaagtaaaggctacacacacatatggagcaccccatcccacagcacattacatccacctcacttcacagaacggagaacagagcagaaatgaccagaacacctttgtcaccatcacacagccctcctaaaatggaaccaaagcttcccagctccctcaaagctttggatgcaaagaaggcaccctgacttccacaagacaccagaattcacacggtactcagaggcactgctggggaagtttgttggtctttattagataaatttccagagacctgtccataatacccaacagaacatgactgtttctttgaggaaagggttataatgtctgtggtgtacaagtcgtttttggtataacttctttcctgctgctgctgcttcccggcaaacatagttttcctatttcaggcagagtgcggtatattccaggaaacactgtttcctactcacttagcttacttctttgttgaatgcctcactaatggcaagtttcaagatgttttgggtgacaatgcacacatgctgggcaaaagggtgatggccagtggctggcagctgggccagcagaagctaggacatctgtgagttgtcattctcatctatccatgtccactggcctgccagcatccgccagtgccttgccagtgtgcacggtcccacactgtggcccctgagtcccctaatgtacacgctgcagccagaatgcagatggagctggcttggctgttccctggatgggcaataaagaaagtgctgcat

SEQ ID NO: 32384 - DNA, 9350 bp, Homo sapiens; identical to SEQ ID NO: 32383

SEQ ID NO: 32385 - DNA, 3426 bp, Homo sapiens
atgcgtcctcaaaagcggacagagtgctccactgacctgcagcctccagagggagttccaacatctcaagctgagagtcactctggcccactgaattccatgattcctgtttctcttggtcaggtggtccccgaagaaggaaacagggccaaaggtggacccagaatgcagcgtggaggactcaaaactcagcctggttttagacaaggatgaagtggccccgcagtctgccatccacatggatctgcctcctgagagggatggagagaaggggaggagcacaaagcctggctttgccatgccaaaacttgcacttcccaaaatgaaggcttctaagagtggggtcagcctgccacagagagacgtggatccttccctttctagtgccacagcagggggtagctttcaagacacagaaaaggccagcagtgacggtggtaggggaggacttggtgcaacagcaagtgccacaggaagtgagggtgtgaacctccaccggccacaggtccacattcccagtttgggctttgccaaacctgatctcagatcctccaaggccaaggtggaggtgagccagcctgaagctgacctgcctcttcccaaacatgatctgtctaccgaaggtgacagcagaggatgtgggctcggggatgtcccagtgagccagccttgtggggaggggatagcccccacacctgaagatcccctccagccatcctgtagaaaaccagatgctgaagtcctcacagtggaaagcccagaggaggaagccatgaccaagtactcgcaggaaagctggtttaaaatgcccaagttccgcatgcccagccttaggcgctctttcagggacagaggcggggctggaaagctggaagtggctcagacacaggcaccggcagcaacagggggtgaagcagcagctaaagtcaaagagttccttgtttctgggtcaaacgtggaggcagctatgtccctacagctcccagaggcagatgcagaagtgacagcttctgagagcaaatcatccacagatattctaaggtgtgatcttgacagcacaggcttgaagctgcacctctccactgctgggatgactggggatgagctttccacttctgaggtcaggatccatccatccaaaggacctctcccttttcagatgcctggcatgaggcttccagaaacccaggttcttccaggagaaatagatgagactcctctttccaagccaggacatgaccttgccagcatggaggataaaacagagaaatggtcttcccagcctgaaggtccacttaaattgaaagcttcaagtactgatatgccatcccagatttctgtggttaatgtggatcaactgtgggaagattctgtcctaactgtcaaattccccaaattaatggtaccaaggttctccttccctgcccccagctcagaggatgatgtgttcatccccactgtgagggaagtgcagtgtccagaggccaatattgatacagccctttgtaaggaaagtccggggctctggggagccagcatcctgaaggcaggtgctggggtccctggggagcagcctgtggaccttaacctgcctttggaagctcccccaatttcaaaggtcagagtgcatattcagggtgctcaggttgaaagtcaagaggtcactatacacagcatagtgacaccagagtttgtagatctctcagtacccaggactttttccactcagattgtgcgggaatcagagatccccacgtcagagattcaaacaccttcgtacggattttccttattaaaagtgaaaatcccagagccccacacgcaggctagagtgtacacaacaatgactcaacactctaggactcaggagggcacagaagaggctcccatacaagccaccccaggagtagactccatttctggagatctccagcctgacactggagaaccatttgagatgatctcttccagcgtcaatgtactgggacagcaaacactcacatttgaagttccttctggccaccagcttgcagacagctgttcagatgaggagccagcagaaattcttgagtttccccctgatgatagccaagaggcaaccacaccactggcagatgaaggcagggctccaaaagacaaaccagaaagtaaaaaatctggtctgctctggttttggcttccaaacattgggttttcctcttctgttgatgagacaggtgttgattccaaaaatgacgtccagagatctgctcccattcaaacacagcctgaggcacgaccagaggcagaactgcctaaaaaacaggagaaggcaggctggttccgatttcccaaattagggttctcctcatctcctaccaagaaaagcaaaagcaccgaagatggggcagagctggaagaacaaaaacttcaagaagaaacaatcacgttttttgatgcccgagaaagtttctcccctgaagagaaggaagagggtgaactgatcgggcctgtgggcactgggctggactccagagtgatggtgacatccgcggcaagaacagagttaatcctgcccgagcaggacagaaaagctgacgatgaaagcaaagggtcaggcctgggaccaaatgaaggctgagaggtatggctcatcagtacaagagagatgcaaaaaactaagttggaaagtaaaggctacacacacatatggagcaccccatcccacagcacattacatccacctcacttcacagaacggagaacagagcagaaatgaccagaacacctttgtcaccatcacacagccctcctaaaatggaaccaaagcttcccagctccctcaaagctttggatgcaaagaaggcaccctgacttccacaagacaccagaattcacacggtactcagaggcactgctggggaagtttgttggtctttattagataaatttccagagacctgtccataatacccaacagaacatgactgtttctttgaggaaagggttataatgtctgtggtgtacaagtcgtttttggtataacttctttcctgctgctgctgcttcccggcaaacatagttttcctatttcaggcagagtgcggtatattccaggaaacactgtttcctactcacttagcttacttctttgttgaatgcctcactaatggcaagtttcaagatgttttgggtgacaatgcacacatgctgggcaaaagggtgatggccagtggctggcagctgggccagcagaagctaggacatctgtgagttgtcattctcatctatccatgtccactggcctgccagcatccgccagtgccttgccagtgtgcacggtcccacactgtggcccctgagtcccctaatgtacacgctgcagccagaatgcagatggagctggcttggctgttccctggatgggcaataaagaaagtgctgcat

SEQ ID NO: 32386 - DNA, 2252 bp, Homo sapiens
cagaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagaatctggtcaacctgtagttccgttggacagacagtttctcatccatgaactaaatgcatttgaagaatcaaaggataatacaatacctcttttatatgggattttagcccatttcttgcgtggaactaaggatggcatccagaatgcatttctgaaagggccttcacttcagccttcagacccaagtcttggcagacaacctagtagaagaaagccaatggatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagactggagtgcagtggcacgatctcggctcactgcaatctctgcctcccggattcaagtgattctcctgcctcagcctcccaagtagctgggaaaacaggcctgtgccaccacaccggagtagtttttgtatttttagtagagatggggtttcaccatgctggccaggctggtcttgaactcctgacctcaggtgatctgtgtgccccagcctcccaaagcgctgggattacaggtgtgagccactgagcccagccatttaggaagtattataaaggcccttaaagtttgtaaggaaatgaaagggctttgtattaccttttcaataggcaacaatgtactttttctttccttagactttggcttactggaagatttaattaaaaggtagaggagaagtaaatttgctgtaataattttgctgtaaataaaacaaagagtttattttattagataaagaatgtgaagtaagcatgaagagacaggctttgggagaaataccagaaagggatttttcaaagatggcattgtttaatctccgtgtggccctcggttgtgcaatcacagatgagccagaagagggccagccccctacttgtttgggctccgaaactcttaccaaacatcaatttttattcttgggatagaaaaatagtatgtgctatctctaatacgctacttcgatatttattaaagaagtatttttaatgtagtgtccacaggctcatttcattgaaaacaactgactatgatgatagacagctcctgattggcaaaagttcgatggtatattcagaattaaattttgcctgcgcacctaaacactgacaacatttagcttaaaggttttccatggagaagagtggtaagagctgtagttagcaaaattggcatcctctttagggtgtcaattctgtgctgctttgcaaattgttgaaacttttgattttctgtttggcaatgctagtcagtgttcacttcttacagattagccaagaatttttatctaaatgcagaaacttattaatgaaatccatttaaactatacttacacaacattttgggaggccctgctggtaaaattatatatggatgcagaagtattgcaagagtccattttccatttttaaatctgcaatatctgattacattgatgaattccgttgtattgtatgtgtgaatataaatatctgaattctcccgggggacttggttttcgtccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatttgtttgtactgcggcaactttttatactttcaatgtatcatttaataaaaaaaataagcaagtc

SEQ ID NO: 32387 - DNA, 1910 bp, Homo sapiens
gtctctgacaggctcagctggagagggacgggttgggacgcactgtccttttgcccttccccctccgcgagcagaagctgactccgcaggagcgagggtcgcagagctgggtgagcggaaatgtccctcccagagtgaagtcgcagggcccgccccgcgtctgagggagcggaggtcttcctgggggatttcagtctccacatagttttggagccggacttttgaagaatgattcgtgaatccggaatgggtgacagcgtcatcacggcattttattgacagaccatggattcttacagtgcaccagagtcaactcctagtgcatcctcaagacctgaagattactttataggtgccactcctctgcagaaacgattagaatcggtcaggaagcagagttcatttatcctgactccacctcgaaggaaaattccccagtgttcgcagttgcaggaagatgttgaccctcaaaaggttgcattccttctgcataaacagtggactttatatagtttaactcccttatataaattctcctatagtaatctcaaagagtattctagacttctcaatgcttttattgttgctgaaaagcaaaaaggacttgctgtggaagtgggagaagacttcaacatcaaagtgattttttctactctcctaggaatgaaaggaacacaaagggacccggaagcatttcttgtccagattgtgtcaaaatctcaattgccatctgagaatagagaaggtaaagtgctgtggactggctggttctgctgtgtatttggagacagtcttctggagactgtttcagaagatttcacctgtctgcccttattccttgcaaatggagcagagtctaacacagcaataattggaacttggtttcagaaaacctttgactgttatttcagtcctttagcaatcaatgcatttaatctttcctggatggctgccatgtggactgcatgcaaaatggaccattatgtggctactactgaatttctttggtctgtaccctgtagccctcaaagtctggacatttctttcgcaatacatccagaggatgcaaaagctctatgggacagtgtccacaaaacacctggggaggttacccaggaagaagttgacctattcatggattgcctttattcacatttccatagacatttcaaaattcatttatcagccacaagattagttcgtgtttcaacatctgtagcttcagcacatactgatggaaaaataaagattctgtgtcataaataccttattggagtgttagcatatttgacagaactggcaatttttcaaattgagtgaagccttatgtggactataagttatagattatatactcttattgataacttgcctaattgctatgctgaaagagactgcaggagaaataggcatctatctctgcatctgttttccccaccatgcctttggagttgccaagatggaagccaagaaggatctagaagaacaaagaatatggtagtagatgagccacagccaggtgcccatgtactaatcatgataacctgacatgccattctcaaaatgctgagttgttaatttcttgtcatctttaaatatatatatataggctgggcttggtggctcacacctgtaattccagcactttgggaggctgaggtgggtggatcatttgaggccaggaattcaagaccagcctggccaacatggtgaaaccccttctctactgaaaatacaataattagctgggcgtggtggcacatgcctgtgatcccagctactggggaggctgaggcaggagaatcgttttaacccagaagacaggctgcagtgagccaagactgcaccactgcactccagcctgggcaacaaagtgagactctgcctcaaaaaataaaaaaaaaaaaaaa

SEQ ID NO: 32388 - DNA, 1197 bp, Homo sapiens
gaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggagaggtcaaggccaggcccccacttggcttgaagggacattttcagacttttctttctgtcacttggagtgtctatgcctctcatatttccctaataaactcctcaactttttatctgactgctgtgattatggtggggagaggagctagagatgggttcacttattgcacagaaatgtaatacatggcgttattattctaacataaaactttcagatgtagctgtttgattcaaagcctaggtggcttaccagcccaagtccccatgtttggactttcagctgactagctcatcttgggaatcatttggtcattcagcacatttaccaagtatttactatgtaggcatgttaaactccaataaaacatacagcattgaatcagaaaaaaaaaaaaaaaaaaaaaa

SEQ ID NO: 32389 - DNA, 1532 bp, Homo sapiens
agcgcagcgggggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatacttgaaacaaaataggaaaatggcagcaaactcttcaggacaaggttttcaaaacaaaaatagagttgcaatcttggcagaactggacaaagagaaaagaaaactacttatgcagaaccagtcttcaacaaatcatcctggagctagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctcatgcctgtaatcccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaaaaaaaaaa

SEQ ID NO: 32390 - DNA, 1499 bp, Homo sapiens
cttcctgtctctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatgctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaactttacaaaaaaaaaaa

SEQ ID NO: 32391 - DNA, 1307 bp, Homo sapiens
cttcctgtctctccactttctttccctctccgttttggtgggctgaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggcctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaactttaaaaaaaaaaaaaaaaaaa

SEQ ID NO: 32392 - DNA, 1681 bp, Homo sapiens
tcaggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatgacggagggtcgctcttgttgccgtggctggagtgcaatggtgcgatctcggctcactgcaacctttgcctcgtgggttcaagtgattctcctgcctcagcctcccgagtagctgggattgcaggcgtccaccaccacgcccagctaatttttgtattttagtagagagagggtttcaccgtgttggccacgctggtcgggaactcctgacctcaggcctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaactttaaaaaaaaaaaaaaaaaaa

SEQ ID NO: 32393 - DNA, 1649 bp, Homo sapiens
gtttcaggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatgccggagctgcggcccgcaactccctcagcctggcaggtcccaggatgcttcggggcaaccccacgcatgcgcgctctggcgtagttccctgaagcactcgctcgcagagaatcctggaatcttcgcttgtggagctgtggaggcaacggagtttttccgcgctttttctttcagcctcaggcctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaactttaaaaaaaaaaaaaaaaaaa

SEQ ID NO: 32394 - DNA, 1857 bp, Homo sapiens
ggaatggggcgggacttccagtaggaggcggcaagtttgaaaagtgatgacggttgacgtttgctgatttttgactttgcttgtagctgctccccgaactcgccgtcttcctgtcggcggccggcactgtagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggtattcaggagctacaacaatcactaaatcaggattttcatcaaaaaacgatagtgctgcaagagggaaattcccaaaagaagtcaaatatttcagagaaaaccaagcgtttgaatgaactaaaattgttggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttaaaaaaaaaaaaaaaaaaaaaa

SEQ ID NO: 32395 - DNA, 2003 bp, Homo sapiens
ggaatggggcgggacttccagtaggaggcggcaagtttgaaaagtgatgacggttgacgtttgctgatttttgactttgcttgtagctgctccccgaactcgccgtcttcctgtcggcggccggcactgtaggtgagcgcgagaggacggaggaaggaagcctgcagacagacgccttctccatcccaaggcgcgggcaggtgccgggacgctgggcctggcggtgttttcgtcgtgctcagcggtgggaggaggcggaagaaaccagagcctgggagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtctatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgttggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttaaaaaaaaaaaaaaaaaaaaaa

SEQ ID NO: 32396 - DNA, 1163 bp, Homo sapiens
ctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcaaaa

SEQ ID NO: 32397 - DNA, 1154 bp, Homo sapiens
cgctcagggaaggcgggtgcgcgcctgcggggcggagatgggcagggggcggtgcgtgggtcccagtctgcagttaagggggcaggagtggcgctgctcacctctggtgccaaagggcggcgcagcggctgccgagctcggccctggaggcggcgagaacatggtgcgcaggttcttggtgaccctccggattcggcgcgcgtgcggcccgccgcgagtgagggttttcgtggttcacatcccgcggctcacgggggagtgggcagcgccaggggcgcccgccgctgtggccctcgtgctgatgctactgaggagccagcgtctagggcagcagccgcttcctagaagaccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcaaaa

SEQ ID NO: 32398 - DNA, 1437 bp, Homo sapiens
ctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtgggtagaaggtctgcagcgggagcaggggatggcgggcgactctggaggacgaagtttgcaggggaattggaatcaggtagcgcttcgattctccggaaaaaggggaggcttcctggggagttttcagaaggggtttgtaatcacagacctcctcctggcgacgccctgggggcttgggaaaccaaggaagaggaatgaggagccacgcgcgtacagatctctcgaatgctgagaagatctgaaggggggaacatatttgtattagatggaagtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcaaaa

SEQ ID NO: 32399 - DNA, 4318 bp, Homo sapiens
aagcggctcgggctgcggctggctcagagtgccgcggggggcgtggggcggtgctgaggagctgaagccgtggccagctcgactccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaggtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaggagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattctttctggtgattctgaaccttgcctcatagcttaaagtataaaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttctttgtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattggtacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcaaaaaaaaaaaaaaaaaaaaaaaaaaaa

SEQ ID NO: 32400 - DNA, 2807 bp, Homo sapiens
ccactgtatgactgactccccggggacatgaggtggatactgttcattggggcccttattgggtccagcatctgtggccaagaaaaattttttggggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcaggcccttttagacaatgaagatgatgaaatgcaacacaatgaagggcaagaacggagcagtaataacttcaactacggggcttaccattccctggaagctatttaccacgagatggacaacattgccgcagactttcctgacctggcgaggagggtgaagattggacattcgtttgaaaaccggccgatgtatgtactgaagttcagcactgggaaaggcgtgaggcggccggccgtttggctgaatgcaggcatccattcccgagagtggatctcccaggccactgcaatctggacggcaaggaagattgtatctgattaccagagggatccagctatcacctccatcttggagaaaatggatattttcttgttgcctgtggccaatcctgatggatatgtgtatactcaaactcaaaaccgattatggaggaagacgcggtcccgaaatcctggaagctcctgcattggtgctgacccaaatagaaactggaacgctagttttgcaggaaagggagccagcgacaacccttgctccgaagtgtaccatggaccccacgccaattcggaagtggaggtgaaatcagtggtagatttcatccaaaaacatgggaatttcaagggcttcatcgacctgcacagctactcgcagctgctgatgtatccatatgggtactcagtcaaaaaggccccagatgccgaggaactcgacaaggtggcgaggcttgcggccaaagctctggcttctgtgtcgggcactgagtaccaagtgggtcccacctgcaccactgtctatccagctagcgggagcagcatcgactgggcgtatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactaggcgatggctctgctctgtctacatttatttgtacccacacgtgcacgcactgaggccattgttaaaggagctctttcctacctgtgtgagtcagagccctctgggtttgtggagcacacaggcctgcccctctccagccagctccctggagtcgtgtgtcctggcggtgtccctgcaagaactggttctgccagcctgctcaattttggtcctgctgtttttgatgagccttttgtctgtttctccttccaccctgctggctgggcggctgcactcagcatcaccccttcctgggtggcatgtctctctctacctcatttttagaaccaaagaacatctgagatgattctctaccctcatccacatctagccaagccagtgaccttgctctggtggcactgtgggagacaccacttgtctttaggtgggtctcaaagatgatgtagaatttcctttaatttctcgcagtcttcctggaaaatattttcctttgagcagcaaatcttgtagggatatcagtgaaggtctctccctccctcctctcctgtttttttttttttgagacagagttttgctcttgttgcccaggctggagtgtgatggctcgatcttggctcaccacaacctctgcctcctgggttcaagcaattctcctgcctcagcctcttgagtagcttggtttataggcgcatgccaccatgcctggctaattttgtgtttttagtagagacagggtttctccatgttggtcaggctggtctcaaactcccaacctcaggtgatctgccctccttggcctcccagagtgctgggattacaggtgtgagccactgtgccgggcccgtcccctccttttttaggcctgaatacaaagtagaagatcactttccttcactgtgctgagaatttctagatactacagttcttactcctctcttccctttgttattcagtgtgaccaggatggcgggaggggatctgtgtcactgtaggtactgtgcccaggaaggctgggtgaagtgaccatctaaattgcaggatggtgaaattatccccatctgtcctaatgggcttacctcctctttgccttttgaactcacttcaaagatctaggcctcatcttacaggtcctaaatcactcatctggcctggataatctcactgccctggcacattcccatttgtgctgtggtgtatcctgtgtttccttgtcctggtttgtgtgtgtgtgtgtgtgtgtgtgtgtgtgtgtgtgtgtgtttgtgtgtgtgtgtctgtctattttgtatcctggaccacaagttcctaagtagagcaagaattcatcaaccagctgcctcttgtttcatttcacctcagcacgtaccatctgtccttttgttgttgttttgtttttgtttttttgcttttaccaaacatgtctgtaaatcttaacctcctgcctaggatttgtacagcatctggtgtgtgcttataagccaataaatattcaatgtgaaaaaaaaaaaaaaaaa

SEQ ID NO: 32401 - DNA, 2910 bp, Homo sapiens
ggcggcggccggccggggaggcggcctcggcgcacagtaatggcagcgctgtgagcaggggaacgcgagctgacagccgccgccgccgccgcctccgcccaccttcctcgccggggcttcgtctttcactccttcgggctgcctccccctccccttgtcccctgccccttgccctgcttctgcagaagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaaaaaaaaaaaaaaaaaaaaaaa

SEQ ID NO: 32402 - DNA, 2912 bp, Homo sapiens
gcgcaggcagtgctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggct

SEQ ID NO: 32403 - DNA, 14198 bp, Homo sapiens
ccggcctcgcgttccctcggacggttgcccaatggcagcccaggtggcagcccgggaggcgcgagacttcagagaagccccgacccttcgcctaacctcgggggccggcctggaggcagtgggcgctgtggagctcgaggaggaggaggagaacgaggaggaggcggcggccaggagagcgcggagtttcgcccaagacgcgcgggtgcgcttcctcggcggccgcctggcgatgatgctggggttcacggaggagaaatggagccagtatttggaaagcgaggacaaccggcaggttcttggggagtttctggaaagcaccagcccggcttgccttgtgtttagcttcgccgcctcggggcgccttgcggcttcccaggagattccaagagatgcaaaccataaacttgtttttatttccaagaagattactgaaagcattggagtaaatgacttttctcaagtggttttatttggagagttacctgcgttgtctcttggacatgtatctgctttccttgatgagattttagtgccagttctttctaataagaacaaccataagtcctggtcctgttttacttcacaagatatggaatatcacatagaagtcatgaaaaagaagatgtatatttttaggggcaaaatgtctagaagaactcttctaccaattcccactgttgcaggaaagatggatctggatcagaattgttcagagaacaagccaccgtcaaatgaaaggataatacttcatgcaattgaatctgtggttattgaatggtcacatcaaatccaagaaattatagaaagagattcagtgcagcgtttgttgaatggtcttcacttgtctcctcaagcagaactagatttctggatgatgaggagagaaaatctgtcatgcatttatgatcaacttcaggcacctgttgtcctcaaaatggttaagatcctgacaactaaacaaagcagctattttcctactctgaaggacatttttctggctgtggaaaatgctcttctcgaagcccaagatgtggaactttacctgagacctctgaggagacacatccagtgtctccaggagacggaattcccacagacacgcatattaatcgctccattatttcataccatctgtctgatctggagtcattccaagttttataacaccccagctcgggttatagttttattgcaagagttttgtaatctcttcattaaccaggcaacagcttacctttcacctgaggaccttttgaggggagaaatagaagagtcactggaaaaggtgcaggtggctgttaacatcttaaagactttcaaaaactcctttttcaactatagaaaaaaattggcaagctactttatgggaagaaagctgagaccatgggatttccagtctcatctggtgttttgcagatttgacaagtttcttgatcgtttaataaaaatagaggatatatttgccaccactttggaatttgaaaagctggaaagactggaatttggtggtaccaaaggagcaattttaaatggacaagtccacgagatgagtgaagaacttatggaactctgtaaactttttaaacagagcacttatgacccatctgattgcactaacatggagtttgaaagtgattatgtggcatttaagtccaaaactctggaatttgacagaaggcttgggacaattatttgtgaagctttctttaactgcaatggcttagaagctgcatttaagcttttgaccatatttggaaattttctagagaagccagttgtcatggaaattttcagcctacattacagcacactagtgcatatgtttaatacagagctggatgtgtgtaagcaactgtataatgaacacatgaaacagattgaatgtggtcatgtagttcttaacaagaacatgccatttacctcaggaaatatgaaatgggcccagcaggttctccaacgacttcaaatgttttggtcaaacttcgcatctctccgttatctatttttgggcaatcctgatcacgctttagtttatcaaaagtatgttgaaatgaccactttgcttgatcaatttgaaagtcgtatctataatgaatggaaaagtaatgtggatgaaatctgtgaattcaatttgaatcaacccttggttaaattcagtgccataaatggtcttctctgtgtcaattttgacccaaagctagtggctgtattgagagaagtgaaatatcttttgatgttgaagaaacaagacataccagattcagctttagccatcttcaagaaaaggaacactattttaaagtacattggaaatcttgaccttcttgtgcaagggtataataaactcaaacagacgctcctggaagttgaataccctctgattgaagatgagctgagggctattgacgagcagctgacagcagccacaacgtggctgacatggcaggatgactgctggggctacatcgagagggtgagggcagccacgtccgagttggagcacagagttgagcgcacacagaaaaacgtgaaggtgatccagcagaccatgaggggctgggccaggtgcgtgctacctcccaggagagagcacagacgagaggcagccttcaccttggaggacaagggtgatttgtttacaaaaaaatacaagttaatccaaggagatggctgcaagatccacaacttggtcgaggaaaataggaagctcttcaaagccaatccctctctggatacctggaaaatttatgtagaattcattgacgacattgtggtggaaggcttttttcaggctataatgcacgacttagacttctttctgaagaatacagagaaacaattgaaaccggcaccgttttttcaagcacaaatgatcttgttgcctcctgagattgtgtttaaaccttccctagacagagaggctggggatggcttctatgatcttgtagaagaaatgttatgcaatagttttagaatgtctgcccagatgaaccgaatagcaacacacctggaaattaaaaattatcagaatgatatggataacatgttaggcctggcagaggtcaggcaggagatcatgaacagagtggtgaatgtcatcaacaaagtcttagatttcagaaacaccctggagacccacacttacctctgggtggatgatcgagctgagtttatgaagcattttctcttgtatggccatgctgtgtcttccgatgaaatggatgctcatgcaaatgaagaaattcccgaacaaccaccaactcttgagcaattcaaagaacagattgacatttatgaagctttgtatgttcaaatgagcaaatttgaggactttagagtgtttgatagttggttcaaggtggacatgaagcctttcaaagtgagcttgttaaccataattaagaaatggagctggatgtttcaggagcatcttttgagatttgtcattgacagtctgaatgagctacaagaatttataaaggagacagattccggacttcagagagaattaaatgaaggtgatcatgatggtttagttgacatcatggtgcatcttctggctgtaagaagccgacagagagctactgatgaactctttgaacctctaaaagaaacgatcaccctcttggaaagctatggccagaagatgcctgagcaggtctatattcagctagaggaattacctgaaagatgggaaactaccaaaaagatcgcagcaactgtcagacatgaagtctcacctctccataatgcggaagtcactcttataaggaaaaaatgtattttgtttgacgcaaagcaggcagagttcagagagagattcagacactatgcccctcttggatttaatgcagaaaatccatacacagcgcttgataaggcaaatgaagagcttgaggccttagaagaagaaatgttgcagatgcaagaatctactcgtctttttgaagtggctcttccagagtacaaacaaatgaaacagtgtcgcaaagaaataaaattgctcaagggactgtgggatgtcattatttatgttcgaagaagcattgataattggactaaaacccagtggagacagattcatgtggaacagatggatgtagaactcagaaggtttgccaaggcgagttccataactgaaatttggtcactcaacaaggaagtccgcgtctgggatgcttacacgggcctggaaggcacagttaaggacatgacagcctccctgagggccatcacagagttacagagccctgccctcagggacaggcattggcaccagctgatgaaagctattggggtcaagtttttaataaatgaagccacaactttggcagatttgttagcactgcggttacacagagtggaagatgatgtccgaaggattgtggacaaggcggtgaaagagctggggactgagaaggttattactgaaatcagtcagacctgggcaaccatgaagttttcttacgaagttcactatcgaacaggcattccattactaaagtctgatgaacaactttttgaaactctagagcacaaccaagttcagttgcagactcttcttcaaagcaagtatgtagaatatttcattgagcaagtgttaagctggcaaaataaattaaacatagcagacttggtcatcttcacttggatggaagtccagcgaacttggtctcacctggaaagcatttttgtctgttcagaagatattcgaatccagcttgtgaaagatgctagaagatttgatggggtggatgctgaatttaaggagttaatgttcaagacagccaaagtagaaaatgtgttagaagcaacgtgcagacctaatctctatgaaaaacttaaagatttacagtccaggctttctctttgtgaaaaagctctcgctgaatacctggaaaccaagcgcatagcctttcctcgcttctatttcgtctcttctgctgatttacttgacattctctcaaaaggagctcagcctaaacaggtaacatgtcaccttgccaaacttttcgacagcattgcagatctgcagtttgaagacaatcaggatgtttctgcacacagggcagttggaatgtacagcaaagaaaaggagtatgtcccattccaagccgagtgtgaatgtgtgggccatgtggaaacatggcttctgcaacttgaacagactatgcaagaaacggtgcgtcattctataacagaagccatagtggcctacgaggaaaaacctagggaactgtggatttttgatttcccagctcaggttgcactaaccagctcacaaatatggtggaccacagatgtaggaatagccttcagtagactggaagaaggctacgaaacagccctgaaggatttccataaaaaacagatttctcagctgaatacactgattacacttttgctgggagaacttccacctggagacagacagaagatcatgacaatttgtaccatagatgtccatgccagagacgtggtggcaaaacttatttctcagaagcaagttgttgtcagtccccaagcttttacatggctgtctcaacttcgtcaccgatgggaggatacccagaaacactgctttgttaatatttgtgatgcccagttccagtacttctatgaatacttaggaaacagccctcgactagtgatcactcctctaactgacaggtgttatattaccttaactcaatcacttcatctaaccatgagtggggctcctgctggcccagctggtaccgggaaaacagagaccaccaaagacctaggacgtgcccttggcatgatggtctatgtattcaactgttcagagcaaatggactacaaatccataggcaatatctataagggattggtgcagacaggagcttggggctgctttgatgagttcaaccgaatctctgtggaagttctgtcagtggtggcagtacaagtgaaaatgattcatgatgccatcagaaacaggaagaagagatttgtatttcttggggaagctatcacactgaagccatcagttggaatatttattactatgaacccgggttatgctggtcgaaccgaattaccggaaaatctcaaagctcttttcagaccctgtgccatggtggcccctgacattgagctaatctgtgaaatcttgttagttgctgaaggttttgtggatgcgcgtgcattagcccgaaagttcattacgttgtacacgctttgcaaggagcttctctccaagcaggatcattacgactggggacttcgtgctattaagtctgtcttggttgtggctggatctctgaaacgaggagataaaaatagacccgaagatcaggtactcatgagagcattaagggatttcaatatgcccaaaatagtgactgacgacatcccagtgtttctgggcctggtcggtgacctgtttccagccctggatgtgccccggaggaggaagctgcactttgaacagatggtcaggcagtctaccctggagctccgcctgcagcctgaagagagcttcatcctcaaagttgtccagcttgaggaactgttggctgtgcggcactcggtctttgtagttggaaatgcaggcacaggaaagagtaagattttgagaacactgaaccgaacatatgttaacatgaaacagaagccggtttggaatgacttaaaccctaaagctgtgacaacagatgaactctttggtttcatacatcatgctacccgagaatggaaagatggcaagattgtttactcttattttataggtctcttctcatccattctacgagaacaagcaaatcttaagcatgatggaccaaaatggatagtcctggatggcgatattgaccccatgtggattgaatcactgaatactgtaatggatgataacaaggtgctgaccctcgccagcaatgagcgcattgcactcactcccttcatgaggcttctgtttgagatacatcacttaaggagcgcaaccccggccactgtttccagagctggtattctgtatgtgaacccacaagatctgggctggaatccgtatgtggccagttggatagacagaaggcggcatcaatcagaaaaggccaatttgactattctttttgataaatatgtccctgcatgcttggataaactgagaacaagctttaaaaccatcacttcaattcctgagagtagcctggtgcagactctatgtgttcttttggagtgcttgctgactcctgaaaatgtaccttctgacagcccaaaagaagtttatgaagtctattttgtatttgcttgtatctgggcttttggaggcaccctgctacaagatcagatttctgattatcaagctgacttcagtcggtggtggcagaaagagatgaaagcagtgaaatttccgtcgcagggaacaatctttgattattatgtggaccacaaaactaagaaattattgccctgggctgacaaaattgcccagtttactatggatccagatgtgcctctgcagacagttctcgttcacacaacagagacagctcgtcttagatatttcatggagttgttgcttgagaaaggaaaacctctaatgctagtaggaaatgcaggagtgggaaaaacagtctttgtaggtgacacattggcaagtctctctgaggattacatagtatcccgtgtgcctttcaactactacacgacatccacagctctgcaaaaaattcttgagaaacccctagagaaaaaagctggtcataactatggtcctggaggaaataaaaaattgatttattttatcgacgacatgaacatgcctgaagtggacttatatggcaccgttcagcctcataccctgatccggcagcatattgattatggacattggtatgatagacagaaggtgatgcttaaagaaatccataactgccagtatgtcgcctgcatgaatccgatggtgggcagcttcaccatcaatcccaggctacagagacatttcacagtgtttgcattcaattttccatctttggatgcactaaacaccatctatggccaaatctttagcttccatttccaacagcaagcatttgctccatcaattctcaggagtggccccactttgatccaggcaacaatagcattccatcagacaatgatgtgtaactttttacccacggctattaaattccactacatctttaatctgagagatttatcaaacgtcttccaggggattttatttgcttctcctgagtgtttaaaaggtccacttgatttaatacatctgtggcttcatgaatctgcccgtgtttatggagacaaactgatagacaaaaaagattgtgatttgtttcagagaagaatgctggaaactgcttataaatattttgaaggtatagatagtcacatgctgcttcaacagcccctcatttattgccactttgctgatagagggaaggacccacattacatgccagtgaaggactgggaagtgctgaagacgattcttacagaaacgttagacaactacaatgaactaaatgctgccatgcacctagttttgtttgaagatgccatgcaacatgtgtgtcgcatcagccggatcttacgaacccctcagggctgtgctctcttggttggagttgggggcagtggcaagcagagcttgtccaggctggcagcttaccttcgtggccttgaggtctttcagatcactctgaccgagggctatggaatccaggaacttcgggtagatcttgccaatttgtacatccgaactggagccaagaacatgcccactgtgttcctgctgacagatgcccaggttctagatgagagcttcctcgtgctgattaatgacttgctggcatcaggagaaatcccagatctgttcagcgatgaagatgtggacaagataatttctggaattcataatgaagttcatgctctgggcatggtagactccagggaaaactgttggaaattctttatggccagggtgcgactacagctcaaaatcattttgtgtttctctccagttggtcgcacgctgagagttagagctcggaagttcccagccatagttaactgcacggctattgactggtttcatgcgtggccgcaggaggctctggtctccgtcagcaggaggttcattgaggaaaccaagggaattgagccagtgcacaaagactctattagccttttcatggcacatgttcacaccactgtaaatgaaatgagtaccagatattaccagaatgagagaagacacaactataccaccccaaagagttttctagaacaaatatcactgtttaagaacctgttgaagaagaagcaaaatgaggtatccgagaaaaaagaacgcctggtgaacggcatccaaaagctaaaaaccacagcctctcaggtgggagatctaaaagccagacttgcctctcaagaagccgagctgcaactgagaaatcatgatgccgaagctctgatcacaaagatcggccttcagacggagaaagtgagccgggaaaagaccatcgctgatgctgaggagcgaaaggtgacagccattcagactgaagtgttccagaaacagagagaatgtgaagctgacttactcaaggctgagcctgcactggtggctgctacagctgcactcaatacactcaacagggtcaacctcagtgagctgaaagcctttcccaaccctcccatcgcagttaccaatgttactgcagccgtgatggtccttctggctcctcggggaagagtgcccaaagaccgaagttggaaagcagctaaagtcttcatgggaaaggttgatgattttttgcaagcattaattaactatgacaaagagcacattccagagaactgtctaaaagtggtgaatgaacactatttgaaagacccagagtttaatccaaacctgattcgaaccaaatcttttgcagcagctggcctgtgtgcctgggtcatcaacatcattaaattctatgaggtctactgtgatgtggagccaaaacgccaagcattagcccaagcaaacttagaactggctgcagctactgaaaaactagaggctatcaggaaaaagcttgtggatctggatcgaaatctgagcagactcacggcttcatttgaaaaagcaacagctgagaaagtccggtgtcaagaagaggtgaaccaaaccaacaaaaccatcaaattagctaacagacttgtcaaggaacttgaggcaaagaagattcgctggggtcaatccattaagtcctttgaagctcaagagaagacactctgtggagatgttcttctcacggcggcatttgtgtcttacgtcggacccttcacaaggcagtatcgccaggagctggtgcactgcaagtgggttccctttcttcaacagaaggtttccattccactaaccgaaggcctggacttgatatccatgttgacggatgatgctacaattgccgcctggaataacgaaggactgcccagtgacagaatgtccaccgaaaatgccgctatcctaacacactgtgagcgctggcctctggtgatagatccccagcaacagggaattaagtggatcaagaataagtatggaatggacctgaaagtcacacatttgggccagaaagggtttttgaatgccattgaaactgctttggcctttggtgatgtcatcttaattgaaaatctcgaggaaacgatagatccagtcctggatccactacttggcaggaacacaattaaaaaaggaaagtatatcaggattggagataaagaatgtgaatttaacaagaactttcgccttatccttcacacaaaattggcaaatcctcactataagccggaattacaagctcagacaactctcctcaatttcacagtcacagaagatggtctagaagcccagctgctggcagaggttgtcagtattgaaaggccagatttggagaaacttaagttggtattgacaaagcaccaaaatgattttaaaattgagctcaagtatctggaagacgatctccttttgcgcctttctgcggcagagggaagctttctggatgacaccaaactggtagagagattggaggcaacaaagaccaccgtggcagagatagagcacaaggtgattgaagccaaagaaaatgaaagaaaaatcaacgaggcccgagaatgttacagaccagtggcagcaagagcatctcttctttattttgttattaatgacctccaaaaaatcaaccccctctaccaattctctttgaaggcttttaacgtgctgttccacagagcgatcgagcaggctgacaaggtggaagacatgcagggacgcatctctatcctgatggagagcatcacccatgctgtcttcctctacaccagccaggcgctgtttgagaaggacaagctcaccttcctgtcccagatggcttttcagattttgttgagaaagaaagagatagaccctcttgaattggatttcctgcttcgattcacagttgaacacactcatctgagtcccgttgacttcctaacttctcagtcatggagtgctatcaaggcaattgccgtcatggaagaatttcgaggcatagaccgagatgtggaaggatctgccaagcagtggaggaagtgggtagaatccgagtgtccagaaaaagaaaaattacctcaagaatggaagaagaaaagtttaatacagaagctgattcttctgagagcaatgcgccctgacagaatgacgtatgctctcagaaattttgtagaggaaaaactgggtgcgaagtatgtggagaggaccagattggacttagttaaagcattcgaagaaagcagcccagccacccccatattcttcatcctgtctccgggggtagatgcccttaaagacctggagattcttggcaaaagacttggctttacaattgactctggaaaattccacaatgtgtctttaggacaaggtcaggagacggtggcagaagtggccctggagaaagcttccaaaggaggacactgggtcatcctccaaaatgttcatttggtagccaagtggctaggaaccttggagaagctccttgaaagattcagccaaggaagccacagagattacagggttttcatgagtgctgagtctgcacctacaccagatgagcatatcatccctcaaggactcctggaaaattccattaagatcactaatgaacccccaacagggatgctggccaatttgcatgccgccctgtacaactttgatcaggatacacttgaaatatgctccaaggagcaggagtttaaaagcatccttttttctctctgctacttccacgcctgtgttgctgggagactgaggtttggcccccagggctggagccgaagctatccttttaatcctggagacctcaccatttgtgccagtgtcctctacaactacttagaggcaaactctaaagtcccatgggaagatctccgttatctctttggtgagatcatgtatggaggccacatcacagatgactgggatcgcaaactgtgtcgggtgtatttagaagaattcatgaatccatctctgactgaagatgaactgatgctggcaccaggttttgctgccccaccctacctagattatgcaggctaccaccagtacatagaggagatgcttcctccagaaagcccggcactgtatggcctccacccaaatgctgaaatagaattcctgacagtgacatccaacactctcttcagaactttgctggagatgcagcccaggaatgcactcagtggtgatgaactggggcagtctacagaagaaaaggttaagaatgtcttggatgacattttggagaaacttccagaagagttcaacatggcagagataatgcaaaaaaattcaaatagaagcccatatgttcttgtttgcttccaagaatgtgagaggatgaatattctcattcgggaaatacgtatatcacttgaacaactggaccttagtttgaagggggaattggcattatctcctgctgtggaagcccagcagtttgcattgagttatgacacggtaccagacacttggagcaaactggcttatccttctacttatggcctagcccagtggttcaatgacctcctcctgcgatgccgagaactcgatacttggacacaagaccttacccttccggctgtcgtgtggctctccggcttcttcaaccctcagtccttcttaactgcaatcatgcagacgatggctcgaaaaaatgagtggcccctggataaaacgcgcttgactgctgatgttaccaaaaaaacaaaggaagattatggacacccgccaagggaaggtgcatacctccacggactcttcatggagggcgcccgctgggacacccaagcaggaaccattgttgaagcccgtctcaaggagctggcatgccctatgccggtcatctttgcaaaagccacccccgtggacagacaagaaaccaaacagacctacgagtgccctgtgtatagaaccaaactgagaggccccagctacatctggaccttcaggctgaagagcgaagagaagactgcaaaatgggttctggctggagtggctctgcttctagaagcgtaaggtaacactggcattcctctagcctctgctggagtgcagtgaggattttctagcatgttgctgcactgttcccatgcacattattctaactttttagtaactcacacgtgcattcttttttcaacgctatccttagagtgaaagtcagaaaaaaatactagaaactaactcagggctgagcgtggtggcacacgactgtaatcccagttactcaggaggtaggagaatcacttgaacctaggaggcaaaggttgcagtgagccgaggttgcaccactgcactccctcctgggcaacagaacaagactccatctcaaaaaaaaaaaagtacatcataaaagtacatcatatgtgaacatgcaaaagcaatgcagccggaaagaacggagattttaatttttaacaaacaacaaattaaattattagcccttaaactctttcaaaatataaaagcagcaggccccaggtgagtcctgaaggaagaggctagcactctgtaaggcctccagtgtccagtgtctacaatgttgatggtccccttttgttcagtcaagttttaataaaaataaaactgttctacagttaattgcaaaaaa

SEQ ID NO: 32404 - DNA, 3104 bp, Homo sapiens
acggcgcgctgggctcacactgtcccgccgcggacgggctttgtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgaaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaaaaaaaaaaaaaaaa

SEQ ID NO: 32405 - DNA, 3182 bp, Homo sapiens
acggcgcgctgggctcacactgtcccgccgcggacgggctttgtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgaaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaaaaaaaaaaaaaaaa

SEQ ID NO: 32406 - DNA, 4698 bp, Homo sapiens
cttgcgcactgagaactcacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagatgacaatgaaggagacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacaaagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagatggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaaccaagcttctgcagattttgtgattcttgggacttttttgacgtaagaaatacttctttatttatgcatattcttcccacagtgatttttccagcattcttctgccatatgcctttagggcttttataaaatagaaaattaggcattctgatatttctttagctgctttgtgtgaaaccatggtgtaaaagcacagctggctgctttttactgcttgtgtagtcacgagtccattgtaatcatcacaattctaaaccaaactaccaataaagaaaacagacatccaccagtaagcaagctctgttaggcttccatgttagtgtagcttctctcccacaagttgtcctcctaggacaagaattatcttacaaactaaactatcatcacactaccttgtatgccagcacctggtaacagtagagatttttatacattaatcttgatctgttttaatcttgatctgttttagtagagatttttatacattaa

SEQ ID NO: 32407 - DNA, 3099 bp, Homo sapiens
tgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaagcagtggggtacgttagactcagatggaaaagtattctaggtgccagtgttaggatgtcagttttacaaaataatgaagcaattagctatgtgattgagagttattgtttggggatgtgtgttgtggttttgcttttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttaaaaaaaaaaaaaaaaaaaaaa

SEQ ID NO: 32408 - DNA, 2605 bp, Homo sapiens
caaaaaagaatggagaggaaatacacagaaagcaacgtgtatgaaaatgggctatgaagaggtttctcagaagttcacctccatacggcgagtccgtggtgataattactgtgcactgagggccacgctgttccaggccatgagccaggctgtggggctgccgccctggctgcaggacccggagctcatgctgttaccagaaaaactcataagcaaatacaactggatcaagcaatggaaacttggactgaaatttgatgggaagaatgaggacctggttgataaaattaaagagtcccttactctgctgaggaagaagtgggcaggcttggctgaaatgagaactgctgaagcaagacagatagcttgtgatgaactattcacaaatgaggcggaggaatatagcctctatgaagctgtaaaatttctaatgctaaacagagccattgaactatataatgataaagagaaaggaaaggaagtaccatttttctctgtgcttctgtttgctcgggacacatcaaatgacccaggacagcttctgaggaaccacctcaaccaggtgggacacactggtggtcttgaacaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatatctcaaatcaaaactctctctaatggtaaactggcttctaatttttttaagtacagtatttttttttcccctttagtagtaacgggtttctatagatcttcctatacagtctgctttaactcaggaccttgagattatgagactgacgtgctgcccactgcactgagggggcttctaacagtctgctttaagtggtataattctgggatagatctgttactggcatagtcatgacaacctctggtaatcttaccttctcctttttatgaagggaagagcaatggtttggacttacatcttaattaaggctattttaagcagattgttttgcaacagattaagaattgggtcccaaagtgggttatttcaaggcatttttgaagactggaggagcgtaggagggagtggtgagggaacctagaacttcttgctccttgtgactatgacagatgtctgatgcccccagcgcactggagtctggggcttggtgcaggtggtgccccatcagtgtggacagacactacttgcctttgtggtttagtgttggaagctttaattattctacagttccatagattcacaattttatagccaaacagtttgtatccacctgctttcagaggaggaaccaaaggccaaattactttgaggtagggcttagctggacctgggttttcctatgctcttttcatgctgtgttggagggtgtgtccactgccagatctgtgtaacccgtctgggtcaggggatgagtgacagcaaaccatcttaaaatttttcatgagtacatttaagcggaagcatacgggaatatgagtgcaaaagtgtggctgagccgcgtatgcccttgattggttttgggaagcctgagggaggcagccttcctggctatgagccatcgcctgcccaatcaggctaagggtggtgactggggtggtgaaggggcagctctgctgagcatggtctgccttatggcctgaattgtcctcaaggggtgtggactgcagatggtgttcacatgaaccggagacatcactctttaggattctactggcagcccctgaattggctcaacgtttgtggaggtggtatttccctgaagtactgagctttgttttataataattaaaatccttatttggtccaatttaatatagtttagaagctattttttttgaggcaaaccgtttttgaaaatgtaaattttgtttttaattaaaaataaagtcttagttaagaaaactcaggatgcacaaaactattcagactgttactttagctttctcccattacctcatcagtaatattcaccacattttgctaaatatttattgattagagtgttgaaatcaaattctgctctaaatgtgtgtgaatatgttggagaggctttgtgttcttcactgtgaaatgcaattgtgccttgaataagaaggtacctagaagccaaattaaagtaataatgacttcttaaaaaaaaaaaaaaaaaaaaaaaaaa

SEQ ID NO: 32409 - DNA, 4909 bp, Homo sapiens
cggaacccggcgcggcggcggcacgatggtcatggcgtatctcgtcgagaatttttggggggaaaaaaatagtggctttgatgtcctctaccataatatgaaacatggacagatatcaacaaaagaactagcagattttgtaagggaacgagctaccatagaggaggcatactccaggtcaatgacaaaactagcaaaatctgcaagcaattattcacaacttggaacatttgcaccagtatgggatgtattcaaaacatctacagagaaattagcaaattgtcacttggatcttgttagaaaattacaagaattaataaaggaagttcagaagtatggagaagaacaagtaaagtctcataaaaagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggcagctgttaaatctaagaaagctacagatacctataaactctatgtggaaaaatatgcattagcaaaagctgatttcgaacagaaaatgacagaaacagctcagaaatttcaagatattgaagaaactcatctcattcacataaaggaaattataggatccttgtcaaatgctataaaggaaattcatttgcagataggccaggtccatgaagaatttataaataacatggctaatactacagttgaaagtttgatacaaaaatttgctgagtcaaaaggcactgggaaggaaagacctggcctcattgaatttgaagaatgtgacactgctagtgcagttgaaggtataaaaccaaggaaaagaaagacctttgctttgccaggaatcattaaaaaggaaaaagatgcagaatctgtggaatgtcctgatgcagattcattgaacattcctgatgtagatgaagaaggctacagtattaaaccagaaacgaatcagaatgataccaaagagaaccatttctactcatctagtgattctgactccgaagatgaagaaccaaagaagtatcggatagaaattaagcctatgcatccaaataactcacatcacacaatggcttctttggatgaattaaaagtatctatagggaatataacactctccccagcaatatctagacacagtccagtacagatgaatcggaatttgtctaatgaggagttaacaaaatcaaagccatctgctccacccaatgaaaaaggaaccagtgatttacttgcttgggaccccctatttggaccatctcttgattcatcttcttcatcttcactaacttcatcatcatcagccaggcccacaactcctctttctgtaggcaccattgtccaacctccgaggcctgcttccagaccaaagcttacttcaggcaaactcagtgggattaatgaaatacccaggccattcagcccacctgtaacttccaacaccagcccacctcctgctgcaccattagcccgggcagaaagttcttcttctatctcatcatctgcttcattgagtgctgccaatactccaacagtaggtgtgtcacggggtcccagccctgtcagccttggaaatcaggataccttacctgtggcagttgcccttacagaatctgttaatgcctactttaaaggagcagatcccaccaagtgtattgtgaagatcactggtgatatgacaatgtcatttccaagtggaattattaaagtcttcaccagcaatccaactccagctgtgttgtgcttcagggtgaaaaatatcagcagactagagcagattcttccaaatgcacagcttgtgttcagtgatccatcacaatgtgattccaacacaaaagatttttggatgaacatgcaagctgttacagtctacctcaagaagctgtcagagcaaaatccagctgcttcttattataatgtagatgtattaaagtatcaggtatcatcaaatggtattcagtccactcctctgaatcttgcaacatactggaaatgtagtgctagcaccacagatcttagagtggattataaatacaatccagaagctatggtggcacctagtgtgctttccaacatacaggtggtggtaccagtggatggaggagtaacgaacatgcagtcccttccccctgcaatatggaatgcagaacaaatgaaagccttttggaaattgtctagtatttcagaaaaatcagaaaatggaggttctgggtccctccgagcaaaatttgatctttcagaaggacctagtaaacccacgacacttgcagtacaattcctcagcgagggaagtaccctttcaggagtagatttcgaacttgtgggcactggctataggctttccttaataaagaagcggtttgctactggacgatacctggcggattgttgatggacctgggaaagtgatgtggcttcagggattacaaacctgccattctgcattatctgttctttccaaacactattttaacttgtatgatgtctttcaaacttagacatatttgagagctgactacaaacattaaatcgcacttttaaagtgagtcattgaaataaatagtactgaaatgattctctatgttgtaaatgatcaactacaatattcaggaagcacatttattcagattctcagtaaaaatgaagtttttgtaggattaatttttaaattatttccagtgtctatgttgaaaaaaagggttatagtgtaatatcaggcctaaagtttcagaagagcaagcacaaagtaatttagctttccatacatttttagagtcagagataactttgaaatttcataagtttgatattcagtggatacaaatagaacatgaattctaagttttgggtaatgttaactcagaacacttaatcaaattgagctatgtgccataaggtaatcagaccagagtccaagttgtatgcaaaaaatctataatttgattctcataaacatattaataaagtataagtgatgttttatatgatttttaaaaaaaattctcaagtgcaatgtgttttaaaataagcttgcaaatgacagcagagacatttacttctgcagttagttaactttataggagttgtgatttttttgatgaattaatgctgtagatttaatttatttttatatggaattgcataatgtgtgccttttaaaacaataacaaaaaccagagatgtgcctatacaatttgtgttcattaatgtgcctcactttttttctcagtctgaatcttctgttcagaatcttacagtgatcaagcatttttataagatatttgcaatttttgtaaatatttttggcctgcaactgggaaggggatttagagtcataaagcctaacttaagaatcctggctcacttctttggtgatacactgtagccactagaaagagaaataaacccaatggcatgtgtttacaggaagaaagattaccttcagatacttgacattaacctcatcaaaagtgtgtgaattttaaaacaaattctaaaaaaactatagtgctaaattggtaactggtattttaactctcaatttagcattttccttgatactttatcattgaaaatttatgcatttatttactgattgtgttgtgaacatgagttttacggtattttgtgagggatgcattttttaaaagattaattttggaaacagaaggagaagcactgccatttgtttttatttcaacaattggaaaaattaccaatttgtacattttaattattcaatttctactttgtaaaaatagggaaattatttgaagtgatatatttggttaaacatttctaaaaataaactaccaatactaaatagtaagaaacctaactttagtagcaaatcttgattaattgaagaaataaaatatttcggataaggtttcataatttacaaatgggaatttcatttataataataaatatgagtgtcctttatttgcctagtagaagtgataaattgtgttatatatgataatttatataaaaccactaattgttccgttaagcttcacagaaaataaaacctctattactagacatttatgtaacatcttgctgtactaaatacagcagaaaatctactctttagcaatatataacacagtatatgcttttttatatattcaatgttagcccaagtctgaatttacatttgactaaagcagcacataagataatttgctaaaatgctaatctttactaaatagtgagctaaattagaatttctaactcttatattgtgctcttttaaatgccaattacagtcccttactggaattctaactgtaatttgctttgcaatcaaactgcttttagggcagccaatattttattattggaattcagacactgttcttaccgtgtttgtttttaatcaagtattacctaaaaatgtacaaattagtgaaatggttaaacttctgcactttcttagttaccacagtcttcataccaagtattgggtacaggttacaattttgaagccatatgagtttatattgattttttttttccatttaaaaatccactaatggtgtaaaagagaccagtagattttcaatgggaaatgtacctagcaagctggttcttgcttatatatagtgataaactttgtagctgcctctttaaccaagaatttgtaaacacaactctaataaatgtgagttttaaaggattgttatttactactttggattgtaattagaacaatgcacatctgtcttccaagattttgtaaatatttttgatttttttcattaaatgtaaattttacataaaagttgtgctcttaataaacatgtaatatataatttaaaaaaaaaaaaaaaaaaaa

SEQ ID NO: 32410 - DNA, 3545 bp, Homo sapiens
gggagattcgattggaaggctgccggcgtgctactgagttcggccggtccgagtcactgtgcgtcgcctgggcgcgttcctggtcttctcccccagggtcttgctctgtcacccaggctggagtgccatggcatcatcatagctcactatggccttgatcctcctgccttagcctcccaagcagctggtattacagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtacattcaggatcctaataaaattccagaaacactggacaatgatacaactcagaatctattaactaaagcagttgaaacttgctttgttggacaaagctttatttttggagtgacgaattttgaaaaccaacctggacaaggttcagatgccagtaacttcttacagcaatgctctgaccacaaaagaaaagccaaagcactagtggcttgccagattgttctaccagacccaggtattgcaggctttactgtcattgactacttccatcaacttttgcagacttttaatttcaggaaacttcagtgtgactctcaggcacctaacaatcacttacttgctttagatcactcaaatagtgatctcagcagcacatatacttctgacagcacttctgattttttcaagtcctgcagcaaggatactttttcaaaattctggcagccatcacttgaattcacttgcattgtttcacaactaacagataatgatgatttttcagcttcagaacaaagtaaggcctttggtactcttcagcagaacagaaagtccatctccattgcagaggccactggttccagtagctgccatgatcccattcaggattcatggagccttgtttcatatatggataaaaagagtacagcagaaaagttgggtaaagaacttggcttacaagctaaggagctgagtgcagttcacagcagtcatcatgaaattggagttaatgactctaatttattctctttggaaatgcgagagccccttgagtcaagtaatacaaaatccttccacagtgcagtggaaattaaaaataggtcccagcatgagctaccatgttttcagcatcatggtatagataccccaactagccttcagaagagatctgcatgttgtccaccttcgttactcagacttgaagagacagccagcagttcccaggatggtgaccctcaaatttgggatgatctgccattctctgaaagcctgaacaagtttctggcagttcttgaaagtgagattgctgtaacccaggcagatgtcagtagtaggaaacatcatgtagataatgacattgataaatttcatgcagaccacagcagtttatctgtgactccccagagaactactggagccctgcatacaccacctatagctttaagatcatcacaagtaatagtcaaagcaaactgtagcaaagatgacttccttttcaactgtaaaggaaatctaagtcctagtgttgaaaaggagtcacaaccagataacaaagtagaggctgtctctgtaaatcataatggaagagatatgtcagaatattttttaccgaatccttacctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatcagattcagaatataattttgaaaatagtcaagactttgttccatgttcacagtcaactccaatttcagggttccaccaaacaagaattcatgggataaacagagctttcaaaaaacctgtattttattcagatcttgatggtaactatgaaaaaataaggattttccctgaaaatgacaaacagcaagccagcccaagctgtccaaaaaatataaaaacacctagccagaaaatcagaagccctattgtatctggtatttcacaaccagacgttttcaatcactacccttttgctgagtgccatgaaactgatagtgatgaatgggtccctcctaccacacaaaaaatatttccttcagatatgcttggattccaaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactgtaaaagttcaggctggatttccaaatgtccagacattcaagtcttagcagcacctcagctgcaccctattcttggacctgattcttgttcagaagtcaaatgttgccttccattttcagaaaaaggcccaccttcagtgtgtgaaactcgaagtgcttggtcacctgaattgttttcataaaaagtcacctgaacccaattcctgaacttttaaatctgtttggaaatgtttgccttcaggggtacggaaagcattctttacattttgaacacttggagagaagcaaattgaaaacaggactctgctgggagctactgtgccttttaaaatataaagccattgttttccccagggttttatctagaatactatgattaggtagttgagcactttatcttatactgtttattgtactttaataatattgttaagattgtttttgaaagtattaatgtttgttaaaatcacatatacatccagaaataaagactttgcaaaccaaaaaaaaaaaaaaaa

SEQ ID NO: 32411 - DNA, 2866 bp, Homo sapiens
ggaaaataagccaggagaggaaggagcggcgggcaggtggccccgggagcccagacggacggctgctgtcgatatggcgacagctgccctgtggccgcccctgcacccagatggcgcctggcctggccgcagcatcctggagtctgaggccagcacctgcgtctccctgaagcccctcagagcctgccctgcagtgctgctgccctcgtctaccagtggctcaagcctgtcatcccagcactgtgggaggccgaggcgggtggatcacctgaggacaggagttcaagaccagcctgggcaacatggctatatggaaagcacaggtgtttctgcttctggagaggccccaggaagcttccaaccgtggtggaaggcgaagcgggagcaggtgtctcacatggcgtgagcgggaacgagaaagacagagcagggaaacgtgcagaggaaatggttggagagcgaagtccaggcacaggggccatgagagccggaccccacgcagctgcagaccccgacccgaactgcatgcggctgaggacccccaagccaggcagaccccgacccagaccccacgcggccgcggacccccgacctcgacccaaactgcatgcggctgaggacccccaagccaggcagacgccaatccagaccccacgcggccgcggaccccaacccagacagaccccgacccacccgtgcagcccccagccccaaaagtcaaaccccagcgtccccccagggcggcccgggctccctcagatacagcagcttcctgaggtggcctcacccgcaactccagaccaatcagagaaggccaaatgggctccccaagcccagcaggtgggacccccgatctagagagccccttccccgccccaggccaacagccaccctcgggctccgcatcaggtctgccaaatgcaggggcgaggggccgaccccgccacgggaaccaaactcaggaaacagcccatccagcgtccatctccatccggacccgccgccgcggccgcaggttcacgcgccgttccgcggagatctctcaggcgcctctggcccggcagaaacccgcggttccgatgacagaggtcctggtgggaatcgcaccgcctgccgttcctgcctccgcggaggatgcgctgccctaaactgcccccggctcttcatcccccaacccccggcagcctccgaccctcccccggccggcgcagctcagcctttcgcagacgcgggggagctggaatccgaccacgcgcagccttctcaccgtggtgcacgcttcgggccccccacgcctttcccaggcttcatcacccatttctctccagcgctgaaggaaacctcccagatgcttctccactcacccaccgaagcaggtctcggttgcccccagccccgggccctcccgagaacactgcaagcccccactggtcccctcccggcaaccccacggcccatccccaaacctgcactcaccctgtggggcctccaccctttggaggaaggacgtgtcaaagcttggaggtgcgcggcctgtctaacctccgcccaaggcgcgcggcaggcgacaggtctcagcccggatcagcgtggtccaaaaggacttatcgttaaaagtgctggtcccagaacccaaggggaagacatgctggttctctgatgagctgggccgcctcctccaggaagcctcctccttggagctctgtagccatcgtgggcttgcaagagtcaaagggcctggcccacagcggcgcccggcactgagctggacagtgtcctgcccccaaaattcatgtccgcccagaacctcagaatgcaaccttccctggtagtagggctttgcagatgtaattaaggatctggggacgaggtcaccctggattgaggctgagtcccaagtcagtcactggtgttcctccatgaagagcagagcagaatagagacagatgcacagagcaggccctgtgaggacagaggcagggactggagcgtcggccgcagcaggggcgtggagcccccagagctggaagagggagggatcctccccagggcctccggaaggagtgtgctgcgtgctgcccacaccgtgattttggactcgtggcatccagaactgggagagaataaatttctgatgttgtaagcctgcactacagcagccccaggacgctgaaatagttcagccggtgcaggctcctccctccctccctctctcttgttgtgagatattttttagacggggtctcacctgtcgctggagtgcagtggtgtgatcatagctcactggagcctctaatgcctgggctcaagcgatcctcccacctcagcctcccgagtagctgggactacaggtgccatcagacctggctaatttttaaaaatctttttagagatgggggaggtctccctatgtggcccaggctggccttgaactcttgggctcaagtgatcctcttgccttggcctcccaaagtgttaggatggcaggcttgagccaccatgcctggcagctccatctgtgttgactcctgaagcccctcatcttggctaatccggacaggcttgctggggaccccatctccccttggagactttgggatgtggctggatgtccaagtggccggggtcctccacagcccccagcttcccagggcgggaggcaggctgtgtcctcggtgggcactgacagtgaggctgaaatgtttgcacttcacatttccacatttaggggcattttgttgttgactcattcaaagctcttttaagtcgcttaatttgctgctcagagggaaatgaaaagggagccattttccctgatttgtttgcctcatcaacttttcaatcaataaaaaagtgcattttgctc

SEQ ID NO: 32412 - DNA, 2130 bp, Homo sapiens
aggacagggcagcggcggtgacccgagctgccgcccgacatgaactcgctggagcaggcggaagccccgcgagttgtatccctgattcctgcggtggtttccggtaactgccaagatctcaaggcttttgagaggagacttactgaatatattcattgtttgcaacctgctactggacgctggagaatgcttcttatagtggtatctgtctgtacagctactggtgcctggaactggttaatagaccctgagacacaaaaggtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgacaagaagtgtgcaatatttacctggattatcttgatgatggtgactcattatcagtgctttggtacttttgattacctgtgtttcagtattagtgtcactttagtacttcagatcctgcaaatatttttgcagatgaagtatgtatgtatgttactaagttaaacttagaaacagaacctcattcagtttttataatgtatttttgcaaactactgtaaatagcaaatcaatgccaatgttaaacaaagaggaaaacgttgtgtggactttgttctcttgcaccggtatttcaggaacatctgcttgccatccccacagctctttaaaactggctattatgtgtgcctttcattcttacatttctaatcatactgcaggaaaaacattggattcagcttagactgaggaaaactctccattatgttgtaagaaattatagatgttttgagagacactttttgttaaaccagatattgaactccagcaactattgtggttatatttttagttcattgttctcatttaatgctaaatatcctttatattgctttaataattttcttttttttttttttttttttagacggagtctcgctctgttgccaggctggagggcagtggcacgatcttggctttctgcaacctctgcctcccaggttcaagcgattctcctgcttcagccttccgagtagctgggactacaggcgcatgccaccatgcccagctaatttttttgtatttttagtagagacggggtttcaccacgttggccaggatggtttcgatctcctgacctcgtgatcctcctgcctcatcctcccaaaatgctgggattacaggcataagccaccgtgcctggcctctttaataatttttaaaataccctaaaggcttgtgaatatacaagtctactgataaattatgtattgtctgggaatttgatagtcattgttttagataactggattttacgctgtggtagacaggctgtgacactagtgttgcacaggtgtaattggtcatcctatgccttcaccagaataacttgggagtggtgccagaaactagagtctacaattctcactgtttagagagtgttaatgacatactgtgtatgcataatagccgcatgtactataatagcccttaaaattaaactattgggattgctgtaaatattttaaagtactggaggtgccttttacctgtttattagattttgaaaaggtttaaattatttcatgagcaatcttttaaatttcatttaacataaagctgaaaattcaataacaggataaaaaagctttttaacaaggctgccatttaacttaaatgtgttcatcttagctttcacttgtataaaatttgattctttgaactgcagcaataaaaccctcagctcctaagaagtcttaagagggtattctatatattctgctttgttttattttctgtaaattttgtaggtaaatatgtgcattaaaaataaatactttatatataactcgtgaaaaaaaaaaaaaaaaaaaaaaaaaaaaaaaaa

SEQ ID NO: 32413 - DNA, 1038 bp, Homo sapiens
atgagtcacctcttcgatccccggctgcctgccctggccgcctcgcccatgctgtatctgtacggtcccgagagacccggcctccctctggccttcgcccccgcggctgctctagctgcctcgggccgggccgagaccccgcagaagcctccctacagctacatcgcgctcatcgccatggcgatccaggacgcgcccgagcagagggtcacgctcaacggcatctaccagttcatcatggaccgcttccccttctaccacgacaaccggcagggctggcagaacagcatccgccacaacctctcgctcaacgactgcttcgtcaaggtgccccgcgagaaagggcggccgggcaagggcagctactggacgctggacccccgctgcctggacatgtttgagaacggcaactaccggcgccggaagaggaagcccaagccgggccccggggccccggaggccaagaggccccgcgccgagacgcaccagcgcagcgcggaggcgcagccggaggcggggagcggggcagggggctcgggccccgcaatctcccgcctgcaggcagcgcccgcgggcccctcgcccctcctggacggcccctctccgccggcgcccctccactggccggggaccgcgtccccgaacgaggacgctggtgacgctgcccagggcgcagcggccgtggcggtcggccaggcagcgcgcacaggggacggcccggggtcccctctgcgccccgcctcccgcagctctccgaagagctccgacaagtccaagagcttcagcatagacagcatcctggcgggaaagcagggccagaagccgccttcaggggacgaactcctagggggtgccaagcctgggcccggcggccgtctgggtgcctcgctcctggccgcctcctccagcctccgtccgcctttcaacgcttccctgatgctcgacccgcatgtccagggcggcttttaccagctcgggatccccttcctctcttatttccccctgcaggttcccgacacggtactccacttccagtaa

SEQ ID NO: 32414 - DNA, 1386 bp, Homo sapiens
gctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactgaatctgcccgtaaaacctgagccattgattcttcagaactttctgcagtttttgacttcatagattatgctttaaaaaattttttttaacttattgcataacagcagatgccaaaaacaaaaaaagcatctcactgcaagtcacataaaaatgcaacgctgtaatatggctgtatcagagggctttgaaaacatacactgagctgcttctgcgctgttgttgtccgtatttaaacaacagctcccctgtattcccccatctagccatttcggaagacaccgaggaagaggaggaagatgaagaccaggactacagctttcctatatcttctattctagagtggtaaactctctataagtgttcagtgttcacatagcctttgtgcaaaaaaaaaaaaaaaaaaaaa

SEQ ID NO: 32415 - DNA, 1122 bp, Homo sapiens
gctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttcacatagcctttgtgcaaaaaaaaaaaaaaaaaaaaa

SEQ ID NO: 32416 - DNA, 4580 bp, Homo sapiens
gggaggtgggactgactgagtcttccgtgtgtcgccgccgttgccgcctcagcttcagcctcgttactcctgcggttctgtgactgtgctgctggcgttaacggcgcgaggtgaagggaggtgacggagtgtgcccgcgcgcgcgggggtcccctcagtcccagcagttcccttcgtgcgcggggggcggcgagggtcttcagcagtcgggagaggcccttgacggcgccatgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggaggcacagttggtggatctgaaatctgaactgacagaaacccaagcagagaaagttgttttggagaaagaagtacatgatcagcttttacagctgcactctattcagctgcagcttcatgctaaaactggtcaaagtgctgactctggtaccattaaggcaaaattggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaagttctcctccttaaggaagatcatgaaggccttggcatttcaattacaggtgggaaagaacatggtgttccaatcctcatctctgagatccatccggggcaacctgctgatagatgcggagggctgcacgttggggatgctattttggcagtcaacggagttaacctaagggacacaaagcataaagaagctgtaactattctttctcagcagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaaggatttaataagaaggcagtaactgacacacatgaaaatggagacctgggcactgcaagtgaaactccgctagatgacggtgcttcaaaattagatgatctgcacactctgtatcataaaaaatcttattaaattgaccatatctccagacaagattgttaatcagactattctgaatttggggcactggggaagatggtgacaaagactacaaaatcaggggaggctgtttgttgcctaaatgaaaggcgggtacctcagggcttcatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacattaaaatgatattgatctcatttttttaaataaacattttgtttccttgacgttaaa

SEQ ID NO: 32417 - DNA, 4604 bp, Homo sapiens
gggaggtgggactgactgagtcttccgtgtgtcgccgccgttgccgcctcagcttcagcctcgttactcctgcggttctgtgactgtgctgctggcgttaacggcgcgaggtgaagggaggtgacggagtgtgcccgcgcgcgcgggggtcccctcagtcccagcagttcccttcgtgcgcggggggcggcgagggtcttcagcagtcgggagaggcccttgacggcgccatgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggaggcacagttggtggatctgaaatctgaactgacagaaacccaagcagagaaagttgttttggagaaagaagtacatgatcagcttttacagctgcactctattcagctgcagcttcatgctaaaactggtcaaagtgctgactctggtaccattaaggcaaaattgtctggcccctctgtggaggagctggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaagttctcctccttaaggaagatcatgaaggccttggcatttcaattacaggtgggaaagaacatggtgttccaatcctcatctctgagatccatccggggcaacctgctgatagatgcggagggctgcacgttggggatgctattttggcagtcaacggagttaacctaagggacacaaagcataaagaagctgtaactattctttctcagcagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaaggatttaataagaaggcagtaactgacacacatgaaaatggagacctgggcactgcaagtgaaactccgctagatgacggtgcttcaaaattagatgatctgcacactctgtatcataaaaaatcttattaaattgaccatatctccagacaagattgttaatcagactattctgaatttggggcactggggaagatggtgacaaagactacaaaatcaggggaggctgtttgttgcctaaatgaaaggcgggtacctcagggcttcatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacattaaaatgatattgatctcatttttttaaataaacattttgtttccttgacgttaaa

SEQ ID NO: 32418 - DNA, 3095 bp, Homo sapiens
attgctgatggatcagtgagcctgtgttcatgccagtgagctgctgtggctcagatactgatactttctttccaaacagcataagaagtgattgagccacaagtatactgaaggaagggctccctcgagttctggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcgaaatggaagcatcgttgctgggtatgaagttgttggctccagcagtgcatctgaactgctgtcagccattgaacatgttgccgagaaggctaagacagcccttcacaagctgtttccattagaagacggctctttcagagtgttcggaaaagcccagtgtaatgacattgtctttggatttgggtccaaggatgatgaatataccctgccctgcagcagtggctacaggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattaccattgctgtcacgcaacctagcaatacctacaaaaggaaagatgtgtgttggcttaactggtccaatggaagcaaaccactcctggcttttgttgtccctgcactggctattgtggctgtgaacttcgttgtggtgctgctagttctcacaaagctctggaggccgactgttggggaaagactgagtcgggatgacaaggccaccatcatccgcgtggggaagagcctcctcattctgacccctctgctagggctcacctggggctttggaataggaacaatagtggacagccagaatctggcttggcatgttatttttgctttactcaatgcattccagggattttttatcttatgctttggaatactcttggacagtaagctgcgacaacttctgttcaacaagttgtctgccttaagttcttggaagcaaacagaaaagcaaaactcatcagatttatctgccaaacccaaattctcaaagcctttcaacccactgcaaaacaaaggccattatgcattttctcatactggagattcctccgacaacatcatgctaactcagtttgtctcaaatgaataaggcaaggaatcataaaatcaagaaaaaatttccagaacaacttgacatttagagacaaatgtcaatgaagaaattatgctcagtattcgatcgggttttctgatttaggggtctgggaataaaacaagaatgtctcagtggcttcaaaaaaaaaaaaaaaaaa

SEQ ID NO: 32419 - DNA, 2715 bp, Homo sapiens
gtcgggtgggggcggcggccgcggaaggccaggccggtgccctgcggggacgcccagcgcagcccagccccgcgcagcccagccctgccctgccctgccctgccctgccctgccctgcgcccggggcgcgcccaccgcgccgcatccatgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcagacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgaccctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtgatctgtgtgagccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagatgaagttctcgctggagaagctgcaccaaggcatcacagtctcagaccctccctttgacacccagccccggcccgatgacagcttttcctgaggaccccggccacgcagctgttcccccacatggacagatggacacacagagcctcggcggccactgctggcacggtgtgagcgccaggcatctcccacccgcccctcccgacggcccaaccaggggctgtgcagacgtggggaccacggaaccgagatgcactttagaccagggagctggcccggcctctggcaggccccccactaacttattttgcccggctgaggttgtggggggcgcctcctggggtgcacgattccctcagctctgggtttaatgtattatatttatttggggccgacagtgccccaataaagggtcagaagtgaaaaaaaaaaaaaaaaaaaaaaaaaaaaaaaaaaaaaaaaaaaaaaaaaaaaaaaaaaaaaaaaa

SEQ ID NO: 32420 - DNA, 2681 bp, Homo sapiens
aaaggtatctgttaagctaggtaggaactgcagtcggctggttgcttctcatctggagaaagcaggcaactgggcagtgattgaagtgtccagcagggggctggcattctctgtctataagtaacactggttcctcttcagagcctcagctcagcggagctgccgtttgctggtgaagcccgtgacgtgcaaagcatcctgcctataggatttgaggatttctcagtgcagtttttttctacccactttaaacctccagattctaaatatcaggaaagacgctgtgggaaaatagcaggccaaaagttcttagtaaactgcagccagggagactcagactagaatggaggtagaaagaactgatgcagagtgggtttaattctaagcctttttgtggctaagttttgttgttgttaacttattgaatttagagttgtattgcactggtcatgtgaaagccagagcagcaccagtgtcaaaatagtgacagagagttttgaataccatagttagtatatatgtactcagagtatttttattaaagaaggcaaagagcccggcatagatcttatcttcatcttcactcggttgcaaaatcaatagttaagaaatagcatctaagggaacttttaggtgggaaaaaaaatctagagatggctctaaatgactgtttccttctgaacttggaggtggaccatttcatgcactgcaacatctccagtcacagtgcggatctccccgtgaacgatgactggtcccacccggggatcctctatgtcatccctgcagtttatggggttatcattctgataggcctcattggcaacatcactttgatcaagatcttctgtacagtcaagtccatgcgaaacgttccaaacctgttcatttccagtctggctttgggagacctgctcctcctaataacgtgtgctccagtggatgccagcaggtacctggctgacagatggctatttggcaggattggctgcaaactgatcccctttatacagcttacctctgttggggtgtctgtcttcacactcacggcgctctcggcagacagatacaaagccattgtccggccaatggatatccaggcctctcatgccctgatgaagatctgcctcaaagccgcctttatctggatcatctccatgctgctggccattccagaggccgtgttttctgacctccatcccttccatgaggaaagcaccaaccagaccttcattagctgtgccccatacccacactctaatgagcttcaccccaaaatccattctatggcttcctttctggtcttctacgtcattccactgtcgatcatctctgtttactactacttcattgctaaaaatctgatccagagtgcttacaatcttcccgtggaagggaatatacatgtcaagaagcagattgaatcccggaagcgacttgccaagacagtgctggtgtttgtgggcctgttcgccttctgctggctccccaatcatgtcatctacctgtaccgctcctaccactactctgaggtggacacctccatgctccactttgtcaccagcatctgtgcccgcctcctggccttcaccaactcctgcgtgaacccctttgccctctacctgctgagcaagagtttcaggaaacagttcaacactcagctgctctgttgccagcctggcctgatcatccggtctcacagcactggaaggagtacaacctgcatgacctccctcaagagtaccaacccctccgtggccacctttagcctcatcaatggaaacatctgtcacgagcggtatgtctagattgacccttgattttgccccctgagggacggttttgctttatggctagacaggaacccttgcatccattgttgtgtctgtgccctccaaagagccttcagaatgctcctgagtggtgtaggtgggggtggggaggcccaaatgatggatcaccattatattttgaaagaagccatcaagtcttaagtttttcatttcaacttgtgaacgtttcttctgatgtgaagcaaaccttcccttttcagaaaagggaacaagtagaaaattattttttaagcctcaagccctgttaaatggtcgtggccaattatgtcatagaaactgtatgaacaaccagatttacatagcagagaaatcatacattgaatgcttactttgtgaaagacttcaccttgtcatttctttaagcagacgctagtactttagaaatataacttgactctgttttcaggaatatctgtaatacacaaaccaaggaacaacttttatttacactcctaatatgaaaagtcaatcctgtgagagagctccatgtatgagggacactctccaagttgataacaatggaagcgagtttaatataaaacaattccctaagcatttattttttttttaaaaagatgttactgaggacctagaagaaatgctcaatacatactttgaaagcaaaaatacaatcaaacacattgacacgtatataaagatccacgcgtggctgtgcgtgatatctcacactctgaattcttacttgatggaggttttgtttgctgctacggttttaatcatccagggtgccattccaccatagaagagcaatccttttaggaaaaaaaaaatcatgctattaattaatcaaatatctataaatgcata

SEQ ID NO: 32421 - DNA, 4220 bp, Homo sapiens
gagtgcgttcgcggctgctttgacctggtgggcgccgcctccggcactgcaccgaggcggggcgccagcgcccaggttgctgggctggccttggcgcccccttcccctacccagagcgcaggcaggcaggggggtcccgccgcgccccttcagcatatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggagggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtgacatggcccccaagcagagcgggtaaagtgcaatgggtaagggagggaaggggaatggaagagaaaagacagggtgggagggaggagggagtgctgtgttttagtctcttaatggtccaaaggacaaatctaaaatgcaaagaacggtgatgtagtatggcctgacagctctgtttagaggaggcaacactgatcccccagatgcagggctgcaggggattctgtgttttcagactgcctgtctgcttgcatctgcacataggcagtagcctcctcctgggctccagagggcactcagaagttgtgctaaaccaagttaagtcccattcagtggcaacttgtgataggtacctgagtgacggcaacctgcggaaggaggttctcccagcccatctgaacacaaccagaggtggcaggagaatttctactgagcgagctgggccggttagtgtatgtcacccccaccccacccctaagtagtcatcaatgcaataagattgcgcctgagatacaaggcccagaagcctgatctttgggcatcagaaaacagggtccaggaatggtgctttatgtgagataccccactccacatcaacattccagggatgagccaaaccagcagggagttagcactgaactgcttttaaaagtgcacattaaaaaggaaagtttgccaggaggaacaaagagattgtggtggtgctaaaggaggccataagctacacagaggccttgggtgttccacctggaaactgctcagacgtctagatgggttcttagcttgtctgtgatctctgctggggagataaaaagattaagccccaacatgttcagaaaagaagtgaagtcttgggtattttaacctgtatactcttgaattcctctcaaattcagctctgatctgaggctaagacacactccccacttcactttcttcaaagccacattttttgaggtatcactgcagtcacctcttctaccctcatcatcataggtaaggttttcaaggtggcaattggggcggagccccggctcttatagaagcttcagcaggaggcaagcgtgttctcagcacatatgggaactatgaggagcctctgatcaaattggctacaatcttggagctgcttggacggattccttggcagccgggttagcatgtgtgactttcaggctactgttcttgacaatcatctccaatggaaagcttttcagtgttcccaaagtgaactctcaaatccaaaatggttatctttgagaccatccattctcctcagtggcttctccagggaattcttacagccaagttgtgacagtcactgcatttgcctgcttctttccagaaaccaaactaggagatgaaactggttcctacatcctaaggttcttgctttctctctcatgcctcctgaggctgtttttggctgttttccctctgctgcttttggggaatgaggggaagccattttccagtgacttgcaatccaggctgttctcagcgttttgagtttaaaacctgggatcctgactaagcctttgacttaagggttgcttgcttgccctccaaatgtcctttctcagaggggccagctaacccgtgcagaaccagcactaaggtggacagcagacaagagggcaagcctctagtgtaccaagtgcttcctacaaagacgcaaggtgtgctctgagccacagatgggcaaaccctggtgctttccttcatctcccacgaactcaagggttttccaggtgtagctaacagttgccacatcacacagacctcgagtttctggtaagactgctggttgacatcagacccaacccatgaaggctggaaggcagcaggcatttgctaaggcagctgatccaggcaatcgttctgctggccaagaagttaaactattttgagcattagaatggaggaaatccggtcagccaagtgcagagttcagacttcgctaagggcttgtttttcttcagcatttacttgaagattaatgtaggatgacaggctctcctggctgtcctaccatcagctctgccttgcactgtggtcgtcaactttcctcaaatcaaaaacaggcaggtacaggtagtgggctcacaacgtttgacctcgactggtttttctaagttattttgtacatttttcagcagcaaaaccaaactgggtcttcagctttatccccgtttcttgcaagggaagagcctttatacaattggacgcattttggtttttcctcattgagaattcaaatcctcttttgtattgtttctacaataatttgtaaacatatttatttttacctgcttttttttttttttttaattttcaggtcaagttttttatactgcacttatttgtcaaaataaagattctcacatatgccggttatctcgaaa

SEQ ID NO: 32422 - DNA, 3547 bp, Homo sapiens
gagagacgagggcagcggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaacacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaagatgacaaagaaaaacagagagagagaatattggagatgtcctgaattttaatagggtacgcgccattagggctttttgcgctaaaggatgaacatgtactggtttatgtggacaagccattataccaccagactgcaatgccagtttcctctactgcaaacagtgttctgtgacaaaaaaaaaaaaaaaaaaaagaaaaaaaaagaaaaaacagaaatatatccagctaacaagaaaaaa

SEQ ID NO: 32423 - DNA, 3676 bp, Homo sapiens
gagagacgagggcagcggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaaccaacaagccaatctgatcccagggttgaacctcagcgcacttggcatcttttcaacaggactgtccgtgctatctccaccagcagggccccgcggagctccccccgctgccccctaccaccccttcactacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaagatgacaaagaaaaacagagagagagaatattggagatgtcctgaattttaatagggtacgcgccattagggctttttgcgctaaaggatgaacatgtactggtttatgtggacaagccattataccaccagactgcaatgccagtttcctctactgcaaacagtgttctgtgacaaaaaaaaaaaaaaaaaaaagaaaaaaaaagaaaaaacagaaatatatccagctaacaagaaaaaa

SEQ ID NO: 32424 - DNA, 1376 bp, Homo sapiens
gtaagaacactctcgtgagtctaacggtcttccggatgaaggctatttgaagtcgccataacctggtcagaagtgtgcctgtcggcggggagagaggcaatatcaaggttttaaatctcggagaaatggctttcgtttgcttggctatcggatgcttatatacctttctgataagcacaacatttggctgtacttcatcttcagacaccgagataaaagttaaccctcctcaggattttgagatagtggatcccggatacttaggttatctctatttgcaatggcaacccccactgtctctggatcattttaaggaatgcacagtggaatatgaactaaaataccgaaacattggtagtgaaacatggaagaccatcattactaagaatctacattacaaagatgggtttgatcttaacaagggcattgaagcgaagatacacacgcttttaccatggcaatgcacaaatggatcagaagttcaaagttcctgggcagaaactacttattggatatcaccacaaggaattccagaaactaaagttcaggatatggattgcgtatattacaattggcaatatttactctgttcttggaaacctggcataggtgtacttcttgataccaattacaacttgttttactggtatgagggcttggatcatgcattacagtgtgttgattacatcaaggctgatggacaaaatataggatgcagatttccctatttggaggcatcagactataaagatttctatatttgtgttaatggatcatcagagaacaagcctatcagatccagttatttcacttttcagcttcaaaatatagttaaacctttgccgccagtctatcttacttttactcgggagagttcatgtgaaattaagctgaaatggagcatacctttgggacctattccagcaaggtgttttgattatgaaattgagatcagagaagatgatactaccttggtgactgctacagttgaaaatgaaacatacaccttgaaaacaacaaatgaaacccgacaattatgctttgtagtaagaagcaaagtgaatatttattgctcagatgacggaatttggagtgagtggagtgataaacaatgctgggaaggtgaagacctatcgaagaaaactttgctacgtttctggctaccatttggtttcatcttaatattagttatatttgtaaccggtctgcttttgcgtaagccaaacacctacccaaaaatgattccagaatttttctgtgatacatgaagactttccatatcaagagacatggtattgactcaacagtttccagtcatggccaaatgttcaatatgagtctcaataaactgaatttttcttgcgaatgttgaaaaa

SEQ ID NO: 32425 - DNA, 3896 bp, Homo sapiens
aagtcccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatgtgagtgattgtccccatccctgaattgccttctaagtctcctggagggaggactcctctggtgcctctggctgtcctgacaactacttcccaaccagactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacctggggaaccaaggataggggaaggagtcagcacagtgaaaggctgcctttatccctgcccacatgttccctctctcacagttttccccccacagagcccctttcagtggccccttggtcctcctaactaagctgtcacctaccatatgtgggcctttttgttttataacaggagtattttctctccaggtccaccccaacctcccctgatttatagcctgaagccttatctttcacactagtgttggtcccttcaggtttggcccatcttgtattgctcttctgttcattcttacatcacagcaatctagtcactccctggtcatccctcagtcactcatatcagagtcattctctctggccatctttggtcactcacgtgtcacagcagcccacgccaacaggatgcagacaggtgcaatggaaacagtccttgcggagccaagactcacccagggtaaaatatttcccctcatagtgacagggggctagggaagaacgggaaatgttagtaggtgtaggagtgctgatgagaggcagaggctcttctggtctggggtggagacagtaagtacgcactatccccgtatttagtttgtctttcctgtttcacagctggaggaagcctgggtattttgacacgggatcatctgtaaggccccatcctccctgtgccctctctgctgctcctccattcctaacgcttcaccccactttaccttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcgagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacat

SEQ ID NO: 32426 - DNA, 3896 bp, Homo sapiens
aagtcccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatgtgagtgattgtccccatccctgaattgccttctaagtctcctggagggaggactcctctggtgcctctggctgtcctgacaactacttcccaaccagactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacctggggaaccaaggataggggaaggagtcagcacagtgaaaggctgcctttatccctgcccacatgttccctctctcacagttttccccccacagagcccctttcagtggccccttggtcctcctaactaagctgtcacctaccatatgtgggcctttttgttttataacaggagtattttctctccaggtccaccccaacctcccctgatttatagcctgaagccttatctttcacactagtgttggtcccttcaggtttggcccatcttgtattgctcttctgttcattcttacatcacagcaatctagtcactccctggtcatccctcagtcactcatatcagagtcattctctctggccatctttggtcactcacgtgtcacagcagcccacgccaacaggatgcagacaggtgcaatggaaacagtccttgcggagccaagactcacccagggtaaaatatttcccctcatagtgacagggggctagggaagaacgggaaatgttagtaggtgtaggagtgctgatgagaggcagaggctcttctggtctggggtggagacagtaagtacgcactatccccgtatttagtttgtctttcctgtttcacagctggaggaagcctgggtattttgacacgggatcatctgtaaggccccatcctccctgtgccctctctgctgctcctccattcctaacgcttcaccccactttaccttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcaagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacat

SEQ ID NO: 32427 - DNA, 983 bp, Homo sapiens
ggatgcagcagagaggagcagctggaagccgtggctgcgctctcttccctctgctgggcgtcctgttcttccagggtgtttatatcgtcttttccttggagattcgtgcagatgcccatgtccgaggttatgttggagaaaagatcaagttgaaatgcactttcaagtcaacttcagatgtcactgacaagcttactatagactggacatatcgccctcccagcagcagccacacagtatcaatatttcattatcagtctttccagtacccaaccacagcaggcacatttcgggatcggatttcctgggttggaaatgtatacaaaggggatgcatctataagtataagcaaccctaccataaaggacaatgggacattcagctgtgctgtgaagaatcccccagatgtgcaccataatattcccatgacagagctaacagtcacagaaaggggttttggcaccatgctttcctctgtggcccttctttccatccttgtctttgtgccctcagccgtggtggttgctctgctgctggtgagaatggggaggaaggctgctgggctgaagaagaggagcaggtctggctataagaagtcatctattgaggtttccgatgacactgatcaggaggaggaagaggcgtgtatggcgaggctttgtgtccgttgcgctgagtgcctggattcagactatgaagagacatattgatgaaagtctgtatgacacaagaagagtcacctaaagacaggaaacatcccattccactggcagctaaagcctgtcagagaaagtggagctggcctggaccatagcgatggacaatcctggagatcatcagtaaagactttaggaaccacttatttattgaataaatgttcttgttgtatttataaactgttcaggaagtctcataagagactcatgacttcccctttcaatgaattatgctgtaattgaatgaagaaattcttttcctgagca

SEQ ID NO: 32428 - DNA, 1213 bp, Homo sapiens
atgagcaccccacctcctgccagagagctcctgcagccacagccgcagccgcaggccctgcactacgcgctggccaacgtgcagcaggtgcagatccaccagatcggagaagacggacaggtgcaagtagtacgtaccctctccacctcgcaccttgggaaagggggctgcggggtgggccacggcagggccctggcggcttccaccagttccgctgtgtttcgggagcacaggacacctccacatcgccaaggtgccgcagggggagcaagtccagatcacgcaggacagcgagggcaacctccagatccatcacgtggggcaggatggtcagagcccgtgttctggtactacgtgaaggaggtcctcaacaagcacgagctgcaagcgcttctactccctgcgccacatcgcctcagacgtgggctggggccgcgcctggctgcgctgtgccctcaacgaacactccctggagtgctacctgcacatgctcctggccgaccgctgcaggctcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattaactcatttgatgatgaggaagatgagcagaactctggggacatgtttaaaaagacacctggggcaggggagagctcagaggacaactccgaccgctcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtggatgaaaacgaagatgacgtgtatggaaactcatcaggacggaagcacaggggccactcagagtcgcccgagaagtaa

SEQ ID NO: 32429 - DNA, 951 bp, Homo sapiens
atgagccagcggcagctgggacaggggggtcagtcgggcccggcgctcaggcctcccgggggcgccggggctgtcccggacagatctggcccgcagggagtggcaggaagtggggacaccgagcgaggctcggccgagggcctaggctggaaggtccgcgtgccccaccccgcctcgccggccccggctgcagccccgccggagggcgagggtggccaacccgaagggggcggccgcctcccgggagggccgaccgcgtggggcccccagcagccctcaggcccgaggccgcctccctcagacagggagcgggtgctgggcagcactgccttctccagcgtccagaccctggaggaaaaataccaggagaaactgctcactcagctctgcccccaccacacccctacctgctcaactcatgcctgggtccaggatcctgggccccagcaggtgggagagtggccccctacggagtccgatcagactgctgcagaggaggtgaagaggggcgagaaggacctgttggtggcctttggaggtggcaggaaacgactgtggttctgccccagcacctatgaccccacctctggcagcatcatgagccagtttcaggtgcccctggccgtccagccggacctgccaggcctttatgacttccctcagcgccaggtgatggtagggagcttcccggggtctgggctctccatggctgggagtgagtcccaactccgagggggtggagatggtcgaaagaaacggaaacggtgtggtacttgtgagccctgccggcggctggaaaactgtggcgcttgcactagctgtaccaaccgccgcacgcaccagatctgcaaactgcgaaaatgtgaggtgctgaagaaaaaagtagggcttctcaaggaggtaagccggcccttgctgggctaccctgttccttcctcgagggcacggtga

SEQ ID NO: 32430 - DNA, 963 bp, Homo sapiens
atgagccagcggcagctgggacaggggggtcagtcgggcccggcgctcaggcctcccgggggcgccggggctgtcccggacagatctggcccgcagggagtggcaggaagtggggacaccgagcgaggctcggccgagggcctaggctggaaggtccgcgtgccccaccccgcctcgccggccccggctgcatccccgccggagggcgagggtggccaacccgaagggggcggccgcctcccgggaaggccgaccgcgcagcactgccttctccagcgtccagaccctggaggaaaaataccaggagaaactgctcactcagctctgcccccaccacacccctacctgctcaactcatgcctgggtccagggtgggtgagggtgaagaacccaccgggccaagatgatcccttttctgagggctgctgctggtgtcctcccccagatcctgggccccagcaggtgggagagtggccccctacggagtccgatcagactgctgcagaggaggtgaagaggggcgagaaggacctgttggtggcctttggaggtggcaggaaacgactgtggttctgccccagcacctatgaccccacctctggcagcatcatgagccagtttcaggtgcccctggccgtccagccggacctgccaggcctttatgacttccctcagcgccaggtgatggtagggagcttcccggggtctgggctctccatggctgggagtgagtcccaactccgagggggtggagatggtcgaaagaaacggaaacggtgtggtacttgtgagccctgccggcggctggaaaactgtggcgcttgcactagctgtaccaaccgccgcacgcaccagatctgcaaactgcgaaaatgtgaggtgctgaagaaaaaagtagggcttctcaaggaggtaagccggcccttgctgggctaccctgttccttcctcgagggcacggtga

SEQ ID NO: 32431 - DNA, 898 bp, Homo sapiens
ggggattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctgggtcctgcagctctggtgggagcctcctcagttcttttcggatgcactccacccccgcgaatccggtggaagccgtggtgcagagagccggctttgtggcctcccaggcttcgctccgaccctggaaacaggatagacgggcgggtgacccgtggccccgtacccacgagtttgggtaccctgaggcatctctccaggcctctgcctgtaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgcggaaaaaaaaaaaaaaaaaaaaaaaaaaaaaa

SEQ ID NO: 32432 - DNA, 3452 bp, Homo sapiens
atttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttgtgaatcctttggccacattttgccctgcttctctcagggttaagggttctggaagaacattaagaatgagatgcaattgaaaatagtcattttgaatcctattgattattcaaaaattcaggctgattgtcttttatcagaggtaggattctgttttatagtatagaatctactttatcccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaaaaa

SEQ ID NO: 32433 - DNA, 3117 bp, Homo sapiens
tcgtagaactagggctgcaggaattgcgccgcgtcgacaaacccccatcctgggaaaaatggggaagctgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctacttatccttccttttaatagttcctttagacctgtgaaatttcttcactacatttaatagttctcctatttcccgctcccccatatcaattttccttttgtctccggggctgagtaaataaacatgttctgtcataaaaaaa

SEQ ID NO: 32434 - DNA, 3352 bp, Homo sapiens
atttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttgtgaatcctttggccacattttgccctgcttctctcagggttaagggttctggaagaacattaagaatgagatgcaattgaaaatagtcattttgaatcctattgattattcaaaaattcaggctgattgtcttttatcagaggtaggattctgttttatagtatagaatctactttatcccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaaaaa

SEQ ID NO: 32435 - DNA, 4972 bp, Homo sapiens
ctggaagaaggaggcgggcggcccgggcctcaggcccctcccaggctctgagtctcccggctgcaggcggattggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgaaaatgtgcatcagatgtttatgtttaattggtttacagactgtctgtggactcttttcctgtcaaattacccagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagattttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttaaatttctacttaagggcaagtaatttgagaattctgaaattaagcatgatgcttagattgcagtttgttttgcatttgctctaattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctttttgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtattaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattgggaaaagaagtctgttaatagtgatttagtctccccgcctcattcccacccccaacaaagcactatcattttcatttggaatgggtatttttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaat

SEQ ID NO: 32436 - DNA, 12515 bp, Homo sapiens
ctaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggctggaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacctagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaatgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacagctgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccagtatgcactgacaagcccacgactcacgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacaccccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaacgtggacgcagaagatgtaattggcagcaggagacagccaagagcacctaaggaaaaggcccaacccctggaagacctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaagataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataacaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgttctccagggcacggtggcaggaacaactatcctcgtctgtcccaacactgagcaggcactcggtaaacacgaatgaatggataagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccagatcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgcgatctggtcccccagcctctcttgggctttcttacactaactctgtacctaccatctcctgcctcccttaggcaggcacctccaaccaccacacactccctgctgttttccctgcctggaactttcccaccagccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtgaaactaagccactaattgagtttctggctcccctcctggggttgtaagttttgttcattcatgagggccgactgtatttcctggttactgtatcccagtgaccagccacaggagatgtccaataaagtatgtgatgaaatggtcttaaaaaaaaaaaaaaaaaaaaaa

SEQ ID NO: 32437 - DNA, 2201 bp, Homo sapiens
caactacgagccacgagtttgcagatggggctgctcggcggcgcctgtggctgagggagagcagcggcggcggggagcgaccgggagcggcggcagcggcggcgcggaggcggctgaggtgcgagccggactaaatcattttgctactttaaaaaaatcacgaaagtacattatttgaagtttggagaagaaagggatttggtaacaaaggacagccatttccattttaagcagctaaacagcaggagagatttctgtaagaaggtaccagctcagattccattgttcatcattttgcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagaaattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacataaagaaatgcgttgaagcaaaaaaaaaaaaaaa

SEQ ID NO: 32438 - DNA, 3081 bp, Homo sapiens
gatgtggaagccgagacctaaagttggggggtgatctctgaggagatggatcggtacctgctgctggtgatctggggggaaggaaaattcccgtcggcggccagtagggaggcagaacatgggccagaggtgtcgtcgggtgagggtactgagaatcagccggacttcacagcagcaaatgtttatcacctcttgaaaagaagcattagtgcttcaattaatccagaagatagtactttccctgcctgttcagtgggaggtatacctggttccaagaagtggttctttgcagtgcaggcaatatatggattttatcagttttgtagttctgattggcaagagatacattttgatacagaaaaagataaaattgaagatgttcttcaaacgaatatcgaagaatgtttgggtgctgttgagtgttttgaagaagaagacagtaatagcagggaatcattatccttggctgatctctatgaagaagctgcagaaaatttgcatcagctgtcagacaagcttcctgctcctggtagagcaatggtagatataatactgttgctttctgacaaagatcctcctaaattgaaagactatttacctactgtaggagcattaaaacatttgagagaatggtattcagcaaagatcactatagcaggaaatcattgtgaaataaactgtcagaaaattgcagaatacctttctgctaatgttgtatctttagaagatctcagaaatgttattgactcaaaggaattatggagggggaaaatacagatatgggaaagaaagtttggatttgaaattagttttcctgaattttgtttaaagggagtcacacttaagaattttagtacttctaatttaaatactgacttccttgccaaaaagatcataccatcaaaggataagaatattttgccaaaggttttccattattatggccctgctttagaatttgtgcagatgataaaattatcagatctaccctcctgctatatgtcggatattgaatttgagttaggattgacaaacagtaccaaacagaattctgtgttgctgttggagcagatttcttctctgtgtagcaaggttggtgctctttttgtattgccatgtaccattagtaacatactgattccacctcccaaccaactcagttcaagaaaatggaaggaatatatagctaaaaagcctaaaacaatcagtgttccagatgttgaagtgaaaggagagtgttctagctattatctcttgttacaaggtaatggcaatagaagatgtaaagccacattgattcactcagccaaccagatcaatggctcatttgcactcaatttaattcatggaaagatgaaaacaaagacagaagaagccaaattgagttttccttttgacttattatcacttccacatttttctggggagcagattgtacagagagagaaacagttagctaatgttcaagttttagctttggaagaatgcctaaaaagacgaaagttggcaaagcagcctgaaacagtttctgttgctgaactcaaaagtctgttagtactcacaaggaaacactttttagattattttgatgctgtgattcctaaaatgattctaagaaagatggacaaaattaaaaccttcaatatattaaatgattttagtccagtggaacctaattcctcaagtctaatggaaaccaatcctctggaatggccagaaaggcatgttcttcaaaatttggaaacttttgaaaaaactaaacaaaaaatgagaactggttcattacctcattcatctgaacagttgctgggccacaaagagggtcctcgggactcaatcacattgttggatgctaaagaattgctgaagtactttacctcagatggattacccattggagatcttcaacctttaccgattcaaaagggggaaaagacttttgttttgacaccagaacttagtcctgggaaacttcaggtcttaccttttgagaaagcctcagtatgtcattatcatggaattgaatattgcttggatgaccgaaaagctttggaaagagatggaggattttctgaacttcagtctcgtcttattcgttatgaaactcaaactacctgcaccagagaaagttttccagtacctactgtgttgagccctcttccatctcctgtagtttcgtcagatcctggaagtgtccctgacggagaagttttacaaaatgaacttcgaactgaagtatcccgattgaaacggagatctaaagatctgaattgcctttatcccagaaaaagacttgtgaaatctgaaagttcagagtctcttctttctcagacaactggtaatagtaatcactatcatcatcatgtgacatccagaaagccacaaacagaacggtccttaccagtgacttgtccattggttccaattcctagctgtgaaactccaaaacttgctacaaagaccagttcaggtcaaaaaagtatgcatgaatcaaaaacatcaaggcaaattaaggaatcaagatcacagaaacacacacggatactgaaagaagtagttactgaaaccctgaagaaacacagtattaccgagactcatgaatgtttcactgcatgcagccagcgtctctttgaaatctctaagttctatctaaaggatcttaaaacttcaaggggtctatttgaagaaatgaagaaaacagcaaacaacaatgctgtacaggtgattgactgggtattagaaaagacaagcaagaaatgatacataatcattctctttaagacaattataaattggatggagctattattcactacttcttttcttagtttgaaaattataaacaaattttaagctttattcaaagaatagatgttatatttctaaagaatttcatgaatatatattctatatttgtatagtttgagggatgctatgttaatgtatttttaattagatacatattttgtaaagtgttactatattttaaagttatttttatatgttttaaaatgtttactcttatttaattattacaataaacagaatttttttttttttaaaaaaaaaaaaaaaaaaaaa

SEQ ID NO: 32439 - DNA, 360 bp, Homo sapiens
ggccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaaaaaaaaaaaaaaaaaaaa

SEQ ID NO: 32440 - DNA, 1992 bp, Homo sapiens
cgcgcgccggagcgcgctagccgcattgcgagccgaacccgggagctggcgccatggtgctgttgcacgtgctgtttgagcacgcggtcggctacgcgctgctggcgctgaaggaagtggaggagatcagtctgctgcagccgcaggtggaggagtctgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacactccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaagaaaaaaaaaaaaaaaaaaaaaaaaaaaaaaaaaaaaaaaaaaaaaaaaaaaaaaaa

SEQ ID NO: 32441 - DNA, 777 bp, Homo sapiens
acaaagggccggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaaaaaaaaaaaaaaa

SEQ ID NO: 32442 - DNA, 659 bp, Homo sapiens
acaaagggccggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacgcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaaaaaaaaaaaaaaa

SEQ ID NO: 32443 - DNA, 3859 bp, Homo sapiens
aatctatcagggaacggcggtggccggtgcggcgtgttcggtgcgctctggccgctcaggccgtgcggctgggtgagcgcacgcgaggcggcgaggcggcaagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaagcaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcagttcatgaaattatatgaagaaaaaaccgggaacgcttggcactccaaaaatttcacgaagtatcccaaaaagttttaccccctggagattgactatggccaggatgaagaggcagtgaagaagctcacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacagtgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactaccatacgtctcagggagacccaataggcttaatcctgttgggagaagttgcccttggaaacatgtatgaactgaagcacgcttcacatatcagcaggttacccaagggcaagcacagtgtcaaaggtttgggcaaaactacccctgatccttcagctaacattagtctggatggtgtagacgttcctcttgggaccgggatttcatctggtgtgatagacacctctctactatataacgagtacattgtctatgatattgctcaggtaaatctgaagtatctgctgaaactgaaattcaattttaagacctccctgtggtaattgggagaggtagccgagtcacacccggtggctgtggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaaagcttcgttagaatgtctgccttactggtttccccagggaaggaaaaatacacttccacccttttttctaagtgttcgtctttagttttgattttggaaagatgttaagcatttatttttagttaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttg

SEQ ID NO: 32444 - DNA, 4116 bp, Homo sapiens
ccagcgcctgtccggcgcctgcctgccgcctccgtggcgaaggggacacaggtccctgcggatgtgatggcccagctatggctgtcctgcttcctccttcctgccctcgtggtgtctgtggcagccaacgtggccccgaagttcctagccaacatgacgtcagtgatcctgcctgaggacctgcctgtgggtgcccaggccttctggttggtagcggaagaccaggacaatgaccctctgacctatgggatgagcggccccaatgcctacttcttcgctgtcactccgaaaactggggaagtgaagctggccagcgctctggactacgagacactctacacattcaaagtcaccatctccgtgagcgacccctacatccaggtgcagagggagatgctggtgattgtggaagatagaaacgacaacgcacccgttttccagaacaccgctttctccaccagcatcaacgagaccctgcccgtgggcagtgtggtgttctccgtgctggccgtggataaagacatggggtctgcaggcatggtcgtgtactccatagagaaggtcatccctagcactggggacagcgagcatctcttccggatcctggccaatggctccatcgtcctcaatggcagcctcagctacaacaacaagagcgctttctaccagctggagctgaaggcctgtgacttgggcggcatgtaccacaacaccttcaccatccagtgctccctgcctgtcttcctgtccatctccgtggtggaccagcctgaccttgacccccagtttgtcagggagttttactcggcctctgtggctgaggatgcagccaagggaacctcggtgctgacggtggaggctgtggatggcgacaaaggcatcaatgaccctgtgatctacagcatctcctactccacgcggcccggctggtttgacatcggggcagatggggtgatcagggtcaacggctccctggaccgtgagcagctgctggaggcggatgaggaggtgcagctgcaggtcacggccaccgagacacacctcaacatctacgggcaggaggccaaggtgagcatctgggtgacagtgagagtgatggacgtcaatgaccacaaacctgagttttacaactgcagcctcccagcctgcaccttcacccccgaagaggcccaagtgaacttcactggctacgtggacgagcatgcctccccccgcatccccatcgatgacctcaccatggtggtctacgacccggacaagggcagcaatggcaccttcctgttgtcgctggggggccccgatgcagaagccttcagcgtctccccggagcgggcagcgggctcagcctccgttcaggtgctggtgagagtatccgcgctggtggactacgagaggcagacggcgatggcggtgcaggttgtggccacagactccgtcagccagaacttctccgtcgccatggtgaccatccaccttagagacattaatgaccacaggcccacgtttccccagagcttgtacgtcctcacggtgccagagcacagcgccaccggctctgtggtcaccgacagcatccacgccacggacccagacacgggcgcgtggggccaaattacctacagcctgctcccaggaaatggggcagacctcttccaagtggatcccgtctcagggacggtgacggtgaggaacggtgagctgctggaccgggagagccaggccgtgtactacctgacgctgcaggccacagatggcgggaacctgtcctcctccaccacactgcagatccacctgctggacatcaacgacaatgcacccgtggttagcggctcctacaacatcttcgtccaggaggaggagggcaatgtctccgtgaccatccaggcccacgacaatgatgagccgggcaccaacaacagccgtctgctcttcaacctgctgcctggcccctacagccacaacttctccttggaccctgacacagggctcctcagaaacctggggcccctggacagagaggccatcgaccccgccctggagggccgcattgtgctgacagtgcttgtgtctgactgcggcgagcctgtcctcggcaccaaagtcaatgtcaccatcactgtggaggacatcaatgataacctgcccatcttcaatcagtccagctacaactttacggtgaaggaggaggatccaggagtgctagtgggcgtggtgaaggcctgggacgcggaccagacggaagccaacaaccgcatcagcttcagcctgtcggggagtggtgccaactacttcatgatccgaggcttggtgctgggggctgggtgggctgagggctacctccggctgcccccggacgtgagcctggattacgagacacagcccgtcttcaacttgacagtgagtgctgagaacccagacccccaggggggtgagaccatagtagacgtctgcgtgaatgtgaaagacgtgaacgacaatccccccaccctggatgtagcctcactccggggcatccgtgtggctgagaatggctcacagcacggccaggtggctgtggtggttgcctcggatgtggacaccagtgcccagctggagatacagcttgtgaacattctctgcaccaaggccggggtcgatgtgggcagcctatgctggggctggttctcagtggcggccaacggctctgtgtacatcaaccagagcaaagccatcgactacgaggcctgtgacctggtcacgctggttgtgcgggcctgtgacctagccacggaccccggcttccaggcctacagcaacaatggaagcctcctcattaccattgaggacgtgaatgacaatgcaccctattttctgcctgagaataagacttttgtgatcatccctgaactcgtgctgcccaaccgggaggtggcttctgtccgggccagagacgatgattcagggaacaatggcgtcatcctgttctccatcctccgagtagacttcatctctaaggacggggccaccatccctttccagggtgtcttctcgatcttcacctcctccgaggccgacgtgttcgctgggagcattcagccggtgaccagcctcgactccactctccaaggcacctaccaagtgacagtccaggccagggacagaccttccttgggtcctttcctggaagccaccaccaccctgaatctcttcaccgtggaccagagttaccgctcgcggctgcagttctccacaccgaaggaggaggtgggcgccaacagacaggcgattaatgcggctcttacccaggcaaccaggactacagtatacattgtggacattcaggacatagattctgcagctcgggcccgacctcactcctacctcgatgcctactttgtcttccccaatgggtcagccctgacccttgatgagctgagtgtgatgatccggaatgatcaggactcgctgacgcagctgctgcagctggggctggtggtgctgggctcccaggagagccaggagtcagacctgtcgaaacagctcatcagtgtcatcataggattgggagtggctttgctgctggtccttgtgatcatgaccatggccttcgtgtgtgtgcggaagagctacaaccggaagcttcaagctatgaaggctgccaaggaggccaggaagacagcagcaggggtgatgccctcagcccctgccatcccagggactaacatgtacaacactgagcgagccaaccccatgctgaacctccccaacaaagacctgggcttggagtacctctctccctccaatgacctggactctgtcagcgtcaactccctggacgacaactctgtggatgtggacaagaacagtcaggaaatcaaggagcacaggccaccacacacaccaccagagccagatccagagcccctgagcgtggtcctgttaggacggcaggcaggcgcaagtggacagctggaggggccatcctacaccaacgctggcctggacaccacggacctgtgacaggggcccccactcttctggaccccttgaagaggccctaccacaccctaactgcacctgtctccctggagatgaaaatatatgacgctgccctgcaaaaaaaaaaaaaaaaaaaaa

SEQ ID NO: 32445 - DNA, 2774 bp, Homo sapiens
tgacccactgctcttcctcttaagaaagtgctccattccttccggcgcccggagctgctggcccaaagggatccggagcgagctagggcagacaccatgaccacccttgatgataagttgctgggggagaaactgcagtactactatagcagcagtgaggatgaggacagtgaccacgaggacaaggaccgaggcagatgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaagatgactctgaaggagtttgccataatgaatgaggaccaagatgatgaagagtttctgcagcagtaccggaagcagcgaatggaagagatgcggcagcagcttcacaaggggccccaattcaagcaggtttttgagatctccagtggagaagggtttttagacatgattgataaagaacagaaaagcattgtcatcatggttcatatttatgaggatggcattccagggaccgaagccatgaatggttgcatgatctgccttgccgcagagtacccagctgtcaagttctgcaaggtgaagagctcagttattggcgccagcagtcagttcaccaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatagatttctcattgtttgggttggaatacacgtcattgtttatttttgttcctttgtcttctggcttttcagctgttctttgtagtcccttttattatgcataaaataaagaaattcttagattaaatcagaatgctgaataaccttgtagctagcaataaggtgacttacagttgtataaacaggaagccaggcttttgaactgtttacttaagattctgtggtgtgacatctctgttattgtttccagtcaatatttacaaagcatcctaaagacagggtcttggaaattgtcttcagatgatcttagaggtctctgccaagtctgagagtataattctgtaggtattgtgttatttgcaacgtaaatagtgcattttcttaatcaaatgattgtaaattatatttacttgtaatcagttccatagctttagacggtggttagattttttttttccccaccagggtcttgtttaaaggggtgagccaccgcacccagtcctgaggggtggcctctgctgctggatttcatgtcttcctccagcatgactaagtctggaacagcaggaagggttgatgcttactgacctggtgatgttagaagacaagtagtttatggatttaaacattagagctggagtggggctggaaatctttgtaaaggaagttctttcagtaagatgcccctgcttgtctttgtctcttttttgtttaacaaggtaactttttgtttaacaaggtaactttttgtttaacctagattttttttaaaactttttttttttttcatattggaaaagtaattcatattcagtagaggaaaactgaccaaaacagaagcaaaaataagaaaattaaaataatctctaatcctactacctagaataaaacactattaatattttggtctgtttcctgccaaggtgttttctgtgtatacatggatattttgtttgtttttaaacaaaacgatgggatcattctgaacatactgttctatagtatggtcagctaataatatatcagacctttttttatattattaaatattctacaactttttaaaaatgtctattaatattccatcgtatagatgtgatataatttgcttgatggttgtctcttaaaaagaaagatagcaaatactttttttaaattacaaaagtgatagatgttcattgtagaaaatgtaataaacactgttaagacttaaaagccatataattccaccaaccaaaattaatcccttttgtcatatttctagtcatttttatagcctttttttctatgtatttataataattatcatttgcgtttttttcctttttttaactttaaaaatgtatattctagggtcaggggaaatgtaatctggaattaaatattagccttaaaattcacaattttgattttcctggcttttcaggaattgactaactgtaaaagagtcttgaaagtatttagtcaacaaacagagtgcattttttttttttttgactaagaaagctcgttgtagtagaaagggtggaatgtattgaaaattattagaagcagggaagtattgttagtctagcttatttcctttcagtcttttttcaatatttttataaacattgagtacttactgaatttagttctgtgctcttccttatttagtgttgtatcataaatactttgatgtttcaaacattctaaataaataattttcagtggcttcataataaaaaaaaaaaaaaaaaaaaaaaaaaaaaaaa

SEQ ID NO: 32446 - DNA, 5913 bp, Homo sapiens
gtggacgcagcgggctttggaaaggccccaagttaatgaggcgtgcgccggctgccgagcgcctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgaggaagggctgctgcttatcccgcccaagcagctgcaacaccagcagcagcagcagcaacagcagcagcagcagcagcaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagtttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttctttttttttttttttttttgagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagaataatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 32447 - DNA, 2653 bp, Homo sapiens
atggccctgtccactgagcatcctcccgccacacagaaacccgcccagccggggccaccgaccccaccccctgcctggaaacttaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcc

SEQ ID NO: 32448 - DNA, 2160 bp, Homo sapiens
atggccctgtccactgagcatcctcccgccacacagaaacccgcccagccggggccaccgaccccaccccctgcctggaaacttaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaaaaaaaaaaaaaaaaaaa

SEQ ID NO: 32449 - DNA, 2534 bp, Homo sapiens
atggccctgtccactgagcatcctcccgccacacagaaacccgcccagccggggccaccgaccccaccccctgcctggaaacttaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaaggttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaaaaaaaaaaaaaaaaa

SEQ ID NO: 32450 - DNA, 3274 bp, Homo sapiens
catggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagaggttggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattcccagagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgattttttttttttaaagagaattctagaattctattttgtctagggtgatgtgctgtagagcaacattttagtagtatcttccattgtgtagatttctatataatataaatacattttaattatttgtactaaaatgctcatttacatgtgccatttttttaattcgagtaacccatatttgtttaattgtatttacattataaatcaagaaatatttattattaaaagtaagtcatttatacatcttagaaaaaattacatagttttgtttttacaattctgaaatatatgaaaaacttagatagaatatgtcatatgttattataacagatctcttcctacatcttatttttcttctttgtatacagtagtgacagtttaccttcagtcatcctacaggtcacctctgtgcccaacaactttacttgcctacaacggttcacaaactggaacaggccatattcaaagccagtgcctatttcttcagaactgttaacagatatagtgagttgagggagctaatctgatacacttttgataatataatgcctttcaaattagttaccaaatcataaacagagtggaataaatataaattagattctaactaggatgaatgtggtagtaatgatgtatatttttcaaatttacctaaacagaaagattattggctaaggcaggcggatcatgagatcaggagatcgagaccatcctggctaacacggtgaaaccccgtctctactaaaagtgcaaaaattagccgggcgtggtggcgcatgcctgtaatcctagctactcaggaggctgaggcagaagaatcacttcaacccaggaggtggaggttgtagtgagccgagattgcgccattgcactccagctcaggcaacaagagcaaaactccgtctcaaaaaaaaaaaaaaa

SEQ ID NO: 32451 - DNA, 1000 bp, Homo sapiens
cgaggtggacgggcggcagtcaagcgccggcgttctctgccatcaccctttccttgccggccggcacttcggctgcagagttttgcccacgcttcgagacttagggagcagtgcctttcagaatttcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgatacagattataaaccagtaccactgaaaacaggagaaggtgaagaatatatgctggctttgaaacaggagttgagagaaacaatgaaaagaatgccttattttattgaaacacctgaagaaagacaagatattgaaaggtatagtaaaagatacatgaaggtataccaggaagaatggataccagattggagaagacttccaagagagatgatgccaagaaataaatgtaaaaaagcaggcccaaaacccaaaaaggcaaaagacgcaggcaaaggcacaccactcactaatactgaagatgtgttgaaaaaaatggtggaattggaaaaaagaggtgatggtgaaaaatcagatgaggaaaatgaagagaaagaaggaagcaaagagaaaagtaaagaaggtgatgatgacgatgacgatgatgccgcagaacaggaggaatatgatgaagaagagcaagaagaggaaaatgactacattaattcatactttgaagatggagatgattttggcgcagacgtgatgacaacatggatgaggcaacctattaggcatgaaatttttcaaaaaatatttttatgatgcagcttctgaacatttggacagacttgatttgtattttatttctgataaggaataagatcttgtttctgttgttttggacaaaatgttgttaccaaaatatcaaaaccactttgagtttacatacagttacctt

SEQ ID NO: 32452 - DNA, 6034 bp, Homo sapiens
ccacgcgtccggagctggaggaggcggcgggcgcgagacccggaatgcgcagggcccccgcctcgccccccccagcccgggccgcggcccccgccttccccgcagtcgtcccgcactcggtgcccgccccccgaggccggcggctgctcccactcggggccgttgctgcttgtgccgtgagcgccgcccagccattgtccccgtcgctccgtcagccgcgccggaccgcgcaccaggaggcgagagcgcgcatggggagcctctgttgatgccgccgccgcgccgccctccgaggctgcgtcccgggaagcccggctccccgagcgctccggcctggcccggtgccccggacctgagtgcgtccccatggaggcgcccgggctggcccaggcggccgcggcggagagcgactcccgcaaggtggcggaggagacccccgacggggcgcccgcgctctgccccagccctgaggcgctgtcgccggagccgcctgtgtacagcctgcaggactttgacacgctggccaccgtgggcactgggacgttcgggcgggtgcacctggtgaaggagaagacagccaagcatttcttcgccctcaaggtgatgagcattcctgacgtcatccgcctaaagcaggagcaacacgtacacaatgagaagtctgtcctgaaggaagtcagccacccgttcctcatcaggctgttctggacgtggcatgacgagcgcttcctctacatgctcatggagtacgtgccgggcggcgagctcttcagctacctgcgcaaccgggggcgcttctccagcaccacggggctcttctactctgcagagatcatctgtgccatcgagtacctgcactccaaagagatcgtctacagggacttgaagccagagaacatcctgctggatagggatggccacattaagctcacggactttgggttcgccaagaagctggtagacaggacttggaccctctgtggaacacccgagtacctagcccccgaagtcattcagagcaagggccacggaagggccgtggactggtgggccctcggcatcctgatattcgagatgctttcggggtttcctccgttttttgatgacaacccgtttggcatttatcagaaaattcttgcaggcaaaatagatttccccagacatttggatttccatgtaaaagacctcattaagaaactgctcgtggttgacagaacaaggcgattaggaaacatgaagaacggggcgaatgatgtgaagcatcatcggtggttccgctccgtggactgggaagctgttccgcagagaaaactgaagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaagaaacaggaagattggaatctgcctggaacaaagaactgcacctaagcagaccagaagcaaaatgtcttcttcacggcataaggacatctccacttttctctgtacctgtgtgtatagaaatagattagagcacagttgaaattcatggaactggcattatttaagcaactggaattccacactgtaggaaggttttgaaaattgtttggttgtagattttatcttatcctttagtgttgtgttcctactgtgatgtcttggtttttgtcatagacttaagtttataagtttgaactggacttgttcgattataaccacaaattgtgtgtgtgtgtgtgtgtgtgtgtgtgtgtgtgtgtatgcctgtgtgtatatatagaagtcattatggcagatgcacagaaattgtgcagtgatgtaaatgttcatactttacagagcctataatttttatttttcaatttgttttttcaaaaatctcttctcggggacaacatctgaagggtatgttgcatgcattaaaaaaaatcatctcacatgcattttatagttttggggaagaaaatatcatggggaggtctaccttcagtatctttagttcttcttaccgggtaacttgagactttaaaagaagaaacaaagaggggaagatatgggagcgaatttattccaagaatctacaatgacattgaagttgttggaggaatgtactgtatttaaaaaaaccttctgtgacacattcaaaaatttcatctgagctggatgcagtggcttgttcctatagtcccagcactttgggaggctgaggtgggtggattgcttgagcccaggagttggagaccagtctgggaaacgtggtgagacctcatctctacaaaatacaaaaaaattagccgggcatggtggcacgtgagttaggtctcagctactcaggaggctgagatgagaggatcacttgagcctggggaggtccaggccgcagtgatccgagatcacaccactgcattccagcctgggtgacagagtgagaccctgtccaaaaaaaaaaaaaaaaaaaagaaggcaatggctttgtgcttttgaagatggattgaagagaacgtccaccttaaggctttaaaagacagtgaagctgggtgcggtggtgcactcctgtaaccctgggactttgggaagctgaggcaggaagattgagcctaggagttcgagactgacctgggcagcatagcgagaccccatctctatataaaaaaaaagatgttaaaacagtgaaattacagaaacagaacatagccaccctttttcatcagtgaccttttcttcacgtggaggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttaccgtgaatgtgaaaaggtgaaactggtgctgacttcggcagcaggtatactaaaattggaatgacacagaggagattagcatggccccctgcgcgaggaagatctgcagattcatgcagcattccatatttttttaagaaaaggttacactgtgcaccgacatgtggagctagaaggaaaagcttttaagtctcatgtttgctgactataaaaataaatcatagtaataatattgaacattctactttaaaaattattaataaaaccataaatgaaacacttgagcacactttaaaaagtacataaatccatgagtccatatgcctatttttaggttgtctgttttattatccaggatttcatactcagatgagaattagcatcaggaaagcctgaaatgccttaattgtgaactgatatgcaggaaaatgaaatatgcaagcacattggtgaccttgttctttacagacgtcgtgatcagcctccagccatacagaacaaatgagaaattagaagcgattccaagaacgtgtgatggtgtgaacccactttggaccatcacacacatttcagcatttgaagtgacacaagctacctggtaactgcccatggcggggtcatagtttaaatggcccaatgtcatgtagaggttaatttaatcaaaatgagctataaacatggagcaatcactgtataattttaaaatagtttacctggccaggcatggtcgtcacgcctgtaatcccagcactttgggaggccgaggcaggtggatcacctgaggtcaggagttcgagaccagcctggccaacatggcaaaacccccgtctctactaaaatacaaaaattaggtgtggtggcgggcacctgtaatcctggctactcgggaggctgaggcaggagaatcgcttgaacccgggaggcagaggctgcagtgagccgagatcgtgccactgcactccagcctgggccacagagcaagactccgtctcaaaacataaaaataaaaaaaatacaaatagctgacccgggtgggcattccaaaatgtccgcatggacgatcacgaaacaatcacggtgcgaaatgtccgcatggatgatcacgaaacaatcacggtgcggaatgtccgtatggatgatcatgacaaacaatcactgcgcaaaatgtggaggaaaattcattaccataatcacaacatttgtatcagaaaaacattacaaatttactttgcttcatgtaattttacgagttggcaatattttcttaaattggaatactctaagagaataggacatggatatgttacaagaagaagtgtattggggcaagtcttgtttttctgaagggaaatgccaccggcctgctttcataggcattgataaagccaggaaggaaataaagtcacaaccaaatagtatacactgtctctactgaattcttctaattccttcgcaacagaagtctaaatcctgcttagcctaaacatatctatagccagcgatgggcaaattatatttgctgtcagcatgatagaataagaagcagaaaccccccagcagtggggtaagattgcgcgcttcatcccctcaaaatgcagctcagccccactccctctccatgcccatcaaacaactgcacaatcacttgttactgaatttcccattcagcgttttgtttctttctgtccatacttaaagaccaaatcatttgtttgctttgaagaaaaagcaaaaacaagaacaaaaacaccaaatcatttgaaatcactgtccattaaaaaaaatcaccagtggaactaaacagttgagtggtttgggatgtgttcgccatttctgtgtttgacctacatggcctgtaattctttggaccattgtaactgtgaactatggcttaatactgttaaagaccccaaggctccactctgtagccaggtgcacctcaggctgcacaaataccccaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttgctctcgtttttccttcaagctacctagcatgcattttacacacattggaggagtcgtatgcactgtttttctgttgctgatggaggcaagcaggccttctaattagtctaagttaaacggatgggattcacttaagaaaagcaagaagaaaagcacacgaacaggtgtcttaatgcatttggatagtttctttgcggggtgtgtgtgtgtgtgtgtgtgtgtgtgtgtgtgtgtgtgtcttggtgaaggtgaggggctgtattttcaccaagccttttcataatcaagtttgctttgcaaaccttatggccttgcaccccgcagaacagtcccttcctaatagcagggatgctctgtcatggtttttctgtaaattatcgtgtgttgggaagttctgttgaggcttagtttgatcttccatggtggacacgtctgttctgtatgtaaaaggcattacaattgtgttttagcagatgagacttgaagcctttccacagtccttgtgctctgagatggctgttgagctctgctcaactgtcgtagctgaattctttctttgcgctgaacactgggcagcctcaccatgttgccaacgtgcttctggggcccctgtcactgccgctggatgccgcgcacacaggcagagtgccttggcaggtttgtgcaccccttggcgagccagaactgggaaccccgcggggtgaccccttctcatggggggtcggggaggggagtgcctatttttaatcctgtctgtttgttgcacaatggaaatcactgtgatttgtacatatgccctaggaaaattttactgctgtctaatttatgtaataatactgttgattccaggtttatttaataaaactttgtatcttttcagaaaaaaaaaaaaa

SEQ ID NO: 32453 - DNA, 1590 bp, Homo sapiens
atgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctcttacaaacccagagttatttcagcgtgtaggaataatacctccaaaaggctgtttgttatatggaccaccaggtacgggaaaaacactcttggcacgagccgttgctagccagctggactgcaatttcttaaaggttgtatctagttctattgtagacaagtacattggtgaaagtgctcgtttgatcagagaaatgtttaattatgctagagatcatcaaccatgcatcatttttatggatgaaatagatgctattggtggtcgtcggttttctgagggtacttcagctgacagagagattcagagaacgttaatggagttactgaatcaaatggatggatttgatactctgcatagagttaaaatgatcatggctacaaacagaccagatacactggatcctgctttgctgcgtccaggaagattagatagaaaaatacatattgatttgccaaatgaacaagcaagattagacatactgaaaatccatgcaggtcccattacaaagcatggtgaaatagattatgaagcaattgtgaagctttcggatggctttaatggagcagatctgagaaatgtttgtactgaagcaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggcaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctcctacatataaaaaaaaaaaaaaaaaaaa

SEQ ID NO: 32454 - DNA, 2499 bp, Homo sapiens
agggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaatt

SEQ ID NO: 32455 - DNA, 2500 bp, Homo sapiens
cccaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggttgacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgttttgtactcacggcggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcataaaaaaaaaaaaaaaaaaaaaaaaa

SEQ ID NO: 32456 - DNA, 1093 bp, Homo sapiens
aggcggtggggcccacagccatggcggagcctgtgcaggaggagctctcggtcctggccgcgattttctgcaggccccacgagtgggaggtgctgagccgctcagagacagatgggaccgtgttcagaattcacacaaaagctgaaggatttatggatgcggatatacctctggaattggtgttccatttgccagtcaattatccttcatgtctacctggtatctcgattaactctgaacagttgaccagggcccagtgtgtgactgtgaaagagaagttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggtaaaataatactgattttactacagggagacagaaacaacctcaaggtgccaaaaagttaaatgtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaaaaaaaaaaaaaaaaa

SEQ ID NO: 32457 - DNA, 2785 bp, Homo sapiens
gatccgccaccatggctgaaggagagaatgaagtgagatgggatggactctgcagcagagattcaactactagggagacagcattggaaaacattaggcaaaccattttgaggaaaaccgagtatcttcgttcggtgaaagaaacacctcatcgtccatcagacgggctttcaaataccgagtcttcggatgggttgaataagctacttgctcatctgcttatgctttctaagaggtgtcccttcaaagatgtgagagagaaaagtgagtttattctgaagagcatccaggaacttggcattagaattcctcgaccactaggacagggaccaagcagattcatcccagaaaaggagatcctccaagtggggagtgaagacgcacagatgcatgctttatttgcagattcttttgctgctttgggccgtttggataacattacgttagtgatggttttccacccacaatatttagaaagtttcttaaaaactcagcactatctactgcaaatggatgggccgttacccctacattatcgtcactacattggaataatggctgcggcaagacatcagtgctcctacttagtgaacctgcatgtaaatgatttccttcatgttggtggggaccccaagtggctcaatggtttagagaatgctcctcaaaaactacagaatttaggagaacttaacaaagtgttagcccatagaccttggcttattaccaaagaacacattgagggacttttaaaagctgaagagcacagctggtcccttgcggaattggtacatgcagtagttttactcacacactatcattctcttgcctcattcacattcggctgtggaatcagtccagaaattcattgtgatggtggccacacattcagacctccttctgttagcaactactgcatctgtgacattacaaatggcaatcacagtgtggatgagatgccggtcaactcagcagaaaatgtttctgtaagtgattctttctttgaggttgaagccctcatggaaaagatgaggcagttacaggaatgtcgagatgaagaagaggcaagtcaggaagagatggcttcacgttttgaaatagaaaaaagagagagtatgtttgtcttctcttcagatgatgaagaagttacaccagcaagagctgtatctcgtcattttgaggatactagttatggctataaagatttctctagacatgggatgcatgttccaacatttcgtgtccaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgttcccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctccaaaaaaaaaaaaaaaaaa

SEQ ID NO: 32458 - DNA, 3423 bp, Homo sapiens
gccgcaaccccgacggcgccccaaacgctgttgcgccgcgcgccccgcccagcccggcctcgcgctggtcccggtctcgccccgcagccctcgatctcccgtgacttcctcggccaggccgcctgcgcctctgggaccatgttgcgctggctgcgggacttcgtgctgcccaccgcggcctgccaggacgcggagcagccgacgcgctacgagaccctcttccaggcactggaccgcaatggggacggagtggtggacatcggcgagctgcaggaggggctcaggaacctgggcatccctctgggccaggacgccgaggagaaaatttttactactggagatgtcaacaaagatgggaagctggattttgaagaatttatgaagtaccttaaagaccatgagaagaaaatgaaattggcatttaagagtttagacaaaaataatgatggaaaaattgaggcttcagaaattgtccagtctctccagacactgggtctgactatttctgaacaacaagcagagttgattcttcaaagcattgatgttgatgggacaatgacagtggactggaatgaatggagagactacttcttatttaatcctgttacagacattgaggaaattatccgtttctggaaacattctacaggaattgacataggggatagcttaactattccagatgaattcacggaagacgaaaaaaaatccggacaatggtggaggcagcttttggcaggaggcattgctggtgctgtctctcgaacaagcactgcccctttggaccgtctgaaaatcatgatgcaggttcacggttcaaaatcagacaaaatgaacatatttggtggctttcgacagatggtaaaagaaggaggtatccgctcgctttggaggggaaatggtacaaacgtcatcaaaattgctcctgagacagctgttaaattctgggcatatgaacagtacaagaagttacttactgaagaaggacaaaaaataggaacatttgagagatttatttctggttccatggctggagcaactgcacagacttttatatatccaatggaggttatgaaaaccaggctggctgtaggcaaaactgggcagtactctggaatatatgattgtgccaagaagattttgaaacatgaaggcttgggagctttttacaaaggctatgttcccaatttattaggtatcataccttatgcaggcatagatcttgctgtgtatgagctcttgaagtcctattggctggataattttgcaaaagattctgtaaaccctggagtcatggtgttgctgggatgcggtgccttatccagcacctgtggtcagctggccagctacccattggctttggtgagaactcgcatgcaggctcaagtgttagaaggttccccacagctgaatatggttggcctctttcgacgaattatttccaaagaaggaataccaggactttacagaggcatcaccccaaacttcatgaaggtgctccctgctgtaggcatcagttatgtggtttatgaaaatatgaagcaaactttaggagtaacccagaaatgatgttgcattttttgctttagcctgataattgaaactttcaacaatctctggagtgactttttctcctcgaattgaaacaagtctatggcaaaagaagctgcatttttttcacaaaagggaagatggtaacaatggtcacttcaaacttttgggctaaattatatgtacacagaaatgttcaaaatcatagttttaatgtgttttgaaaaggccacacaattatactttatcttttcttaataatcctgcaaatctctgccctgaatccgaaatctgaaaatgtactggcttgaacaaaatttgttttgtgtgttagagttataaatcattaatctttatttcgggtggtttacgtttatgccagttcctttatatttaaatttcttgttttatatattttgaatgtctttatagatttctttaaatttccttatagaaccattaatagaaaatcattacatttaaaatataccttacagcaaaagcatccaaataagtatagggtttatgtccttatttttctttcagctgaatacgaatgaacacagtggtggaatttctgaagggaagtgatgaaattatatttatttcagtgggcacttttccattttaccactgtaccattatttggttcctggagttatacactaattttcagtatattactgttaaattaccaacacaaggcaatttatttgaaagattccgtttatcctgccattgctttgaaaagcagcaggaaacgaaatcctttgacttgtatcagcttctgcagagcatctttgttttcctttgtcctttgtttcctaccttttgaatcagattccgttttagtcaggaagacttcttgggaccattcttagtaacctgaaatttcttttttaattgcatgaagtggattgatcatgagcaaatgatgtgcttatttctccctcactgttgaatatctttgaacttgctgttttcaatatgggcagcacaaaggtgagagatacatattaatagtagtatgtattactcttatacattagatacctatatttaaatgaaaggcccaatttgtaaacatatacattcatattctctcttgccccaagttttaggaacatgttaggatataggagacttaatttataataatgagagcatttttttattttactaaagccatttttatagtcaactatcttttcttatttgtgtgattagaacttagaaaaatatttactagttgaagttattatcagtttttaatttagttcttaaactcatttcacttctaataatttctgttataaatttccagcattttaatgaaaatctaatgatgtaataggcattttctttatttgaacctacctcttttattttctgaaccaaagagaaagatggactggtgtttgtgaaacatttttaaaaatgtagtttcatttatattagttatgtttgataaatgtctcagtatttttataatatgataagcctgggattctacttttagggttatttgtacttttgagtaatatataaagtgacaatattaaggtacatgatcagctctttctatttttactcgtaaaaattatggaaatgaataattttgctaacaactttgaaatttcaaacttctggaaaatatgaaaatattcattgttcattatgaatttaaattgtaaggtatgaatgtgatttgtctgtacatcttgtatcttttccaaaaaatgattctgtatcttttggaaaaaagccgagagttgaagatagtatatttctggtagtactgaatatttacttacagtttctatcaaaaatatatatttgtttctaaaaaaaaaaaaaaaaaaaaaaaaaaaa

SEQ ID NO: 32459 - DNA, 3344 bp, Homo sapiens
atgctgtcttaggcctcttcccactggacgtgtgtggtgggcagagatcccgttcgtcggtcgcacttccaccccgctggggctcactcaggccgcggagctgcgagggagacatcctcgatggactccctctacggagatctcttttggtacctggactataacaaggatgggaccttggacatttttgagcttcaggaaggcctggaggatgtaggggccattcaatctctagaggaagcgaagaaaatttttactactggagatgtcaacaaagatgggaagctggattttgaagaatttatgaagtaccttaaagaccatgagaagaaaatgaaattggcatttaagagtttagacaaaaataatgatggaaaaattgaggcttcagaaattgtccagtctctccagacactgggtctgactatttctgaacaacaagcagagttgattcttcaaagcattgatgttgatgggacaatgacagtggactggaatgaatggagagactacttcttatttaatcctgttacagacattgaggaaattatccgtttctggaaacattctacaggaattgacataggggatagcttaactattccagatgaattcacggaagacgaaaaaaaatccggacaatggtggaggcagcttttggcaggaggcattgctggtgctgtctctcgaacaagcactgcccctttggaccgtctgaaaatcatgatgcaggttcacggttcaaaatcagacaaaatgaacatatttggtggctttcgacagatggtaaaagaaggaggtatccgctcgctttggaggggaaatggtacaaacgtcatcaaaattgctcctgagacagctgttaaattctgggcatatgaacagtacaagaagttacttactgaagaaggacaaaaaataggaacatttgagagatttatttctggttccatggctggagcaactgcacagacttttatatatccaatggaggttatgaaaaccaggctggctgtaggcaaaactgggcagtactctggaatatatgattgtgccaagaagattttgaaacatgaaggcttgggagctttttacaaaggctatgttcccaatttattaggtatcataccttatgcaggcatagatcttgctgtgtatgagctcttgaagtcctattggctggataattttgcaaaagattctgtaaaccctggagtcatggtgttgctgggatgcggtgccttatccagcacctgtggtcagctggccagctacccattggctttggtgagaactcgcatgcaggctcaagccatgttagaaggttccccacagctgaatatggttggcctctttcgacgaattatttccaaagaaggaataccaggactttacagaggcatcaccccaaacttcatgaaggtgctccctgctgtaggcatcagttatgtggtttatgaaaatatgaagcaaactttaggagtaacccagaaatgatgttgcattttttgctttagcctgataattgaaactttcaacaatctctggagtgactttttctcctcgaattgaaacaagtctatggcaaaagaagctgcatttttttcacaaaagggaagatggtaacaatggtcacttcaaacttttgggctaaattatatgtacacagaaatgttcaaaatcatagttttaatgtgttttgaaaaggccacacaattatactttatcttttcttaataatcctgcaaatctctgccctgaatccgaaatctgaaaatgtactggcttgaacaaaatttgttttgtgtgttagagttataaatcattaatctttatttcgggtggtttacgtttatgccagttcctttatatttaaatttcttgttttatatattttgaatgtctttatagatttctttaaatttccttatagaaccattaatagaaaatcattacatttaaaatataccttacagcaaaagcatccaaataagtatagggtttatgtccttatttttctttcagctgaatacgaatgaacacagtggtggaatttctgaagggaagtgatgaaattatatttatttcagtgggcacttttccattttaccactgtaccattatttggttcctggagttatacactaattttcagtatattactgttaaattaccaacacaaggcaatttatttgaaagattccgtttatcctgccattgctttgaaaagcagcaggaaacgaaatcctttgacttgtatcagcttctgcagagcatctttgttttcctttgtcctttgtttcctaccttttgaatcagattccgttttagtcaggaagacttcttgggaccattcttagtaacctgaaatttcttttttaattgcatgaagtggattgatcatgagcaaatgatgtgcttatttctccctcactgttgaatatctttgaacttgctgttttcaatatgggcagcacaaaggtgagagatacatattaatagtagtatgtattactcttatacattagatacctatatttaaatgaaaggcccaatttgtaaacatatacattcatattctctcttgccccaagttttaggaacatgttaggatataggagacttaatttataataatgagagcatttttttattttactaaagccatttttatagtcaactatcttttcttatttgtgtgattagaacttagaaaaatatttactagttgaagttattatcagtttttaatttagttcttaaactcatttcacttctaataatttctgttataaatttccagcattttaatgaaaatctaatgatgtaataggcattttctttatttgaacctacctcttttattttctgaaccaaagagaaagatggactggtgtttgtgaaacatttttaaaaatgtagtttcatttatattagttatgtttgataaatgtctcagtatttttataatatgataagcctgggattctacttttagggttatttgtacttttgagtaatatataaagtgacaatattaaggtacatgatcagctctttctatttttactcgtaaaaattatggaaatgaataattttgctaacaactttgaaatttcaaacttctggaaaatatgaaaatattcattgttcattatgaatttaaattgtaaggtatgaatgtgatttgtctgtacatcttgtatcttttccaaaaaatgattctgtatcttttggaaaaaagccgagagttgaagatagtatatttctggtagtactgaatatttacttacagtttctatcaaaaatatatatttgtttctaaaaaaaaaaaaaaaaaaaaa

SEQ ID NO: 32460 - DNA, 2646 bp, Homo sapiens
atcagcaacaattaaaatattcacgtggtatctgtagtttaataatggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggatattataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggagcttgtaggatatataattccgtattttttggaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaatgaaacactttggatgtattacttaggccaaaatctggcctggatttatgctataatatatattttcatgttaagttgtatatttttcagaaattataaatattattaatttaaaattcgaaaaaaaaaaaaaaaaaaaaa

SEQ ID NO: 32461 - DNA, 2850 bp, Homo sapiens
gcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacataa

SEQ ID NO: 32462 - DNA, 2569 bp, Homo sapiens
acggtgcttgacaatactatattgaatgcaataaaagttggatttcattcatatgtacaacaaactactttcttcttcacttcaagattcggtacaactgttcctgaattccaactctccatacatcccaatgtcagggtccctgtagctcggagcccttatccaggtagatgaactgctgcccagtgaacactatgtacaaagcaatttgagcaccattctcttttctggcagtgaggtaaaatcaggtctttttggaaggggagaagccacattgcatctctgctacacacaagattactctgtcattgcctttgagtctttcacgctcccttcttctgaagcatcagtttttatggaaacttatcacacctgtcttgtgggcacatcttgctccatccctcctctcttcatattgtccgttttccggtattgagttagggaaagtatgcaggtattcctgtcattcctgactgaggctgttgtatctgtcaaaagagaggagaggtagggggcattctgaaaaatgatcactcatggcttgcaggagcaagagccagacaggactttgcaactggcagctttctgagtgcataagacctccacctctagactagctcttcagtcatggttagccccttcagtccattatcctccaatacaatgcccatgccttctggggctttcagctaagttttgtttaaaaaatgtgggttttttttttgccaattcattaaggcttttccctttgttttctcctgttggtggttcagagttaaattcagtatgaataagagagggaaatatacaacactgaatttggaggagaaaatgaaggttctaagtagaattgaagctggacgatcacttaaaagtgtaatggatgaatttggaatcagtaagtcaacattttatgacattaaaaaaaataagaagttaattctggactttgtactgaagcaggacatgccattagtaggggctgagaagagaaagaggacaacgggagccaaatatggtgatgtagatgatgcggtctacatgtggtaccaacagaaacgctcagccggtgttccggtaagaggcgtggagcttcaggctgctgcagagagatttgcacggtgttttgggcgaacagatttcaaagctagcactggttggctttttagatttcgaaatcggcatgcaattgggaaccgaaaaggatgtggggaacaagtcctaagttcagtttctgaaaatgttgagccatttcgacaaaaactgtccatgataatcaaagaggagaaactgtgtctagctcagctatacagtggggatgaaacagacctcttttggaagtcaatgccagaaaattctcaggcaagtaggaaagatatctgcctaccagggaagaaaataaacaaagaaaggttgtctgcctttttatgtgcaaatgcagacggaactcataaattaaagtcaatcattattggaaaatcaaaactgcccaaaagtgtgaaagaggacacaagtacattgcctgtgatatataaacccagtaaagatgtttggttcaccagagaattgttttcagaatggttttttcaaaactttgttcctgaggtccgacattttcaacttaatgttctaagatttcatgacgaggacgtcagggcattgttacttctggacagttgcccggctcatccttcctctgaatccctaaccagtgaggatggtcgaataaaatgtatgttcttcccccataacacttcaaccttgattcaaccaatgaatcaaggtgtgatcttgagctgcaaacggctgtatagatggaagcaacttgaagagagtcttgtaatatttgaagaaagtgatgatgagcaagagaaaggagataaaggagtttccaaaattaaaatctacaatataaaaagtgcaatttttaactgggcaaaaagttgggaagaagtaaaacaaataaccatagcaaatgcatgggaaaatcttctttacaaaaaggaacctgaatatgattttcaaggcttagaacatggggattatagagaaattcttgaaaaatgtggggagttggaaactaagttggatgatgatagggtgtggttaaatggagatgaagaaaagggttgtctcctaaaaaccaaaggtggaataacaaaggaagttgttcaaaaaggaggagaagctgagaagcagactgctgaatttaaattatctgctgtaagagagagtttggactaccttcttgactttgttgatgccacacctgagtttcagagattccacttcacactgaaagagatgcaacaagaaatagtcaagaaacagttccagagtaaaatccattctagaattggtagctttttgaaacctaggcctcataatattaaggactccttcagtgggccttcaacttctggttctaatcattagattttgtgtttaaagatttctgccattatatgatgtaggccagctgtgaattgtcttgttttagcaactgacattattttgtatatcagtgcccatttatataatggttataaaatttacagtttgaaaataa

SEQ ID NO: 32463 - DNA, 4496 bp, Homo sapiens
gggagccccgaccgtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctgaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggaacagaagagactaagcaatgggaaacttgtggaggaaattgaacagatgaataatttgttccagcaaaaacagagggagctcgtcctggctgtgtcaaaagtagaagaactgaccaggcagctagagatgctcaagaacggcaggatcgacagccaccatgacaatcagtctgcagtggctgagcttgatcgcctctataaggagctgcagctaagaaacaaattgaatcaagagcagaatgccaagctacaacaacagagggagtgtttgaataagcgtaattcagaagtggcagtcatggataagcgtgttaatgagctgagggaccggctgtggaagaagaaggcagctctacagcaaaaagaaaatctaccagtttcatctgatggaaatcttccccagcaagccgcgtcagccccaagccgtgtggctgcagtaggtccctatatccagtcgtctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggctctaaaatccatccagttggccctgattggagtccttcaaatgcagatcttttcccaagccaaggctctgcttctgtacctcaaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcaggttgcaaataaaaatgtggctaaagtaccacctcctgttcctacaaaaccaaaacagattaatttgccttattttggacaaactaatcagccaccttcagacattaagccagacggaagttctcagcagttgtcaacagttgttccgtccatgggaactaaaccaaaaccagcagggcagcagccgagagtgctgctatctcccagcataccttcggttggccaagaccagaccctttctccaggttctaagcaagaaagtccacctgctgctgccgtccggccctttactccccagccttccaaagacaccttacttccacccttcagaaaaccccagaccgtggcagcaagttcaatatattccatgtatacgcaacagcaggcgccaggaaaaaacttccagcaggctgtgcagagcgcgttgaccaagactcataccagagggccacacttttcaagtgtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctccccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttgaaatattgaaactaagctacggtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgctaaaaaaaaaaaaaaaaaaaaaaaaaaaaaaaaaaaaaaaaaaaaaaaaaaaaaaaaaaaaaaaaaaaaaaaaaaaaa

SEQ ID NO: 32464 - DNA, 4534 bp, Homo sapiens
gtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctgtagagatagagtttcatcatgttggccaggatggtctcgatctcctgaccttgtgatccgcctgcctcggcctcccaaagtgctggattacaggtgtgagccaccacgatcagcctctagtgtttaaaaaagaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggaacagaagagactaagcaatgggaaacttgtggaggaaattgaacagatgaataatttgttccagcaaaaacagagggagctcgtcctggctgtgtcaaaagtagaagaactgaccaggcagctagagatgctcaagaacggcaggatcgacagccaccatgacaatcagtctgcagtggctgagcttgatcgcctctataaggagctgcagctaagaaacaaattgaatcaagagcagaatgccaagctacaacaacagagggagtgtttgaataagcgtaattcagaagtggcagtcatggataagcgtgttaatgagctgagggaccggctgtggaagaagaaggcagctctacagcaaaaagaaaatctaccagtttcatctgatggaaatcttccccagcaagccgcgtcagccccaagccgtgtggctgcagtaggtccctatatccagtcatctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggctctaaaatccatccagttggccctgattggagtccttcaaatgcagatcttttcccaagccaaggctctgcttctgtacctcaaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcaggttgcaaataaaaatgtggctaaagtaccacctcctgttcctacaaaaccaaaacagattaatttgccttattttggacaaactaatcagccaccttcagacattaagccagacggaagttctcagcagttgtcaacagttgttccgtccatgggaactaaaccaaaaccagcagggcagcagccgagagtgctgctatctcccagcataccttcggttggccaagaccagaccctttctccaggttctaagcaagaaagtccacctgctgctgccgtccggccctttactccccagccttccaaagacaccttacttccacccttcagaaaaccccagaccgtggcagcaagttcaatatattccatgtatacgcaacagcaggcgccaggaaaaaacttccagcaggctgtgcagagcgcgttgaccaagactcataccagagggccacacttttcaagtgtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctgcccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggccttggggctcactgaaggctcgaaggcactgcacaccttgtatattgtcagtgaagaacgttagttggttgtcagtgaacaataactttattatatgagtttttgtagcatcttaagaattatacatatgtttgaaatattgaaactaagctacagtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgct

SEQ ID NO: 32465 - DNA, 1316 bp, Homo sapiens
atgcgccaagcccacgcggttccgggtcccaagatttggctccaagagctattcgcagagaaacagcctcgcacaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggacgttcaggccaaggcgtagccaagatcgcgccgccctgtagcttgaggaggcgccgggattcgaaccaaggctgtgcccaatcctaagccctgcgaggtcttgtggaaccgacatgacccactctttggtttgtccagagacagtgagcagggtgagttcagtgctgaatcgcaacactcggcagtttggaaaaaaacatcttttcgaccaggatgaggagacatgttggaactcagaccagggcccctcccagtgggtgacgctggagtttccccagctcatccgtgtctcccagctgcagatccagtttcagggtggcttctccagtcgccggggctgcctggaaggttcacagggcactcaggctctccacaagattgtagatttctaccctgaggacaacaactcgcttcagactttccccataccagctgctgaagtggaccggctgaaggtgacgtttgaggatgccactgacttttttggccgtgtggtcatctaccacctgcgggtgcttggggagaaggtgtgagacctctaggggctgtctcctccaggaagccctccgggaagcacagcaaagtccctcattctgcacagaaggtttattggttcctcttgggaagggtcccctcccaccacctgtccagaagctgcctttgaagtcagttctgggtttccccagctctggctgaccattttgttccctgagtgtctgagtccccggcaggcggccttcactcagggtcagcgggcaccaggttgctctggaagagcttgaggatgtggttctcgatcacctgttgcactgagatggggcagggaaaaggtgggctgtgagcttgaatcgggagtggggtggaggcacaggccaacctgcgctctccccttaggggacaaacagggacccttgcagagacctgcattacagagcaaagctgggagaaccgaggactcaccccaggaacctcaacttcccctaagtttgtaaaaatgcacttttgtagcttttcagaattaatataaaaatatttcctaccaaaaaaaaaaaaaaaaaaa

SEQ ID NO: 32466 - DNA, 4890 bp, Homo sapiens
cgccacgggggtcgctgtcatggcaacgcacccgctcccgcatggagggcgcgaagccgcattgtgagcgctggccctggagcccgcggccccgcggctgagagcgagcctcggtcccgctgaagctcccctgacttctgcctgctccctctcccgacgggacggaaagggccggggctcgggcatggggtcccctgcggtccgagcctgcccacggcgaagccggtgcagcctggccccgtgacccctctgaatccccgtccggccgtcgccgtgcagttgtcaagtttctgggaagattagtgggagcgcagccgcccgagcccgacggccggagggtcgcggccagtcccccttgccgggtcgccacgtcccacaaggtccttcccggccgctccgtgggaggcggggcgcaggttggagtaacagggacgggcttgagctggtacggaaccgggcaaggtgagagaagtgtcttccacgcgattcccaagcctcgctagggaatcgagggagaagaaaggttgctcagagtgataaagaacatgccgttgcaaacggaagagcaacgtgcccgaatctaggtgacaggaagggcttaggccttttcggcacgaatggagccttccagtcaacatgcttctacgtgatgcagctttatagcgcaaaaaaatgacaatgcaaggggtacaaacagccctgctagaccaacagcccgagcctcgacagtctacatccggcgccttcaagcccccaaccacacactgcgaagtgggaaaagttcccagcgcggcttggcgaacccgctaacacggcgctctcacgagctgctggaaaagaccttcgcgagagggcgcagggagtcccgctccctggagggcccgcccccttggaggggaccggaagcgcttgtcctggcccggaagcagtgctgactccgtacacgcgcgctgcggcatggcggcccaccgccccggcccgctcaagcagcagaataaagctcataaaggcggacggcatcggggtcggggatctgcacagcgggacggcaagggccgtctggcactgaaaaccctaagcaagaaggtgagaaaagaactcagcagagtcgaccagaggcatcgcgccagccagctccgaaagcagaagaaggaggcggttctggcagagaagagacagctgggtggcaaggatggccctcctcatcaggtactggtggtgcccctgcacagcagaatttccctgccagaggccatgcagctgcttcaagatagggacactggaacagtacacttgaatgaattgggaaacacccagaactttatgctgctgtgcccccgcttgaaacatcggtggtttttcacctcagcaaggccaggggatctgcacgttgtgttagacatggctaaagtagctgataccatcctgttcctccttgatccactagaaggctgggacagcaccggtgattactgtctttcctgcctctttgctcagggccttccgacctatacactagctgtccaggggatttctggcctcccactgaagaaacaaatagataccaggaagaagctaagtaaagcagtggagaagcgctttccgcatgacaaactcctcttgttagacactcaacaggaggcagggatgctgcttaggcagttggctaaccagaagcaacagcatcttgcttttcgagatcggcgggcctacctatttgcccatgctgttgattttgttcctagtgaagagaataacttggtgggcaccttgaaaatttcaggctatgttcgagggcagactctgaatgtcaataggttgctgcatatcgttggatatggtgatttccagatgaaacagatagatgcccccggagaccctttccctttaaatcctagaggaattaaaccccaaaaggacccagacatggcaatggagatttgtgctacggatgctgtagatgatatggaagaaggtcttaaagtcctaatgaaggcagaccctggtagacaggaatccttgcaagcagaggttatcccagatccaatggagggagagcaaacctggcccactgaggaggagctgagcgaggcaaaggatttcttgaaggaaagttctaaggtggtaaagaaggtccccaaaggaacatccagttaccaagctgaatggattttggatggtggcagccaaagtggtggggaaggagatgaatatgaatatgatgatatggaacatgaggattttatggaggaggaatctcaggatgagagtagtgaagaagaggaagaatatgaaactatgactattggggagtctgtgcatgatgatctgtatgataagaaagtagatgaagaagctgaggcaaaaatgttggagaaatataaacaagaaagactggaagagatgtttccagatgaagtggacacgccccgtgatgtggctgctcgaattcgatttcagaaatacagaggccttaagagcttccggacatctccatgggatcctaaggaaaaccttcctcaagattatgctcgaatatttcagtttcagaactttactaacactaggaaaagcatctttaaagaggttgaagaaaaagaggttgaaggagctgaggttggctggtatgtcacacttcatgtctctgaagtccccgtctcagtggtcgagtgcttcaggcaaggaacacccttgattgcattttctttactacctcatgaacagaagatgtcagtattgaatatggtggtgaggcgtgaccctggcaacactgaacctgtgaaagccaaggaagagctcatatttcactgtggattcaggcgcttccgagcctcacctttattctctcagcacactgcagcggacaaacataaattgcagagattcctgactgctgacatggccctggtggcgacagtctatgcgccaatcacttttcctcctgcatctgtgctgcttttcaagcaaaaaagcaatggaatgcacagcctcattgctacaggccatcttatgtcagtagatccagacagaatggtcatcaagagagttgttctgagtggtcatcctttcaaaatttttactaagatggcagtagtacgttacatgttcttcaacagagaggatgtgctgtggtttaaaccagtggaactgagaacgaagtggggccggagaggacatatcaaggaacctttaggtacccatggccacatgaaatgcagctttgatgggaagctaaaatctcaagacacagtactgatgaacctgtataaacgagtcttccccaaatggacttatgatccatatgtaccagaaccagtaccctggctgaaaagtgagatttcttcaacagtgcctcaagggggcatggagtaatggattcaaagagattctgtcttaccggtgccagtcagtactccagggatgggaggcacaagttgtgattgggcaaagtttattttctatgtcagcctgtcagtccactgccccattttgcaagacttttttttagccttgacaaaatgtctcagttaagtataaaagtttttccactacttagtccaaaaaaaactattaaatcttaatgaaatagccactctccattaagaatctgataactaagagttgacaatactaggaaacaaaatgtcttcagtatctaaagacactgaattcccaccatttccttttctgtaaattaaacagaaacagactgataagaagctggcctttcagcctgcttcacccaagttatggaggaggttaagtctacatttccaccactgagcacaatacaaatgttctttacttctggggaaacagtttgaaaatgttgagacagcacagcagccactccaacaccagctgtaggttcaatgagtagtttcatcctctcccacaccagctgggttgcacactgttgatatggaagggagtaggaattagtgaaaggggagtctagttggtttacctataaagttcagatgagaatacgtgtccagtttgaattttcttatcactgtgtacacacgcttcccaaagcttttctttaattctgactctgcttctgtcaagagggttgtcattaatacatctagggtaccctcccatgtcatgaagttacctagtcaggttcccgtgggtcacttgctactcctaagggaagtttcttctgcctaagaagttacaccatgctttgctatttcttttcttgctggagcctcaccttaatttcatcctctgtgacagtgaagatatcatccacaaggtccctgataataggccaggtgttcaagccaatgctggatttgacaccatctgctatggtttctggaggataaagattgggcatcagtttccccttcagcttggactggtagcagtcatctgcatttgagggttcagcagcatataccttcacactaggtttcagagcctgggaagaggaatattaagacatcttaacaacaaaccacaacattgcctgcatgtctaaaagaaaatatgggcctggtgtggtggctcacacctgtaatcccaacactttgggagcccgaggcgggtggatcagctgaggtcaggagttcaagaccagcctggccaacctggtgaaatgcagtgtcaactaaaaataggaaaatcagccaggcgtggtggcagacccctgtaatcccagctactcaagaggctgaggtaggagaatcacttgaacttgggaggggtaggttgcagtgagctgagatcacaccaaaatggggtggggcgcagtggctcacgcctgtaatcccagcactttgggaggccgaggtgggcggatcacgaggtagggagatcaagaccatcctggctaacacggtgaaaccccgtctctactaaaaatacaaaaaaaaaaaa

SEQ ID NO: 32467 - DNA, 3923 bp, Homo sapiens
ggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtgaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataataaaaaaaaaaaaaaaaa

SEQ ID NO: 32468 - DNA, 3694 bp, Homo sapiens
ggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataataaaaaaaaaaaaaaaaaaaaaaaaa

SEQ ID NO: 32469 - DNA, 3813 bp, Homo sapiens
ggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataataaaaaaaaaaaaaaaaa

SEQ ID NO: 32470 - DNA, 3576 bp, Homo sapiens
ggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttgcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataataaaaaaaaaaaaaaaaa

SEQ ID NO: 32471 - DNA, 4641 bp, Homo sapiens
gcgagccgaagcgcgggaagcagctcttgtggatcctcagtggcggaggctcggtcacccggttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttgatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcattaataccttctaggggtttggttcatttggtttttgtcatgtgcaaggaaggacaatagtcctctttccaagtgtgttagcatagacttctctatatgtttctactagacctaggggatgacgtcttttaataatactggccctaaacatgtaaataatcttgtaggtgagactttttcttttgtgtttcggaaatttcctatgtggctttcagttgtctgtttgtatagcctggatttttttgaggtaaatgaaactttctcatttgtatatttggcttgatatggtcttaatattatctttccacgaaatggatatatttctagaaaatatatatttactaccataatttctaccaccacccccattttgctctgcattatacacagtagagaagaactgaagacactgctgtgacagtattgcagtccaaggcatcatgtgctcttggtgggatactctgattatcagcatcaacagtactttactgagcaagactttgaaggcctgagaagagagcaaagttatggaaagtatttaactcttattttatattgaacaaacaaggtttaatcatgtcatacatttttggttttctaagcagagactaatacaaatgcagccacataaaggcagtgtactgggggtgggagggaaggaaacaatcacataaaatcagctgactcaaaattgaggatagttaataggttgaaagggaaaaagtatgttgaaaatttagacataaatgaaccaagaatattccttatctggtgatgattaaagttaggaaaacatacattttttattttttaattagtagctgctatcagagacattatagcacagtggttatgagcacagattccaaagccagattacctaggttcggagacccgcttctctacctactactaatagttgggtcatgttgggccgg

SEQ ID NO: 32472 - DNA, 4734 bp, Homo sapiens
gcgagccgaagcgcgggaagcagctcttgtggatcctcagtggcggaggctcggtcacccggataggtaaaggaaaacatgcctgccacacggaagccaatgagatatgggcatacagagggacacacggaggtctgttttgatgattctgggagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttgatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcattaataccttctaggggtttggttcatttggtttttgtcatgtgcaaggaaggacaatagtcctctttccaagtgtgttagcatagacttctctatatgtttctactagacctaggggatgacgtcttttaataatactggccctaaacatgtaaataatcttgtaggtgagactttttcttttgtgtttcggaaatttcctatgtggctttcagttgtctgtttgtatagcctggatttttttgaggtaaatgaaactttctcatttgtatatttggcttgatatggtcttaatattatctttccacgaaatggatatatttctagaaaatatatatttactaccataatttctaccaccacccccattttgctctgcattatacacagtagagaagaactgaagacactgctgtgacagtattgcagtccaaggcatcatgtgctcttggtgggatactctgattatcagcatcaacagtactttactgagcaagactttgaaggcctgagaagagagcaaagttatggaaagtatttaactcttattttatattgaacaaacaaggtttaatcatgtcatacatttttggttttctaagcagagactaatacaaatgcagccacataaaggcagtgtactgggggtgggagggaaggaaacaatcacataaaatcagctgactcaaaattgaggatagttaataggttgaaagggaaaaagtatgttgaaaatttagacataaatgaaccaagaatattccttatctggtgatgattaaagttaggaaaacatacattttttattttttaattagtagctgctatcagagacattatagcacagtggttatgagcacagattccaaagccagattacctaggttcggagacccgcttctctacctactactaatagttgggtcatgttgggccgg

SEQ ID NO: 32473 - DNA, 3110 bp, Homo sapiens
gcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacggcagagtctccagagatttgggccgctacaaaaagtgcattttgcccattcggctgtggatagagaagcaggaagagcactggacttggagtcagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttaaaaaa

SEQ ID NO: 32474 - DNA, 3015 bp, Homo sapiens
gcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttaaaaaa

SEQ ID NO: 32475 - DNA, 3303 bp, Homo sapiens
gcctaacttgcgcgctgagatttccggcgtgggagcagaggtctgagtcttgcgtgggtcctctatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagagggcattatctgctccctggctttctctttttcctcctgaagggaacatggaagacaaggagatgactgggccccagttgcctgagagcttagaggacgtggcaatgtacatctcccaggaggagtgggggcatcaggatcctagtaagagggccctctccagggacacggtgcaggagagttatgagaatgtggactcactggagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagactggttgtgagttgcagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaaaaaaaaaaaaaaaaaaaa

SEQ ID NO: 32476 - DNA, 3669 bp, Homo sapiens
gccagtttctgcagtggaggtcgcgactgagggacgggacagagaagtcgcgaaagtgggccagaggttctgcgacaccacctcgggtgagctgcgccaggcccgggatagggactgttgtgttcgaatgcccgccccggtcggccgccgctccccgcctagtccacggagctcaatggcggcagtcgcgctgagggactcggctcagggtatgacctttgaggatgtggccatttatttctcccaagaagagtgggagctccttgatgagtctcagaggttcctgtactgcgatgtgatgctggagaactttgcacatgtaacatccctgggttattgccatggaatggagaatgaggcgatagcttctgagcagagtgtatctatacaggtcaggacttctaagggcaatacacccacccagaaaactcacctcagtgagattaagatgtgtgtcccagtcttgaaagacattttgcctgcggctgagcaccaaaccacatcccctgtgcaaaagtcatacttgggtagcacaagcatgagaggcttctgcttcagtgctgaccttcaccagcatcaaaagcattacaatgaagaagagccctggaaaaggaaggtggatgaggctacatttgtgaccggctgcagattccatgtgttgaattatttcacctgtggggaggccttcccagcccccacggacctactccaacacgaagccactcccagtggtgaggagccacacagtagcagcagcaagcatatacaggcatttttcaatgcaaaaagttattacaagtggggtgaatacagaaaagcttcaagccacaaacacacacttgttcagcatcagagtgtctgttctgaaggagggctttatgagtgtagcaaatgtgagaaagccttcacttgcaagaacacacttgttcagcaccagcaaattcacactggacaaaagatgtttgagtgtagtgaatgtgaggaatcctttagcaaaaagtgccacctaatcttacacaagataattcacactggagaaaggccttatgaatgcagtgatcgtgagaaagcctttatccataaatctgaattcattcaccaccagagacgtcacactggaggagtgcgtcatgagtgtggtgaatgtaggaaaacctttagctacaaatctaacctcattgaacaccagagagttcacactggagaaaggccttatgaatgtggcgagtgcgggaaatcctttagacaaagctctagcctttttcgacaccagagagttcactctggagaaaggccttatcagtgctgtgagtgtgggaaatcctttagacaaatcttcaatctcattcgacatagaagagttcacactggagaaatgccttatcagtgcagtgattgtgggaaatcttttagctgcaaatcggaactcattcaacaccagagaattcacagtggagaaagaccttatgaatgcagagaatgtgggaaatcctttagacaattctctaacctcattcgacaccgcagcattcacactggtgataggccttatgagtgcagtgaatgtgagaaatcctttagccgcaaatttatcctgattcaacaccaaagagttcacactggagaaagaccttatgaatgcagtgaatgtggaaaatcctttacccgcaaatctgacctcattcaacaccggagaattcatactggcacaagaccttatgagtgcagtgaatgtggcaaatcttttagacagcgctctggcctcattcagcaccggagacttcatactggagaaaggccttatgaatgtagtgaatgtggaaagtcttttagccaaagtgctagcctcattcaacaccagagagttcacactggagaaaggccttatgaatgtagtgaatgtgggaaatcctttagccagagctctagcctcattcaacaccagagaggtcacactggagaaagaccttatgagtgcagtcaatgtgggaaaccctttacccacaaatcagaccttattcagcaccaaagagttcacactggagaaaggccttatgaatgcagtgaatgtgggaaatcctttagccgcaaatctaacctcattcgacatcggagagttcacactgaagaaaggccttaaatgtgaagggaatgtgctatttctttattcagtataatagcactggaggagactgtggtagccatcttcgtaaatttaaactttgagcacccacagtggggtattcttcataagtttcaggtatgtgggaagctctgaggaggttcattgtaatttctaatctgccgaggcctatagcctgatttatgtcactgccaatttctgaggctgaagccatttcacatttcacccctaccacctggcaggtgcacaccatgtgcatgagtcacttccccacagtgctcagagaagcaaacctctgtactctcccatttgcttggggaaattattaatagcccaagcatgtagggtcttcatgtcttttctctgactttagagtatacacctgacccagttgtggtccagagaatctgagttgtgctgtcagctttctaaggattacctttttaaggaacattgtcggtctcacatgatgcttgtaatgaatttttccacattctgattcaccagcctggaaactgcttggtgcacattgctttaatttataatgtttttataaaggttttaaaaaaatttacgcacctttaatcttgggtgttctattcattgcatagaatgacttgtaagcagaatagtgatgtcagcatgaaggggtgaatagattttgtggagatctcaaactttctgtactcagaagggacaatgtgatggcagaagacagctctttgttctgtattgctctaattggcctgctgcccaaggcctcaaagtaaagactgccaggctttgtgttcctgtattgtggcctggtgccatttttgtcaggtcagaggtcaccatgaaaaggaggcagttgtgacaatccccagtgcttctgtgaacgtgaattttgttcagttgtccacaggagatccacataattcctagcactggtgaggggaatctgttgcccaggtcctgcaaaggagccatgtgccatggcatataagtcagtgtagactggtgccatttgttgtcagactataggtgtggaggtgaaattacaggttcaacagtaattgggacagaaactccaggtaaatggggagtggagaagactgcagtaaattagatggaatgactcttctaaaagttcatctacaaattttccagtgaatatggttgtgtaggatcagtgcatacagaaattctcaggatcttctgtttactatcgctgagatcattatcagaaaatagtctggccgggcatggtgtaatcctaacactttgggaggccaaggcgggcggattgcctgagctcaggagttcaagaccagcctgggcaacatggtgaaatcccatgtctactaaaatacaaaaaattagccaggcgtggcagcatgcgcctatagtcccagccacttgggaggctgaggcaggagaatcgcttgaacccagaaggcggaagttgcagtgagctgagattgcaccactgcactccagcccaggcaacagagtgagactccgtctccaaaaaaaaaaaaaaaaaa

SEQ ID NO: 32477 - DNA, 1546 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacatttaaaaaaaaaaaaaaaaaaaaaaaaaaa

SEQ ID NO: 32478 - DNA, 2002 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggtatgtacaagatgagagcgagcctttcagaagccagggtctggtcctggctcctcttactgagatacagggcagcattggcagagagcagacttaaggaaacctgtaaggaggtaaggatgttccctgtctctgccctccctctgagcaggactctcagaagaaagacaagctgctctgcagccagcttcaggtagcggatttcctgcagaacatcctggctcaggaggacactgctaagggtctcgaccccttggcttctgaagacacgagccgtgagtaggcaggggattgtagtagcagctgacctgagtggggaaggaaggaggatttcagttaggtctcccatttggctgatgggaaggaggcccagtgttgcagggaggcaggctagcaggccaccctcactcatgtactcattcctggtggctcatctcaggacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacagggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacatttaaaaaaaaaaaaaaaaaaaaaaaaaaa

SEQ ID NO: 32479 - DNA, 1687 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacagggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacatttaaaaaaaaaaaaaaaaaaaaaaaaaaa

SEQ ID NO: 32480 - DNA, 1878 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacagggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggtcagacccaactcaggccttggtgtccctggactgcaagtgtggaaggagggaaagcctggtttacctctctctgcatctgagctctgctacccatggagcagatggatggtgggaacaggaaagagcttatgttacacctcattcccatgcttagcccacccagagctaacccctgtcttcttccccaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacatttaaaaaaaaaaaaaaaaaaaaaaaaaaa

SEQ ID NO: 32481 - protein, 1075 aa, Homo sapiens
MRGGKCNMLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 32482 - protein, 2316 aa, Homo sapiens
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGHVYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACPGTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAETEESTEGPSATEVPSASEEPSPSEVPFPSEEPSPSEEPFPSVRPFPSVELFPSEEPFPSKEPSPSEEPSASEEPYTPSPPEPSWTELPSSGEESGAPDVSGDFTGSGDVSGHLDFSGQLSGDRASGLPSGDLDSSGLTSTVGSGLTVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGVPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGVSGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTATTYKRRLQKRSSRHPRRSRPSTAH

SEQ ID NO: 32483 - protein, 2415 aa, Homo sapiens
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGHVYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACPGTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAETEESTEGPSATEVPSASEEPSPSEVPFPSEEPSPSEEPFPSVRPFPSVELFPSEEPFPSKEPSPSEEPSASEEPYTPSPPEPSWTELPSSGEESGAPDVSGDFTGSGDVSGHLDFSGQLSGDRASGLPSGDLDSSGLTSTVGSGLTVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGVPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGVSGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDVSGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLASATPTASGDRTEISGDLSGHTSQLGVVISTSIPESEWTQQTQRPAETHLEIESSSLLYSGEETHTVETATSPTDASIPASPEWKRESESTAAAPARSCAEEPCGAGTCKETEGHVICLCPPGYTGEHCNIDQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPRITCTDPTTYKRRLQKRSSRHPRRSRPSTAH

SEQ ID NO: 32484 - protein, 324 aa, Homo sapiens
MFCGDYVQGTIFPAPNFNPIMDAQMLGGALQGFDCDKDMLINILTQRCNAQRMMIAEAYQSMYGRDLIGDMREQLSDHFKDVMAGLMYPPPLYDAHELWHAMKGVGTDENCLIEILASRTNGEIFQMREAYCLQYSNNLQEDIYSETSGHFRDTLMNLVQGTREEGYTDPAMAAQDAMVLWEACQQKTGEHKTMLQMILCNKSYQQLRLVFQEFQNISGQDMVDAINECYDGYFQELLVAIVLCVRDKPAYFAYRLYSAIHDFGFHNKTVIRILIARSEIDLLTIRKRYKERYGKSLFHDIRNFASGHYKKALLAICAGDAEDY

SEQ ID NO: 32485 - protein, 1261 aa, Homo sapiens
MIAHKQKKTKKKRAWASGQLSTDITTSEMGLKSLSSNSIFDPDYIKELVNDIRKFSHMLLYLKEAIFSDCFKEVIHIRLEELLRVLKSIMNKHQNLNSVDLQNAAEMLTAKVKAVNFTEVNEENKNDLFQEVFSSIETLAFTFGNILTNFLMGDVGNDSLLRLPVSRETKSFENVSVESVDSSSEKGNFSPLELDNVLLKNTDSIELALSYAKTWSKYTKNIVSWVEKKLNLELESTRNMVKLAEATRTNIGIQEFMPLQSLFTNALLNDIESSHLLQQTIAALQANKFVQPLLGRKNEMEKQRKEIKELWKQEQNKMLEAENALKKAKLLCMQRQDEYEKAKSSMFRAEEEHLSSSGGLAKNLNKQLEKKRRLEEEALQKVEEANELYKVCVTNVEERRNDLENTKREILAQLRTLVFQCDLTLKAVTVNLFHMQHLQAASLADSLQSLCDSAKLYDPGQEYSEFVKATNSTEEEKVDGNVNKHLNSSQPSGFGPANSLEDVVRLPDSSNKIEEDRCSNSADITGPSFIRSWTFGMFSDSESTGGSSESRSLDSESISPGDFHRKLPRTPSSGTMSSADDLDEREPPSPSETGPNSLGTFKKTLMSKAALTHKFRKLRSPTKCRDCEGIVVFQGVECEECLLVCHRKCLENLVIICGHQKLPGKIHLFGAEFTQVAKKEPDGIPFILKICASEIENRALCLQGIYRVCGNKIKTEKLCQALENGMHLVDISEFSSHDICDVLKLYLRQLPEPFILFRLYKEFIDLAKEIQHVNEEQETKKNSLEDKKWPNMCIEINRILLKSKDLLRQLPASNFNSLHFLIVHLKRVVDHAEENKMNSKNLGVIFGPSLIRPRPTTAPITISSLAEYSNQARLVEFLITYSQKIFDGSLQPQDVMCSIGVVDQGCFPKPLLSPEERDIERSMKSLFFSSKEDIHTSESESKIFERATSFEESERKQNALGKCDACLSDKAQLLLDQEAESASQKIEDGKTPKPLSLKSDRSTNNVERHTPRTKIRPVSLPVDRLLLASPPNERNGRNMGNVNLDKFCKNPAFEGVNRKDAATTVCSKFNGFDQQTLQKIQDKQYEQNSLTAKTTMIMPSALQEKGVTTSLQISGDHSINATQPSKPYAEPVRSVREASERRSSDSYPLAPVRAPRTLQPQHWTTFYKPHAPIISIRGNEEKPASPSAAVPPGTDHDPHGLVVKSMPDPDKASACPGQATGQPKEDSEELGLPDVNPMCQRPRLKRMQQFEDLEDEIPQFV

SEQ ID NO: 32486 - protein, 213 aa, Homo sapiens
MAAPAVSGLSRQVRCFSTSVVRPFAKLVRPPVQVYGIEGRYATALYSAASKQNKLEQVEKELLRVAQILKEPKVAASVLNPYVKRSIKVKSLNDITAKERFSPLTTNLINLLAENGRLSNTQGVVSAFSTMMSVHRGEVPCTVTSASPLEEATLSELKTVLKSFLSQGQVLKLEAKTDPSILGGMIVRIGEKYVDMSVKTKIQKLGRAMREIV

SEQ ID NO: 32487 - protein, 233 aa, Homo sapiens
MEPTAPSLTEEDLTEVKKDALENLRVYLCEKIIAERHFDHLRAKKILSREDTEEISCRTSSRKRAGKLLDYLQENPKGLDTLVESIRREKTQNFLIQKITDEVLKLRNIKLEHLKGLKCSSCEPFPDGATNNLSRSNSDESNFSEKLRASTVMYHPEGESSTTPFFSTNSSLNLPVLEVGRTENTIFSSTTLPRPGDPGAPPLPPDLQLEEEGTCANSSEMFLPLRSRTVSRQ

SEQ ID NO: 32488 - protein, 340 aa, Homo sapiens
MDSELMHSIVGSYHKPPERVFVPSFTQNEPSQNCHPANLEVTSPKILHSPNSQALILALKTLQEKIHCLELERTQAEDDLNILSREAAQYKKALENETNERNLAHQELIKQKKDVSIQLSSAQSRCTLLEKQLEYTKRMVLNVEREKNMILEQQAQLQREKEQDQMKLYAKLDKLDVLEKECFRLTTTQKTAEDKIKHLEEKLKEEEHQRKLFQDKASELQTGLEISKIMSSVSNLKHSKEKKKSSKKTKCIKRGPPWQICSKFGALPFVAEKMRQHRDPHILQKPFNVTETRCLPKPSRTTAWCKAITPDSEKSISICDNLSELLMAMQDELDQMSMEH

SEQ ID NO: 32489 - protein, 340 aa, Homo sapiens; identical to SEQ ID NO: 32488

SEQ ID NO: 32490 - protein, 2779 aa, Homo sapiens
MQGDLKTTDISIEPPSAQLEVQAGQVDLKLPEGHVPEGAGLKGHLPKLQMPSFKMPKVDRKGPQIDVKGPKLDLKGPKTDVTAPDVEVSQPGMEVDVEAPGAKLDGARLEGDLSLADKDVTAKDSKFKMPKFKMPSFGVSAPGKSIEVLVDVSAPKVEADLSLPSMQGDLKNTDISIEPPSAQLEVQAGQVDVKLPEGHVLEGAGLKGHLPKLQMPSFKMPKVDRKGPQIDIKGPKLDLKGPKMDVTAPDVEVSQPSMEVDVEAPGAKLDGARLEGDLSLADKDVTAKDSKFKMPKFKMPSYRASAPGKSIQASVDVSAPKAEADVSLPSMQGDLKTTDLSIQLPSVDLEVQAGQVDVKLPEGHVPEGAGLKGHLPKVEMPSFKMPKVDLKSPQVDIKGPKLDLKVPKAEVTVPDVEVSLPSVEVDVQAPRAKLDGARLEGDLSLAEKDVTAKDSKFKMPKFKMPSFGVSAPGRSIEASLDVSAPKVEADVSLSSMQGDLKATDLSIQPPSADLEVQAVQVDVELLEGPVPEGAGLKGHLPKVEMPSLKTPKVDLKGPQIDVKGPKLDLKGPKAEVRVPDVEVSLPSVEVDVQAPKAKLDAGRLEGDLSLADKDVTAKDSKFKMPKFKMPSFRVSAPGKSMEASVDVSAPKVEADVSLPSMQGDLKTTDLSIQPPSADLKVQAGQMDVKLPEGQVPEGAGLKEHLPKVEMPSLKMPKVDLKGPQVDIKGPKLDLKVSKAEVTAPDVEVSLPSVEVDVQAPRAKLDSAQLEGDLSLADKDVTAKDSKFKMPKFKMPSFGVSAPGKSIEASVHVSAPKVEADVSLPSMQGDLKTTDLSIQPHSADLTVQARQVDMKLLEGHVPEEAGLKGHLPKVQMPSFKMPKVDLKGPEIDIKGPKLDLKDPKVEVTAPDVEVSLPSVEVDVEAPGAKLDGARLEGDLSLADKDMTAKDSKFKMPKFKMPSFGVSAPGKSMEASVDVTAPKVEADVSLPSMQGDLKATDLSVQPPSADLEVQAGQVDVKLPEGPVPEGASLKGHLPKVQMPSFKMPKVDLKGPQIDVKGPKLDLKGPKAEVTAPDVKMSLSSMEVDVQAPRAKLDGVQLEGDLSLADKDVTAKDSKFKMPKFKMPSFGVSAPGKSMEASVDVSELKAKADVSLPSMQGDLKTTDLSIQSPSADLEVQAGQVDVKLPEGPLPKGAGLKGHLPKVQMPCLKMPKVALKGPQVDVKGPKLDLKGPKADVMTPVVEVSLPSMEVDVEAPGAKLDSVRLEGDLSLADKDMTAKDSKFKMPKFKMPSFGVSAPGKSIEASLDVSALKVEADVSLPSMQGDLKTTHLSIQPPSADLEVQAGQEDVKLPEGPVHEGAGLKGHLPKLQMPSFKVPKVDLKGPQIDVNVPKLDLKGPKVEVTSPNLDVSLPSMEVDIQAPGAKLDSTRLEGDLSLADKDVTAKDSKFKMPKFKMPSFGMLSPGKSIEVSVDVSAPKMEADMSIPSMQGDLKTTDLRIQAPSADLEVQAGQVDLKLPEGHMPEVAGLKGHLPKVEMPSFKMPKVDLKGPQVDVKGPKLDLKGPKAEVMAPDVEVSLPSVETDVQAPGSMLDGARLEGDLSLAHEDVAGKDSKFQGPKLSTSGFEWSSKKVSMSSSEIEGNVTFHEKTSTFPIVESVVHEGDLHDPSRDGNLGLAVGEVGMDSKFKKLHFKVPKVSFSSTKTPKDSLVPGAKSSIGLSTIPLSSSECSSFELQQVSACSEPSMQMPKVGFAGFPSSRLDLTGPHFESSILSPCEDVTLTKYQVTVPRAALAPELALEIPSGSQADIPLPKTECSTDLQPPEGVPTSQAESHSGPLNSMIPVSLGQVSFPKFYKPKFVFSVPQMAVPEGDLHAAVGAPVMSPLSPGERVQCPLPSTQLPSPGTCVSQGPEELVASLQTSVVAPGEAPSEDADHEGKGSPLKMPKIKLPSFRWSPKKETGPKVDPECSVEDSKLSLVLDKDEVAPQSAIHMDLPPERDGEKGRSTKPGFAMPKLALPKMKASKSGVSLPQRDVDPSLSSATAGGSFQDTEKASSDGGRGGLGATASATGSEGVNLHRPQVHIPSLGFAKPDLRSSKAKVEVSQPEADLPLPKHDLSTEGDSRGCGLGDVPVSQPCGEGIAPTPEDPLQPSCRKPDAEVLTVESPEEEAMTKYSQESWFKMPKFRMPSLRRSFRDRGGAGKLEVAQTQAPAATGGEAAAKVKEFLVSGSNVEAAMSLQLPEADAEVTASESKSSTDILRCDLDSTGLKLHLSTAGMTGDELSTSEVRIHPSKGPLPFQMPGMRLPETQVLPGEIDETPLSKPGHDLASMEDKTEKWSSQPEGPLKLKASSTDMPSQISVVNVDQLWEDSVLTVKFPKLMVPRFSFPAPSSEDDVFIPTVREVQCPEANIDTALCKESPGLWGASILKAGAGVPGEQPVDLNLPLEAPPISKVRVHIQGAQVESQEVTIHSIVTPEFVDLSVPRTFSTQIVRESEIPTSEIQTPSYGFSLLKVKIPEPHTQARVYTTMTQHSRTQEGTEEAPIQATPGVDSISGDLQPDTGEPFEMISSSVNVLGQQTLTFEVPSGHQLADSCSDEEPAEILEFPPDDSQEATTPLADEGRAPKDKPESKKSGLLWFWLPNIGFSSSVDETGVDSKNDVQRSAPIQTQPEARPEAELPKKQEKAGWFRFPKLGFSSSPTKKSKSTEDGAELEEQKLQEETITFFDARESFSPEEKEEGELIGPVGTGLDSRVMVTSAARTELILPEQDRKADDESKGSGLGPNEG

SEQ ID NO: 32491 - protein, 2779 aa, Homo sapiens; identical to SEQ ID NO: 32490

SEQ ID NO: 32492 - protein, 793 aa, Homo sapiens
MDLPPERDGEKGRSTKPGFAMPKLALPKMKASKSGVSLPQRDVDPSLSSATAGGSFQDTEKASSDGGRGGLGATASATGSEGVNLHRPQVHIPSLGFAKPDLRSSKAKVEVSQPEADLPLPKHDLSTEGDSRGCGLGDVPVSQPCGEGIAPTPEDPLQPSCRKPDAEVLTVESPEEEAMTKYSQESWFKMPKFRMPSLRRSFRDRGGAGKLEVAQTQAPAATGGEAAAKVKEFLVSGSNVEAAMSLQLPEADAEVTASESKSSTDILRCDLDSTGLKLHLSTAGMTGDELSTSEVRIHPSKGPLPFQMPGMRLPETQVLPGEIDETPLSKPGHDLASMEDKTEKWSSQPEGPLKLKASSTDMPSQISVVNVDQLWEDSVLTVKFPKLMVPRFSFPAPSSEDDVFIPTVREVQCPEANIDTALCKESPGLWGASILKAGAGVPGEQPVDLNLPLEAPPISKVRVHIQGAQVESQEVTIHSIVTPEFVDLSVPRTFSTQIVRESEIPTSEIQTPSYGFSLLKVKIPEPHTQARVYTTMTQHSRTQEGTEEAPIQATPGVDSISGDLQPDTGEPFEMISSSVNVLGQQTLTFEVPSGHQLADSCSDEEPAEILEFPPDDSQEATTPLADEGRAPKDKPESKKSGLLWFWLPNIGFSSSVDETGVDSKNDVQRSAPIQTQPEARPEAELPKKQEKAGWFRFPKLGFSSSPTKKSKSTEDGAELEEQKLQEETITFFDARESFSPEEKEEGELIGPVGTGLDSRVMVTSAARTELILPEQDRKADDESKGSGLGPNEG

SEQ ID NO: 32493 - protein, 174 aa, Homo sapiens
MATVAELKAVLKDTLEKKGVLGHLKARIRAEVFNALDDDREPRPSLSHENLLINELIREYLEFNKYKYTASVLIAESGQPVVPLDRQFLIHELNAFEESKDNTIPLLYGILAHFLRGTKDGIQNAFLKGPSLQPSDPSLGRQPSRRKPMDDHLRKEEQKSTNIEDLHVSQAVNR

SEQ ID NO: 32494 - protein, 344 aa, Homo sapiens
MDSYSAPESTPSASSRPEDYFIGATPLQKRLESVRKQSSFILTPPRRKIPQCSQLQEDVDPQKVAFLLHKQWTLYSLTPLYKFSYSNLKEYSRLLNAFIVAEKQKGLAVEVGEDFNIKVIFSTLLGMKGTQRDPEAFLVQIVSKSQLPSENREGKVLWTGWFCCVFGDSLLETVSEDFTCLPLFLANGAESNTAIIGTWFQKTFDCYFSPLAINAFNLSWMAAMWTACKMDHYVATTEFLWSVPCSPQSLDISFAIHPEDAKALWDSVHKTPGEVTQEEVDLFMDCLYSHFHRHFKIHLSATRLVRVSTSVASAHTDGKIKILCHKYLIGVLAYLTELAIFQIE

SEQ ID NO: 32495 - protein, 75 aa, Homo sapiens
MAGQEDPVQREIHQDWANREYIEIITSSIKKIADFLNSFDMSCRSRLATLNEKLTALERRIEYIEARVTKGETLT

SEQ ID NO: 32496 - protein, 104 aa, Homo sapiens
MAANSSGQGFQNKNRVAILAELDKEKRKLLMQNQSSTNHPGASIALSRPSLNKDFRDHAEQQHIAAQQKAALQHAHAHSSGYFITQDSAFGNLILPVLPRLDPE

SEQ ID NO: 32497 - protein, 297 aa, Homo sapiens
MSTAFFFYALFSFWRPHYPIMSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQVHQERLYQEYNFSKAEGHLKQMEKIYTQQIQSKDVELTSMKGEVTSMKKVLEEYKKKFSDISEKLMERNRQYQKLQGLYDSLRLRNITIANHEGTLEPSMIAQSGVLGFPLGNNSKFPLDNTPVRNRGDGDGDFQFRPFFAGSPTAPEPSNSFFSFVSPSRELEQQQVSSRAFKVKRI

SEQ ID NO: 32498 - protein, 277 aa, Homo sapiens
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQVHQERLYQEYNFSKAEGHLKQMEKIYTQQIQSKDVELTSMKGEVTSMKKVLEEYKKKFSDISEKLMERNRQYQKLQGLYDSLRLRNITIANHEGTLEPSMIAQSGVLGFPLGNNSKFPLDNTPVRNRGDGDGDFQFRPFFAGSPTAPEPSNSFFSFVSPSRELEQQQVSSRAFKVKRI

SEQ ID NO: 32499 - protein, 277 aa, Homo sapiens; identical to SEQ ID NO: 32498

SEQ ID NO: 32500 - protein, 277 aa, Homo sapiens; identical to SEQ ID NO: 32498

SEQ ID NO: 32501 - protein, 464 aa, Homo sapiens
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQYKSSADKMQQLNAAHQEALMKLERLDSVPVEEQEEFKQLSDGIQELQQSLNQDFHQKTIVLQEGNSQKKSNISEKTKRLNELKLLVVSLKEIQESLKTKIVDSPEKLKNYKEKMKDTVQKLKNARQEVVEKYEIYGDSVDCLPSCQLEVQLYQKKIQDLSDNREKLASILKESLNLEDQIESDESELKKLKTEENSFKRLMIVKKEKLATAQFKINKKHEDVKQYKRTVIEDCNKVQEKRGAVYERVTTINQEIQKIKLGIQQLKDAAEREKLKSQEIFLNLKTALEKYHDGIEKAAEDSYAKIDEKTAELKRKMFKMST

SEQ ID NO: 32502 - protein, 464 aa, Homo sapiens; identical to SEQ ID NO: 32501

SEQ ID NO: 32503 - protein, 156 aa, Homo sapiens
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 32504 - protein, 173 aa, Homo sapiens
MGRGRCVGPSLQLRGQEWRCSPLVPKGGAAAAELGPGGGENMVRRFLVTLRIRRACGPPRVRVFVVHIPRLTGEWAAPGAPAAVALVLMLLRSQRLGQQPLPRRPGHDDGQRPSGGAAAAPRRGAQLRRPRHSHPTRARRCPGGLPGHAGGAAPGRGAAGRARCLGPSARGPG

SEQ ID NO: 32505 - protein, 116 aa, Homo sapiens
MEPAAGSSMEPSADWLATAAARGRVEEVRALLEAGALPNAPNSYGRRPIQVGRRSAAGAGDGGRLWRTKFAGELESGSASILRKKGRLPGEFSEGVCNHRPPPGDALGAWETKEEE

SEQ ID NO: 32506 - protein, 253 aa, Homo sapiens
MALSMPLNGLKEEDKEPLIELFVKAGSDGESIGNCPFSQRLFMILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAKRLTK

SEQ ID NO: 32507 - protein, 421 aa, Homo sapiens
MRWILFIGALIGSSICGQEKFFGDQVLRINVRNGDEISKLSQLVNSNNLKLNFWKSPSSFNRPVDVLVPSVSLQAFKSFLRSQGLEYAVTIEDLQALLDNEDDEMQHNEGQERSSNNFNYGAYHSLEAIYHEMDNIAADFPDLARRVKIGHSFENRPMYVLKFSTGKGVRRPAVWLNAGIHSREWISQATAIWTARKIVSDYQRDPAITSILEKMDIFLLPVANPDGYVYTQTQNRLWRKTRSRNPGSSCIGADPNRNWNASFAGKGASDNPCSEVYHGPHANSEVEVKSVVDFIQKHGNFKGFIDLHSYSQLLMYPYGYSVKKAPDAEELDKVARLAAKALASVSGTEYQVGPTCTTVYPASGSSIDWAYDNGIKFAFTFELRDTGTYGFLLPANQIIPTAEETWLGLKTIMEHVRDNLY

SEQ ID NO: 32508 - protein, 745 aa, Homo sapiens
MSLKPRVVDFDETWNKLLTTIKAVVMLEYVERATWNDRFSDIYALCVAYPEPLGERLYTETKIFLENHVRHLHKRVLESEEQVLVMYHRYWEEYSKGADYMDCLYRYLNTQFIKKNKLTEADLQYGYGGVDMNEPLMEIGELALDMWRKLMVEPLQAILIRMLLREIKNDRGGEDPNQKVIHGVINSFVHVEQYKKKFPLKFYQEIFESPFLTETGEYYKQEASNLLQESNCSQYMEKVLGRLKDEEIRCRKYLHPSSYTKVIHECQQRMVADHLQFLHAECHNIIRQEKKNDMANMYVLLRAVSTGLPHMIQELQNHIHDEGLRATSNLTQENMPTLFVESVLEVHGKFVQLINTVLNGDQHFMSALDKALTSVVNYREPKSVCKAPELLAKYCDNLLKKSAKGMTENEVEDRLTSFITVFKYIDDKDVFQKFYARMLAKRLIHGLSMSMDSEEAMINKLKQACGYEFTSKLHRMYTDMSVSADLNNKFNNFIKNQDTVIDLGISFQIYVLQAGAWPLTQAPSSTFAIPQELEKSVQMFELFYSQHFSGRKLTWLHYLCTGEVKMNYLGKPYVAMVTTYQMAVLLAFNNSETVSYKELQDSTQMNEKELTKTIKSLLDVKMINHDSEKEDIDAESSFSLNMNFSSKRTKFKITTSMQKDTPQEMEQTRSAVDEDRKMYLQAAIVRIMKARKVLRHNALIQEVISQSRARFNPSISMIKKCIEVLIDKQYIERSQASADEYSYVA

SEQ ID NO: 32509 - protein, 121 aa, Homo sapiens
MVQIVISSARAGGLAEWVLMELQGEIEARYSTGLAGNLLGDLHYTTEGIPVLIVGHHILYGKIIHLEKPFAVLVKHTPGDQDCDELGRETGTRYLVTALIKDKILFKTRPKPIITSVPKKV

SEQ ID NO: 32510 - protein, 4523 aa, Homo sapiens
MAAQVAAREARDFREAPTLRLTSGAGLEAVGAVELEEEEENEEEAAARRARSFAQDARVRFLGGRLAMMLGFTEEKWSQYLESEDNRQVLGEFLESTSPACLVFSFAASGRLAASQEIPRDANHKLVFISKKITESIGVNDFSQVVLFGELPALSLGHVSAFLDEILVPVLSNKNNHKSWSCFTSQDMEYHIEVMKKKMYIFRGKMSRRTLLPIPTVAGKMDLDQNCSENKPPSNERIILHAIESVVIEWSHQIQEIIERDSVQRLLNGLHLSPQAELDFWMMRRENLSCIYDQLQAPVVLKMVKILTTKQSSYFPTLKDIFLAVENALLEAQDVELYLRPLRRHIQCLQETEFPQTRILIAPLFHTICLIWSHSKFYNTPARVIVLLQEFCNLFINQATAYLSPEDLLRGEIEESLEKVQVAVNILKTFKNSFFNYRKKLASYFMGRKLRPWDFQSHLVFCRFDKFLDRLIKIEDIFATTLEFEKLERLEFGGTKGAILNGQVHEMSEELMELCKLFKQSTYDPSDCTNMEFESDYVAFKSKTLEFDRRLGTIICEAFFNCNGLEAAFKLLTIFGNFLEKPVVMEIFSLHYSTLVHMFNTELDVCKQLYNEHMKQIECGHVVLNKNMPFTSGNMKWAQQVLQRLQMFWSNFASLRYLFLGNPDHALVYQKYVEMTTLLDQFESRIYNEWKSNVDEICEFNLNQPLVKFSAINGLLCVNFDPKLVAVLREVKYLLMLKKQDIPDSALAIFKKRNTILKYIGNLDLLVQGYNKLKQTLLEVEYPLIEDELRAIDEQLTAATTWLTWQDDCWGYIERVRAATSELEHRVERTQKNVKVIQQTMRGWARCVLPPRREHRREAAFTLEDKGDLFTKKYKLIQGDGCKIHNLVEENRKLFKANPSLDTWKIYVEFIDDIVVEGFFQAIMHDLDFFLKNTEKQLKPAPFFQAQMILLPPEIVFKPSLDREAGDGFYDLVEEMLCNSFRMSAQMNRIATHLEIKNYQNDMDNMLGLAEVRQEIMNRVVNVINKVLDFRNTLETHTYLWVDDRAEFMKHFLLYGHAVSSDEMDAHANEEIPEQPPTLEQFKEQIDIYEALYVQMSKFEDFRVFDSWFKVDMKPFKVSLLTIIKKWSWMFQEHLLRFVIDSLNELQEFIKETDSGLQRELNEGDHDGLVDIMVHLLAVRSRQRATDELFEPLKETITLLESYGQKMPEQVYIQLEELPERWETTKKIAATVRHEVSPLHNAEVTLIRKKCILFDAKQAEFRERFRHYAPLGFNAENPYTALDKANEELEALEEEMLQMQESTRLFEVALPEYKQMKQCRKEIKLLKGLWDVIIYVRRSIDNWTKTQWRQIHVEQMDVELRRFAKASSITEIWSLNKEVRVWDAYTGLEGTVKDMTASLRAITELQSPALRDRHWHQLMKAIGVKFLINEATTLADLLALRLHRVEDDVRRIVDKAVKELGTEKVITEISQTWATMKFSYEVHYRTGIPLLKSDEQLFETLEHNQVQLQTLLQSKYVEYFIEQVLSWQNKLNIADLVIFTWMEVQRTWSHLESIFVCSEDIRIQLVKDARRFDGVDAEFKELMFKTAKVENVLEATCRPNLYEKLKDLQSRLSLCEKALAEYLETKRIAFPRFYFVSSADLLDILSKGAQPKQVTCHLAKLFDSIADLQFEDNQDVSAHRAVGMYSKEKEYVPFQAECECVGHVETWLLQLEQTMQETVRHSITEAIVAYEEKPRELWIFDFPAQVALTSSQIWWTTDVGIAFSRLEEGYETALKDFHKKQISQLNTLITLLLGELPPGDRQKIMTICTIDVHARDVVAKLISQKQVVVSPQAFTWLSQLRHRWEDTQKHCFVNICDAQFQYFYEYLGNSPRLVITPLTDRCYITLTQSLHLTMSGAPAGPAGTGKTETTKDLGRALGMMVYVFNCSEQMDYKSIGNIYKGLVQTGAWGCFDEFNRISVEVLSVVAVQVKMIHDAIRNRKKRFVFLGEAITLKPSVGIFITMNPGYAGRTELPENLKALFRPCAMVAPDIELICEILLVAEGFVDARALARKFITLYTLCKELLSKQDHYDWGLRAIKSVLVVAGSLKRGDKNRPEDQVLMRALRDFNMPKIVTDDIPVFLGLVGDLFPALDVPRRRKLHFEQMVRQSTLELRLQPEESFILKVVQLEELLAVRHSVFVVGNAGTGKSKILRTLNRTYVNMKQKPVWNDLNPKAVTTDELFGFIHHATREWKDGKIVYSYFIGLFSSILREQANLKHDGPKWIVLDGDIDPMWIESLNTVMDDNKVLTLASNERIALTPFMRLLFEIHHLRSATPATVSRAGILYVNPQDLGWNPYVASWIDRRRHQSEKANLTILFDKYVPACLDKLRTSFKTITSIPESSLVQTLCVLLECLLTPENVPSDSPKEVYEVYFVFACIWAFGGTLLQDQISDYQADFSRWWQKEMKAVKFPSQGTIFDYYVDHKTKKLLPWADKIAQFTMDPDVPLQTVLVHTTETARLRYFMELLLEKGKPLMLVGNAGVGKTVFVGDTLASLSEDYIVSRVPFNYYTTSTALQKILEKPLEKKAGHNYGPGGNKKLIYFIDDMNMPEVDLYGTVQPHTLIRQHIDYGHWYDRQKVMLKEIHNCQYVACMNPMVGSFTINPRLQRHFTVFAFNFPSLDALNTIYGQIFSFHFQQQAFAPSILRSGPTLIQATIAFHQTMMCNFLPTAIKFHYIFNLRDLSNVFQGILFASPECLKGPLDLIHLWLHESARVYGDKLIDKKDCDLFQRRMLETAYKYFEGIDSHMLLQQPLIYCHFADRGKDPHYMPVKDWEVLKTILTETLDNYNELNAAMHLVLFEDAMQHVCRISRILRTPQGCALLVGVGGSGKQSLSRLAAYLRGLEVFQITLTEGYGIQELRVDLANLYIRTGAKNMPTVFLLTDAQVLDESFLVLINDLLASGEIPDLFSDEDVDKIISGIHNEVHALGMVDSRENCWKFFMARVRLQLKIILCFSPVGRTLRVRARKFPAIVNCTAIDWFHAWPQEALVSVSRRFIEETKGIEPVHKDSISLFMAHVHTTVNEMSTRYYQNERRHNYTTPKSFLEQISLFKNLLKKKQNEVSEKKERLVNGIQKLKTTASQVGDLKARLASQEAELQLRNHDAEALITKIGLQTEKVSREKTIADAEERKVTAIQTEVFQKQRECEADLLKAEPALVAATAALNTLNRVNLSELKAFPNPPIAVTNVTAAVMVLLAPRGRVPKDRSWKAAKVFMGKVDDFLQALINYDKEHIPENCLKVVNEHYLKDPEFNPNLIRTKSFAAAGLCAWVINIIKFYEVYCDVEPKRQALAQANLELAAATEKLEAIRKKLVDLDRNLSRLTASFEKATAEKVRCQEEVNQTNKTIKLANRLVKELEAKKIRWGQSIKSFEAQEKTLCGDVLLTAAFVSYVGPFTRQYRQELVHCKWVPFLQQKVSIPLTEGLDLISMLTDDATIAAWNNEGLPSDRMSTENAAILTHCERWPLVIDPQQQGIKWIKNKYGMDLKVTHLGQKGFLNAIETALAFGDVILIENLEETIDPVLDPLLGRNTIKKGKYIRIGDKECEFNKNFRLILHTKLANPHYKPELQAQTTLLNFTVTEDGLEAQLLAEVVSIERPDLEKLKLVLTKHQNDFKIELKYLEDDLLLRLSAAEGSFLDDTKLVERLEATKTTVAEIEHKVIEAKENERKINEARECYRPVAARASLLYFVINDLQKINPLYQFSLKAFNVLFHRAIEQADKVEDMQGRISILMESITHAVFLYTSQALFEKDKLTFLSQMAFQILLRKKEIDPLELDFLLRFTVEHTHLSPVDFLTSQSWSAIKAIAVMEEFRGIDRDVEGSAKQWRKWVESECPEKEKLPQEWKKKSLIQKLILLRAMRPDRMTYALRNFVEEKLGAKYVERTRLDLVKAFEESSPATPIFFILSPGVDALKDLEILGKRLGFTIDSGKFHNVSLGQGQETVAEVALEKASKGGHWVILQNVHLVAKWLGTLEKLLERFSQGSHRDYRVFMSAESAPTPDEHIIPQGLLENSIKITNEPPTGMLANLHAALYNFDQDTLEICSKEQEFKSILFSLCYFHACVAGRLRFGPQGWSRSYPFNPGDLTICASVLYNYLEANSKVPWEDLRYLFGEIMYGGHITDDWDRKLCRVYLEEFMNPSLTEDELMLAPGFAAPPYLDYAGYHQYIEEMLPPESPALYGLHPNAEIEFLTVTSNTLFRTLLEMQPRNALSGDELGQSTEEKVKNVLDDILEKLPEEFNMAEIMQKNSNRSPYVLVCFQECERMNILIREIRISLEQLDLSLKGELALSPAVEAQQFALSYDTVPDTWSKLAYPSTYGLAQWFNDLLLRCRELDTWTQDLTLPAVVWLSGFFNPQSFLTAIMQTMARKNEWPLDKTRLTADVTKKTKEDYGHPPREGAYLHGLFMEGARWDTQAGTIVEARLKELACPMPVIFAKATPVDRQETKQTYECPVYRTKLRGPSYIWTFRLKSEEKTAKWVLAGVALLLEA

SEQ ID NO: 32511 - protein, 364 aa, Homo sapiens
MAAISTSIPVISQPQFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 32512 - protein, 364 aa, Homo sapiens; identical to SEQ ID NO: 32511

SEQ ID NO: 32513 - protein, 1220 aa, Homo sapiens
MGKKQKNKSEDSTKDDIDLDALAAEIEGAGAAKEQEPQKSKGKKKKEKKKQDFDEDDILKELEELSLEAQGIKADRETVAVKPTENNEEEFTSKDKKKKGQKGKKQSFDDNDSEELEDKDSKSKKTAKPKVEMYSGSDDDDDFNKLPKKAKGKAQKSNKKWDGSEEDEDNSKKIKERSRINSSGESGDESDEFLQSRKGQKKNQKNKPGPNIESGNEDDDASFKIKTVAQKKAEKKERERKKRDEEKAKLRKLKEKEELETGKKDQSKQKESQRKFEEETVKSKVTVDTGVIPASEEKAETPTAAEDDNEGDKKKKDKKKKKGEKEEKEKEKKKGPSKATVKAMQEALAKLKEEEERQKREEEERIKRLEELEAKRKEEERLEQEKRERKKQKEKERKERLKKEGKLLTKSQREARARAEATLKLLQAQGVEVPSKDSLPKKRPIYEDKKRKKIPQQLESKEVSESMELCAAVEVMEQGVPEKEETPPPVEPEEEEDTEDAGLDDWEAMASDEETEKVEGNKVHIEVKENPEEEEEEEEEEEEDEESEEEEEEEGESEGSEGDEEDEKVSDEKDSGKTLDKKPSKEMSSDSEYDSDDDRTKEERAYDKAKRRIEKRRLEHSKNVNTEKLRAPIICVLGHVDTGKTKILDKLRHTHVQDGEAGGITQQIGATNVPLEAINEQTKMIKNFDRENVRIPGMLIIDTPGHESFSNLRNRGSSLCDIAILVVDIMHGLEPQTIESINLLKSKKCPFIVALNKIDRLYDWKKSPDSDVAATLKKQKKNTKDEFEERAKAIIVEFAQQGLNAALFYENKDPRTFVSLVPTSAHTGDGMGSLIYLLVELTQTMLSKRLAHCEELRAQVMEVKALPGMGTTIDVILINGRLKEGDTIIVPGVEGPIVTQIRGLLLPPPMKELRVKNQYEKHKEVEAAQGVKILGKDLEKTLAGLPLLVAYKEDEIPVLKDELIHELKQTLNAIKLEEKGVYVQASTLGSLEALLEFLKTSEVPYAGINIGPVHKKDVMKASVMLEHDPQYAVILAFDVRIERDAQEMADSLGVRIFSAEIIYHLFDAFTKYRQDYKKQKQEEFKHIAVFPCKIKILPQYIFNSRDPIVMGVTVEAGQVKQGTPMCVPSKNFVDIGIVTSIEINHKQVDVAKKGQEVCVKIEPIPGESPKMFGRHFEATDILVSKISRQSIDALKDWFRDEMQKSDWQLIVELKKVFEII

SEQ ID NO: 32514 - protein, 462 aa, Homo sapiens
MSIAGVAAQEIRVPLKTGFLHNGRAMGNMRKTYWSSRSEFKNNFLNIDPITMAYSLNSSAQERLIPLGHASKSAPMNGHCFAENGPSQKSSLPPLLIPPSENLGPHEEDQVVCGFKKLTVNGVCASTPPLTPIKNSPSLFPCAPLCERGSRPLPPLPISEALSLDDTDCEVEFLTSSDTDFLLEDSTLSDFKYDVPGRRSFRGCGQINYAYFDTPAVSAADLSYVSDQNGGVPDPNPPPPQTHRRLRRSHSGPAGSFNKPAIRISNCCIHRASPNSDEDKPEVPPRVPIPPRPVKPDYRRWSAEVTSSTYSDEDRPPKVPPREPLSPSNSRTPSPKSLPSYLNGVMPPTQSFAPDPKYVSSKALQRQNSEGSASKVPCILPIIENGKKVSSTHYYLLPERPPYLDKYEKFFREAEETNGGAQIQPLPADCGISSATEKPDSKTKMDLGGHVKRKHLSYVVSP

SEQ ID NO: 32515 - protein, 214 aa, Homo sapiens
MSQAVGLPPWLQDPELMLLPEKLISKYNWIKQWKLGLKFDGKNEDLVDKIKESLTLLRKKWAGLAEMRTAEARQIACDELFTNEAEEYSLYEAVKFLMLNRAIELYNDKEKGKEVPFFSVLLFARDTSNDPGQLLRNHLNQVGHTGGLEQVEMFLLAYAVRHTIQVYRLSKYNTEEFITVYPTDPPKDWPVVTLIAEDDRHYNIPVRVCEETSL

SEQ ID NO: 32516 - protein, 810 aa, Homo sapiens
MVMAYLVENFWGEKNSGFDVLYHNMKHGQISTKELADFVRERATIEEAYSRSMTKLAKSASNYSQLGTFAPVWDVFKTSTEKLANCHLDLVRKLQELIKEVQKYGEEQVKSHKKTKEEVAGTLEAVQTIQSITQALQKSKENYNAKCVEQERLKKEGATQREIEKAAVKSKKATDTYKLYVEKYALAKADFEQKMTETAQKFQDIEETHLIHIKEIIGSLSNAIKEIHLQIGQVHEEFINNMANTTVESLIQKFAESKGTGKERPGLIEFEECDTASAVEGIKPRKRKTFALPGIIKKEKDAESVECPDADSLNIPDVDEEGYSIKPETNQNDTKENHFYSSSDSDSEDEEPKKYRIEIKPMHPNNSHHTMASLDELKVSIGNITLSPAISRHSPVQMNRNLSNEELTKSKPSAPPNEKGTSDLLAWDPLFGPSLDSSSSSSLTSSSSARPTTPLSVGTIVQPPRPASRPKLTSGKLSGINEIPRPFSPPVTSNTSPPPAAPLARAESSSSISSSASLSAANTPTVGVSRGPSPVSLGNQDTLPVAVALTESVNAYFKGADPTKCIVKITGDMTMSFPSGIIKVFTSNPTPAVLCFRVKNISRLEQILPNAQLVFSDPSQCDSNTKDFWMNMQAVTVYLKKLSEQNPAASYYNVDVLKYQVSSNGIQSTPLNLATYWKCSASTTDLRVDYKYNPEAMVAPSVLSNIQVVVPVDGGVTNMQSLPPAIWNAEQMKAFWKLSSISEKSENGGSGSLRAKFDLSEGPSKPTTLAVQFLSEGSTLSGVDFELVGTGYRLSLIKKRFATGRYLADC

SEQ ID NO: 32517 - protein, 998 aa, Homo sapiens
MNRRRKFLLASVLALQNSSFIYPSCQKCFSRIILVSKRSNCPKCGSTGESGNANYRYKLSLKVAESNKLFVITVFGSCLDTFFGLTATGLHRYIQDPNKIPETLDNDTTQNLLTKAVETCFVGQSFIFGVTNFENQPGQGSDASNFLQQCSDHKRKAKALVACQIVLPDPGIAGFTVIDYFHQLLQTFNFRKLQCDSQAPNNHLLALDHSNSDLSSTYTSDSTSDFFKSCSKDTFSKFWQPSLEFTCIVSQLTDNDDFSASEQSKAFGTLQQNRKSISIAEATGSSSCHDPIQDSWSLVSYMDKKSTAEKLGKELGLQAKELSAVHSSHHEIGVNDSNLFSLEMREPLESSNTKSFHSAVEIKNRSQHELPCFQHHGIDTPTSLQKRSACCPPSLLRLEETASSSQDGDPQIWDDLPFSESLNKFLAVLESEIAVTQADVSSRKHHVDNDIDKFHADHSSLSVTPQRTTGALHTPPIALRSSQVIVKANCSKDDFLFNCKGNLSPSVEKESQPDNKVEAVSVNHNGRDMSEYFLPNPYLSALSSSSKDLETIVTLKKTIRISPHRESDHSSLNNKYLNGCGEISVSEMNEKLTTLCYRKYNDVSDLCKLENKQYCRWSKNQDDSFTICRKLTYPLETLCNSPNRSTNTLKEMPWGHINNNVTQSYSIGYEGSYDASADLFDDIAKEMDIATEITKKSQDILLKWGTSLAESHPSESDFSLRSLSEDFIQPSQKLSLQSLSDSRHSRTCSPTPHFQSDSEYNFENSQDFVPCSQSTPISGFHQTRIHGINRAFKKPVFYSDLDGNYEKIRIFPENDKQQASPSCPKNIKTPSQKIRSPIVSGISQPDVFNHYPFAECHETDSDEWVPPTTQKIFPSDMLGFQGIGLGKCLAAYHFPDQQELPRKKLKHIRQGTNKGLIKKKLKNMLAAVVTKKKTHKYNCKSSGWISKCPDIQVLAAPQLHPILGPDSCSEVKCCLPFSEKGPPSVCETRSAWSPELFS

SEQ ID NO: 32518 - protein, 350 aa, Homo sapiens
MRLRTPKPGRRQSRPHAAADPNPDRPRPTRAAPSPKSQTPASPQGGPGSLRYSSFLRWPHPQLQTNQRRPNGLPKPSRWDPRSREPLPRPRPTATLGLRIRSAKCRGEGPTPPREPNSGNSPSSVHLHPDPPPRPQVHAPFRGDLSGASGPAETRGSDDRGPGGNRTACRSCLRGGCAALNCPRLFIPQPPAASDPPPAGAAQPFADAGELESDHAQPSHRGARFGPPTPFPGFITHFSPALKETSQMLLHSPTEAGLGCPQPRALPRTLQAPTGPLPATPRPIPKPALTLWGLHPLEEGRVKAWRCAACLTSAQGARQATGLSPDQRGPKGLIVKSAGPRTQGEDMLVL

SEQ ID NO: 32519 - protein, 142 aa, Homo sapiens
MNSLEQAEAPRVVSLIPAVVSGNCQDLKAFERRLTEYIHCLQPATGRWRMLLIVVSVCTATGAWNWLIDPETQKVSFFTSLWNHPFFTISCITLIGLFFAGIHKRVVAPSIIAARCRTVLAEYNMSCDDTGKLILKPRPHVQ

SEQ ID NO: 32520 - protein, 345 aa, Homo sapiens
MSHLFDPRLPALAASPMLYLYGPERPGLPLAFAPAAALAASGRAETPQKPPYSYIALIAMAIQDAPEQRVTLNGIYQFIMDRFPFYHDNRQGWQNSIRHNLSLNDCFVKVPREKGRPGKGSYWTLDPRCLDMFENGNYRRRKRKPKPGPGAPEAKRPRAETHQRSAEAQPEAGSGAGGSGPAISRLQAAPAGPSPLLDGPSPPAPLHWPGTASPNEDAGDAAQGAAAVAVGQAARTGDGPGSPLRPASRSSPKSSDKSKSFSIDSILAGKQGQKPPSGDELLGGAKPGPGGRLGASLLAASSSLRPPFNASLMLDPHVQGGFYQLGIPFLSYFPLQVPDTVLHFQ

SEQ ID NO: 32521 - protein, 317 aa, Homo sapiens
MVRARHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCIKAKSCEDIQCTGGKKCLWDFKVGRGRCSLCDELCPDSKSDEPVCASDNATYASECAMKEAACSSGVLLEVKHSGSCN

SEQ ID NO: 32522 - protein, 344 aa, Homo sapiens
MVRARHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCIKAKSCEDIQCTGGKKCLWDFKVGRGRCSLCDELCPDSKSDEPVCASDNATYASECAMKEAACSSGVLLEVKHSGSCNSISEDTEEEEEDEDQDYSFPISSILEW

SEQ ID NO: 32523 - protein, 454 aa, Homo sapiens
MSAGGPCPAAAGGGPGGASCSVGAPGGVSMFRWLEVLEKEFDKAFVDVDLLLGEIDPDQADITYEGRQKMTSLSSCFAQLCHKAQSVSQINHKLEAQLVDLKSELTETQAEKVVLEKEVHDQLLQLHSIQLQLHAKTGQSADSGTIKAKLERELEANKKEKMKEAQLEAEVKLLRKENEALRRHIAVLQAEVYGARLAAKYLDKELAGRVQQIQLLGRDMKGPAHDKLWNQLEAEIHLHRHKTVIRACRGRNDLKRPMQAPPGHDQDSLKKSQGVGPIRKVLLLKEDHEGLGISITGGKEHGVPILISEIHPGQPADRCGGLHVGDAILAVNGVNLRDTKHKEAVTILSQQRGEIEFEVVYVAPEVDSDDENVEYEDESGHRYRLYLDELEGGGNPGASCKDTSGEIKVLQGFNKKAVTDTHENGDLGTASETPLDDGASKLDDLHTLYHKKSY

SEQ ID NO: 32524 - protein, 462 aa, Homo sapiens
MSAGGPCPAAAGGGPGGASCSVGAPGGVSMFRWLEVLEKEFDKAFVDVDLLLGEIDPDQADITYEGRQKMTSLSSCFAQLCHKAQSVSQINHKLEAQLVDLKSELTETQAEKVVLEKEVHDQLLQLHSIQLQLHAKTGQSADSGTIKAKLSGPSVEELERELEANKKEKMKEAQLEAEVKLLRKENEALRRHIAVLQAEVYGARLAAKYLDKELAGRVQQIQLLGRDMKGPAHDKLWNQLEAEIHLHRHKTVIRACRGRNDLKRPMQAPPGHDQDSLKKSQGVGPIRKVLLLKEDHEGLGISITGGKEHGVPILISEIHPGQPADRCGGLHVGDAILAVNGVNLRDTKHKEAVTILSQQRGEIEFEVVYVAPEVDSDDENVEYEDESGHRYRLYLDELEGGGNPGASCKDTSGEIKVLQGFNKKAVTDTHENGDLGTASETPLDDGASKLDDLHTLYHKKSY

SEQ ID NO: 32525 - protein, 910 aa, Homo sapiens
MKVGVLWLISFFTFTDGHGGFLGKNDGIKTKKELIVNKKKHLGPVEEYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRNGSIVAGYEVVGSSSASELLSAIEHVAEKAKTALHKLFPLEDGSFRVFGKAQCNDIVFGFGSKDDEYTLPCSSGYRGNITAKCESSGWQVIRETCVLSLLEELNKNFSMIVGNATEAAVSSFVQNLSVIIRQNPSTTVGNLASVVSILSNISSLSLASHFRVSNSTMEDVISIADNILNSASVTNWTVLLREEKYASSRLLETLENISTLVPPTALPLNFSRKFIDWKGIPVNKSQLKRGYSYQIKMCPQNTSIPIRGRVLIGSDQFQRSLPETIISMASLTLGNILPVSKNGNAQVNGPVISTVIQNYSINEVFLFFSKIESNLSQPHCVFWDFSHLQWNDAGCHLVNETQDIVTCQCTHLTSFSILMSPFVPSTIFPVVKWITYVGLGISIGSLILCLIIEALFWKQIKKSQTSHTRRICMVNIALSLLIADVWFIVGATVDTTVNPSGVCTAAVFFTHFFYLSLFFWMLMLGILLAYRIILVFHHMAQHLMMAVGFCLGYGCPLIISVITIAVTQPSNTYKRKDVCWLNWSNGSKPLLAFVVPALAIVAVNFVVVLLVLTKLWRPTVGERLSRDDKATIIRVGKSLLILTPLLGLTWGFGIGTIVDSQNLAWHVIFALLNAFQGFFILCFGILLDSKLRQLLFNKLSALSSWKQTEKQNSSDLSAKPKFSKPFNPLQNKGHYAFSHTGDSSDNIMLTQFVSNE

SEQ ID NO: 32526 - protein, 650 aa, Homo sapiens
MQSWYSMLSPTYKQRNEDFRKLFSKLPEAERLIVDYSCALQREILLQGRLYLSENWICFYSNIFRWETTISIQLKEVTCLKKEKTAKLIPNAIQICTESEKHFFTSFGARDRCFLLIFRLWQNALLEKTLSPRELWHLVHQCYGSELGLTSEDEDYVSPLQLNGLGTPKEVGDVIALSDITSSGAADRSQEPSPVGSRRGHVTPNLSRASSDADHGAEEDKEEQVDSQPDASSSQTVTPVAEPPSTEPTQPDGPTTLGPLDLLPSEELLTDTSNSSSSTGEEADLAALLPDLSGRLLINSVFHVGAERLQQMLFSDSPFLQGFLQQCKFTDVTLSPWSGDSKCHQRRVLTYTIPISNPLGPKSASVVETQTLFRRGPQAGGCVVDSEVLTQGIPYQDYFYTAHRYCILGLARNKARLRVSSEIRYRKQPWSLVKSLIEKNSWSGIEDYFHHLERELAKAEKLSLEEGGKDARGLLSGLRRRKRPLSWRAHGDGPQHPDPDPCARAGIHTSGSLSSRFSEPSVDQGPGAGIPSALVLISIVICVSLIILIALNVLLFYRLWSLERTAHTFESWHSLALAKGKFPQTATEWAEILALQKQFHSVEVHKWRQILRASVELLDEMKFSLEKLHQGITVSDPPFDTQPRPDDSFS

SEQ ID NO: 32527 - protein, 384 aa, Homo sapiens
MALNDCFLLNLEVDHFMHCNISSHSADLPVNDDWSHPGILYVIPAVYGVIILIGLIGNITLIKIFCTVKSMRNVPNLFISSLALGDLLLLITCAPVDASRYLADRWLFGRIGCKLIPFIQLTSVGVSVFTLTALSADRYKAIVRPMDIQASHALMKICLKAAFIWIISMLLAIPEAVFSDLHPFHEESTNQTFISCAPYPHSNELHPKIHSMASFLVFYVIPLSIISVYYYFIAKNLIQSAYNLPVEGNIHVKKQIESRKRLAKTVLVFVGLFAFCWLPNHVIYLYRSYHYSEVDTSMLHFVTSICARLLAFTNSCVNPFALYLLSKSFRKQFNTQLLCCQPGLIIRSHSTGRSTTCMTSLKSTNPSVATFSLINGNICHERYV

SEQ ID NO: 32528 - protein, 553 aa, Homo sapiens
MPVQLTTALRVVGTSLFALAVLGGILAAYVTGYQFIHTEKHYLSFGLYGAILGLHLLIQSLFAFLEHRRMRRAGQALKLPSPRRGSVALCIAAYQEDPDYLRKCLRSAQRISFPDLKVVMVVDGNRQEDAYMLDIFHEVLGGTEQAGFFVWRSNFHEAGEGETEASLQEGMDRVRDVVRASTFSCIMQKWGGKREVMYTAFKALGDSVDYIQVCDSDTVLDPACTIEMLRVLEEDPQVGGVGGDVQILNKYDSWISFLSSVRYWMAFNVERACQSYFGCVQCISGPLGMYRNSLLQQFLEDWYHQKFLGSKCSFGDDRHLTNRVLSLGYRTKYTARSKCLTETPTKYLRWLNQQTRWSKSYFREWLYNSLWFHKHHLWMTYESVVTGFFPFFLIATVIQLFYRGRIWNILLFLLTVQLVGIIKATYACFLRGNAEMIFMSLYSLLYMSSLLPAKIFAIATINKSGWGTSGRKTIVVNFIGLIPVSIWVAVLLGGLAYTAYCQDLFSETELAFLVSGAILYGCYWVALLMLYLAIIARRCGKKPEQYSLAFAEV

SEQ ID NO: 32529 - protein, 556 aa, Homo sapiens
MMNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 32530 - protein, 599 aa, Homo sapiens
MMNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNQQANLIPGLNLSALGIFSTGLSVLSPPAGPRGAPPAAPYHPFTTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 32531 - protein, 380 aa, Homo sapiens
MAFVCLAIGCLYTFLISTTFGCTSSSDTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLRFWLPFGFILILVIFVTGLLLRKPNTYPKMIPEFFCDT

SEQ ID NO: 32532 - protein, 114 aa, Homo sapiens [sequence omitted]

SEQ ID NO: 32533 - protein, 114 aa, Homo sapiens [sequence omitted]

SEQ ID NO: 32534 - protein, 235 aa, Homo sapiens
MQQRGAAGSRGCALFPLLGVLFFQGVYIVFSLEIRADAHVRGYVGEKIKLKCTFKSTSDVTDKLTIDWTYRPPSSSHTVSIFHYQSFQYPTTAGTFRDRISWVGNVYKGDASISISNPTIKDNGTFSCAVKNPPDVHHNIPMTELTVTERGFGTMLSSVALLSILVFVPSAVVVALLLVRMGRKAAGLKKRSRSGYKKSSIEVSDDTDQEEEEACMARLCVRCAECLDSDYEETY

SEQ ID NO: 32535 - protein, 404 aa, Homo sapiens
  VARIANT 176,184,205,207,216,262,278,295,298,299,300,303,311,336,355,369,375,376,380,384: Xaa = Any Amino Acid
MSTPPPARELLQPQPQPQALHYALANVQQVQIHQIGEDGQVQVVRTLSTSHLGKGGCGVGHGRALAASTSSAVFREHRTPPHRQGAAGGASPDHAGQRGQPPDPSRGAGWSEPVFWYYVKEVLNKHELQALLLPAPHRLRRGLGPRLAALCPQRTLPGVLPAHAPGRPLQAQYFLXRLVFCDGXREVQYASYHGSRSELHTLCDXHXQQGFERAEXVCSHRFRPLKGVNAECDLAEGVHARSEQRVQGDHSLLCHLHPHQTXTGDRPLARRVQECQCXCQMQKGAEEEKASDQHXLIXXXGRXAELWGHVXKDTWGRGELRGQLRPLLCQYHVRLXKPLRAKLQWKSEQQLVENXFPVFEQGVWVPEAXCEKHRXXRCGXKRRXRVWKLIRTEAQGPLRVAREV

SEQ ID NO: 32536 - protein, 316 aa, Homo sapiens
MSQRQLGQGGQSGPALRPPGGAGAVPDRSGPQGVAGSGDTERGSAEGLGWKVRVPHPASPAPAAAPPEGEGGQPEGGGRLPGGPTAWGPQQPSGPRPPPSDRERVLGSTAFSSVQTLEEKYQEKLLTQLCPHHTPTCSTHAWVQDPGPQQVGEWPPTESDQTAAEEVKRGEKDLLVAFGGGRKRLWFCPSTYDPTSGSIMSQFQVPLAVQPDLPGLYDFPQRQVMVGSFPGSGLSMAGSESQLRGGGDGRKKRKRCGTCEPCRRLENCGACTSCTNRRTHQICKLRKCEVLKKKVGLLKEVSRPLLGYPVPSSRAR

SEQ ID NO: 32537 - protein, 320 aa, Homo sapiens [sequence omitted]

SEQ ID NO: 32538 - protein, 83 aa, Homo sapiens
MHSTPANPVEAVVQRAGFVASQASLRPWKQDRRAGDPWPRTHEFGYPEASLQASACKKKKSKDKKRKREDEETQLDTLESGEQ

SEQ ID NO: 32539 - protein, 667 aa, Homo sapiens
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNSQPFKLDPKSAHRKLKVSHDNLTVERDESSSKKSHTPERFTSQGSYGVAGNVFIDSGRHYWEVVISGSTWYAIGLAYKSAPKHEWIGKNSASWALCRCNNNWVVRHNSKEIPIEPAPHLRRVGILLDYDNGSIAFYDALNSIHLYTFDVAFAQPVCPTFTVWNKCLTIITGLPIPDHLDCTEQLP

SEQ ID NO: 32540 - protein, 667 aa, Homo sapiens; identical to SEQ ID NO: 32539

SEQ ID NO: 32541 - protein, 552 aa, Homo sapiens
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNSQPFKLDPKSAHRKLKVSHDNLTVERDESSSKKSHTPERFTSQGSYGVAGNVFIDSGRHYWEVVISGSTW

SEQ ID NO: 32542 - protein, 536 aa, Homo sapiens
MLKMCIRCLCLIGLQTVCGLFSCQITQPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 32543 - protein, 3256 aa, Homo sapiens
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGERVATCLQKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTVNRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGWKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDLDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTADEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPVCTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRNVDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQDKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKITTRSHRDSEDI

SEQ ID NO: 32544 - protein, 540 aa, Homo sapiens
MQQVLENLTELPSSTGAEEIDLIFLKGIMENPIVKSLAKAHERLEDSKLEAVSDNNLELVNEILEDITPLINVDENVAELVGILKEPHFQSLLEAHDIVASKCYDSPPSSPEMNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQVFVKCHFDYNPYNDNLIPCKEAGLKFSKGEILQIVNREDPNWWQASHVKEGGSAGLIPSQFLEEKRKAFVRRDWDNSGPFCGTISSKKKKKMMYLTTRNAEFDRHEIQIYEEVAKMPPFQRKTLVLIGAQGVGRRSLKNRFIVLNPTRFGTTVPFTSRKPREDEKDGQAYKFVSRSEMEADIKAGKYLEHGEYEGNLYGTKIDSILEVVQTGRTCILDVNPQALKVLRTSEFMPYVVFIAAPELETLRAMHKAVVDAGITTKLLTDSDLKKTVDESARIQRAYNHYFDLIIINDNLDKAFEKLQTAIEKLRMEPQWVPISWVY

SEQ ID NO: 32545 - protein, 904 aa, Homo sapiens
MDRYLLLVIWGEGKFPSAASREAEHGPEVSSGEGTENQPDFTAANVYHLLKRSISASINPEDSTFPACSVGGIPGSKKWFFAVQAIYGFYQFCSSDWQEIHFDTEKDKIEDVLQTNIEECLGAVECFEEEDSNSRESLSLADLYEEAAENLHQLSDKLPAPGRAMVDIILLLSDKDPPKLKDYLPTVGALKHLREWYSAKITIAGNHCEINCQKIAEYLSANVVSLEDLRNVIDSKELWRGKIQIWERKFGFEISFPEFCLKGVTLKNFSTSNLNTDFLAKKIIPSKDKNILPKVFHYYGPALEFVQMIKLSDLPSCYMSDIEFELGLTNSTKQNSVLLLEQISSLCSKVGALFVLPCTISNILIPPPNQLSSRKWKEYIAKKPKTISVPDVEVKGECSSYYLLLQGNGNRRCKATLIHSANQINGSFALNLIHGKMKTKTEEAKLSFPFDLLSLPHFSGEQIVQREKQLANVQVLALEECLKRRKLAKQPETVSVAELKSLLVLTRKHFLDYFDAVIPKMILRKMDKIKTFNILNDFSPVEPNSSSLMETNPLEWPERHVLQNLETFEKTKQKMRTGSLPHSSEQLLGHKEGPRDSITLLDAKELLKYFTSDGLPIGDLQPLPIQKGEKTFVLTPELSPGKLQVLPFEKASVCHYHGIEYCLDDRKALERDGGFSELQSRLIRYETQTTCTRESFPVPTVLSPLPSPVVSSDPGSVPDGEVLQNELRTEVSRLKRRSKDLNCLYPRKRLVKSESSESLLSQTTGNSNHYHHHVTSRKPQTERSLPVTCPLVPIPSCETPKLATKTSSGQKSMHESKTSRQIKESRSQKHTRILKEVVTETLKKHSITETHECFTACSQRLFEISKFYLKDLKTSRGLFEEMKKTANNNAVQVIDWVLEKTSKK

SEQ ID NO: 32546 - protein, 84 aa, Homo sapiens
MAARVGAFLKNAWDKEPVLVVSFVVGGLAVILPPLSPYFKYSVMINKATPYNYPVPVRDDGNMPDVPSHPQDPQGPSLEWLKKL

SEQ ID NO: 32547 - protein, 594 aa, Homo sapiens
MVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRALKTRGNTPKYGLIFHSTFIGRAAAKNKGRISRYLANKCSIASRIDCFSEVPTSVFGEKLREQVEERLSFYETGEIPRKNLDVMKEAMVQAEEAAAEITRKLEKQEKKRLKKEKKRLAALALASSENSSSTPEECEEMSEKPKKKKKQKPQEVPQENGMEDPSISFSKPKKKKSFSKEELMSSDLEETAGSTSIPKRKKSTPKEETVNDPEEAGHRSGSKKKRKFSKEEPVSSGPEEAVGKSSSKKKKKFHKASQED

SEQ ID NO: 32548 - protein, 154 aa, Homo sapiens
MASASARGNQDKDAHFPPPSKQSLLFCPKSKLHIHRAEISKIMRECQEESFWKRALPFSLVSMLVTQGLVYQGYLAANSRFGSLPKVALAGLLGFGLGKVSYIGVCQSKFHFFEDQLRGAGFGPQHNRHCLLTCEECKIKHGLSEKGDSQPSAS

SEQ ID NO: 32549 - protein, 99 aa, Homo sapiens
MASASARGNQDKDAHFPPPSKQSLLFCPKSKLHIHRAEISKIMRECQEESFWKRALPFSLVSMLVTQGLVYQGYLAANSRFGSLPKVARTASLPVRNAK

SEQ ID NO: 32550 - protein, 1014 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKDSKLEKALKAQNDLIWNIKDELKKVCSTNDLKELLIFNKQQVPSGESAILDRVADGMVFGALLPCEECSGQLVFKSDAYYCTGDVTAWTKCMVKTQTPNRKEWVTPKEFREISYLKKLKVKKQDRIFPPETSASVAATPPPSTASAPAAVNSSASADKPLSNMKILTLGKLSRNKDEVKAMIEKLGGKLTGTANKASLCISTKKEVEKMNKKMEEVKEANIRVVSEDFLQDVSASTKSLQELFLAHILSPWGAEVKAEPVEVVAPRGKSGAALSKKSKGQVKEEGINKSEKRMKLTLKGGAAVDPDSGLEHSAHVLEKGGKVFSATLGLVDIVKGTNSYYKLQLLEDDKENRYWIFRSWGRVGTVIGSNKLEQMPSKEDAIEQFMKLYEEKTGNAWHSKNFTKYPKKFYPLEIDYGQDEEAVKKLTVNPGTKSKLPKPVQDLIKMIFDVESMKKAMVEYEIDLQKMPLGKLSKRQIQAAYSILSEVQQAVSQGSSDSQILDLSNRFYTLIPHDFGMKKPPLLNNADSVQAKVEMLDNLLDIEVAYSLLRGGSDDSSKDPIDVNYEKLKTDIKVVDRDSEEAEIIRKYVKNTHATTHSAYDLEVIDIFKIEREGECQRYKPFKQLHNRRLLWHGSRTTNFAGILSQGLRIAPPEAPVTGYMFGKGIYFADMVSKSANYYHTSQGDPIGLILLGEVALGNMYELKHASHISRLPKGKHSVKGLGKTTPDPSANISLDGVDVPLGTGISSGVIDTSLLYNEYIVYDIAQVNLKYLLKLKFNFKTSLW

SEQ ID NO: 32551 - protein, 1310 aa, Homo sapiens
MAQLWLSCFLLPALVVSVAANVAPKFLANMTSVILPEDLPVGAQAFWLVAEDQDNDPLTYGMSGPNAYFFAVTPKTGEVKLASALDYETLYTFKVTISVSDPYIQVQREMLVIVEDRNDNAPVFQNTAFSTSINETLPVGSVVFSVLAVDKDMGSAGMVVYSIEKVIPSTGDSEHLFRILANGSIVLNGSLSYNNKSAFYQLELKACDLGGMYHNTFTIQCSLPVFLSISVVDQPDLDPQFVREFYSASVAEDAAKGTSVLTVEAVDGDKGINDPVIYSISYSTRPGWFDIGADGVIRVNGSLDREQLLEADEEVQLQVTATETHLNIYGQEAKVSIWVTVRVMDVNDHKPEFYNCSLPACTFTPEEAQVNFTGYVDEHASPRIPIDDLTMVVYDPDKGSNGTFLLSLGGPDAEAFSVSPERAAGSASVQVLVRVSALVDYERQTAMAVQVVATDSVSQNFSVAMVTIHLRDINDHRPTFPQSLYVLTVPEHSATGSVVTDSIHATDPDTGAWGQITYSLLPGNGADLFQVDPVSGTVTVRNGELLDRESQAVYYLTLQATDGGNLSSSTTLQIHLLDINDNAPVVSGSYNIFVQEEEGNVSVTIQAHDNDEPGTNNSRLLFNLLPGPYSHNFSLDPDTGLLRNLGPLDREAIDPALEGRIVLTVLVSDCGEPVLGTKVNVTITVEDINDNLPIFNQSSYNFTVKEEDPGVLVGVVKAWDADQTEANNRISFSLSGSGANYFMIRGLVLGAGWAEGYLRLPPDVSLDYETQPVFNLTVSAENPDPQGGETIVDVCVNVKDVNDNPPTLDVASLRGIRVAENGSQHGQVAVVVASDVDTSAQLEIQLVNILCTKAGVDVGSLCWGWFSVAANGSVYINQSKAIDYEACDLVTLVVRACDLATDPGFQAYSNNGSLLITIEDVNDNAPYFLPENKTFVIIPELVLPNREVASVRARDDDSGNNGVILFSILRVDFISKDGATIPFQGVFSIFTSSEADVFAGSIQPVTSLDSTLQGTYQVTVQARDRPSLGPFLEATTTLNLFTVDQSYRSRLQFSTPKEEVGANRQAINAALTQATRTTVYIVDIQDIDSAARARPHSYLDAYFVFPNGSALTLDELSVMIRNDQDSLTQLLQLGLVVLGSQESQESDLSKQLISVIIGLGVALLLVLVIMTMAFVCVRKSYNRKLQAMKAAKEARKTAAGVMPSAPAIPGTNMYNTERANPMLNLPNKDLGLEYLSPSNDLDSVSVNSLDDNSVDVDKNSQEIKEHRPPHTPPEPDPEPLSVVLLGRQAGASGQLEGPSYTNAGLDTTDL

SEQ ID NO: 32552 - protein, 301 aa, Homo sapiens
MTTLDDKLLGEKLQYYYSSSEDEDSDHEDKDRGRCAPASSSVPAEAELAGEGISVNTGPKGVINDWRRFKQLETEQREEQCREMERLIKKLSMTCRSHLDEEEEQQKQKDLQEKISGKMTLKEFAIMNEDQDDEEFLQQYRKQRMEEMRQQLHKGPQFKQVFEISSGEGFLDMIDKEQKSIVIMVHIYEDGIPGTEAMNGCMICLAAEYPAVKFCKVKSSVIGASSQFTRNALPALLIYKGGELIGNFVRVTDQLGDDFFAVDLEAFLQEFGLLPEKEVLVLTSVRNSATCHSEDSDLEID

SEQ ID NO: 32553 - protein, 401 aa, Homo sapiens
MRRAPAAERLLELGFPPRCGRQEPPFPLGVTRGWGRWPIQKRREGARPVPFSERSQEDGRGPAARSSGTLWRIRTRLSLCRDPEPPPPLCLLRVSLLCALRAGGRGSRWGEDGARLLLLPPARAAGNGEAEPSGGPSYAGRMLESSGCKALKEGVLEKRSDGLLQLWKKKCCILTEEGLLLIPPKQLQHQQQQQQQQQQQQQQQPGQGPAEPSQPSGPAVASLEPPVKLKELHFSNMKTVDCVERKGKYMYFTVVMAEGKEIDFRCPQDQGWNAEITLQMVQYKNRQAILAVKSTRQKQQHLVQQQPPSQPQPQPQLQPQPQPQPQPQPQPQSQPQPQPQPKPQPQQLHPYPHPHPHPHSHPHSHPHPHPHPHPHQIPHPHPQPHSQPHGHRLLRSTSNSA

SEQ ID NO: 32554 - protein, 562 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 32555 - protein, 291 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRTGRSVSSPATASMRPCLLSIRSG

SEQ ID NO: 32556 - protein, 516 aa, Homo sapiens
MDAMKRGLCCVLLLCGAVFVSPSQEIHARFRRGARSYQGCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 32557 - protein, 783 aa, Homo sapiens
MAACRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREVGTSDKEILTSRIIDRSIRPLFPAGYFYDTQVLCNLLAVDGVNEPDVLAINGASVALSLSDIPWNGPVGAVRIGIIDGEYVVNPTRKEMSSSTLNLVVAGAPKSQIVMLEASAENILQQDFCHAIKVGVKYTQQIIQGIQQLVKETGVTKRTPQKLFTPSPEIVKYTHKLAMERLYAVFTDYEHDKVSRDEAVNKIRLDTEEQLKEKFPEADPYEIIESFNVVAKEVFRSIVLNEYKRCDGRDLTSLRNVSCEVDMFKTLHGSALFQRGQTQVLCTVTFDSLESGIKSDQVITAINGIKDKNFMLHYEFPPYATNEIGKVTGLNRRELGHGALAEKALYPVIPRDFPFTIRVTSEVLESNGSSSMASACGGSLALMDSGVPISSAVAGVAIGLVTKTDPEKGEIEDYRLLTDILGIEDYNGDMDFKIAGTNKGITALQADIKLPGIPIKIVMEAIQQASVAKKEILQIMNKTISKPRASRKENGPVVETVQVPLSKRAKFVGPGGYNLKKLQAETGVTISQVDEETFSVFAPTPSAMHEARDFITEICKDDQEQQLEFGAVYTATITEIRDTGVMVKLYPNMTAVLLHNTQLDQRKIKHPTALGLEVGQEIQVKYFGRDPADGRMRLSRKVLQSPATTVVRTLNDRSSIVMGEPISQSSSNSQ

SEQ ID NO: 32558 - protein, 233 aa, Homo sapiens
MAGNKGRGRAAYTFNIEAVGFSKGEKLPDVVLKPPPLFPDTDYKPVPLKTGEGEEYMLALKQELRETMKRMPYFIETPEERQDIERYSKRYMKVYQEEWIPDWRRLPREMMPRNKCKKAGPKPKKAKDAGKGTPLTNTEDVLKKMVELEKRGDGEKSDEENEEKEGSKEKSKEGDDDDDDDAAEQEEYDEEEQEEENDYINSYFEDGDDFGADVMTTWMRQPIRHEIFQKIFL

SEQ ID NO: 32559 - protein, 358 aa, Homo sapiens
MEAPGLAQAAAAESDSRKVAEETPDGAPALCPSPEALSPEPPVYSLQDFDTLATVGTGTFGRVHLVKEKTAKHFFALKVMSIPDVIRLKQEQHVHNEKSVLKEVSHPFLIRLFWTWHDERFLYMLMEYVPGGELFSYLRNRGRFSSTTGLFYSAEIICAIEYLHSKEIVYRDLKPENILLDRDGHIKLTDFGFAKKLVDRTWTLCGTPEYLAPEVIQSKGHGRAVDWWALGILIFEMLSGFPPFFDDNPFGIYQKILAGKIDFPRHLDFHVKDLIKKLLVVDRTRRLGNMKNGANDVKHHRWFRSVDWEAVPQRKLKPPIVPKIAGDGDTSNFETYPENDWDTAAPVPQKDLEIFKNF

SEQ ID NO: 32560 - protein, 389 aa, Homo sapiens
MADPRDKALQDYRKKLLEHKEIDGRLKELREQLKELTKQYEKSENDLKALQSVGQIVGEVLKQLTEEKFIVKATNGPRYVVGCRRQLDKSKLKPGTRVALDMTTLTIMRYLPREVDPLVYNMSHEDPGNVSYSEIGGLSEQIRELREVIELPLTNPELFQRVGIIPPKGCLLYGPPGTGKTLLARAVASQLDCNFLKVVSSSIVDKYIGESARLIREMFNYARDHQPCIIFMDEIDAIGGRRFSEGTSADREIQRTLMELLNQMDGFDTLHRVKMIMATNRPDTLDPALLRPGRLDRKIHIDLPNEQARLDILKIHAGPITKHGEIDYEAIVKLSDGFNGADLRNVCTEAGMFAIRADHDFVVQEDFMKAVRKVADSKKLESKLDYKPV

SEQ ID NO: 32561 - protein, 486 aa, Homo sapiens
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 32562 - protein, 389 aa, Homo sapiens
MLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 32563 - protein, 195 aa, Homo sapiens
MAEPVQEELSVLAAIFCRPHEWEVLSRSETDGTVFRIHTKAEGFMDADIPLELVFHLPVNYPSCLPGISINSEQLTRAQCVTVKEKLLEQAESLLSEPMVHELVLWIQQNLRHILSQPETGSGSEKCTFSTSTTMDDGLWITLLHLDHMRAKTKYVKIVEKWASDLRLTGRLMFMGKIILILLQGDRNNLKVPKS

SEQ ID NO: 32564 - protein, 551 aa, Homo sapiens
MAEGENEVRWDGLCSRDSTTRETALENIRQTILRKTEYLRSVKETPHRPSDGLSNTESSDGLNKLLAHLLMLSKRCPFKDVREKSEFILKSIQELGIRIPRPLGQGPSRFIPEKEILQVGSEDAQMHALFADSFAALGRLDNITLVMVFHPQYLESFLKTQHYLLQMDGPLPLHYRHYIGIMAAARHQCSYLVNLHVNDFLHVGGDPKWLNGLENAPQKLQNLGELNKVLAHRPWLITKEHIEGLLKAEEHSWSLAELVHAVVLLTHYHSLASFTFGCGISPEIHCDGGHTFRPPSVSNYCICDITNGNHSVDEMPVNSAENVSVSDSFFEVEALMEKMRQLQECRDEEEASQEEMASRFEIEKRESMFVFSSDDEEVTPARAVSRHFEDTSYGYKDFSRHGMHVPTFRVQDYCWEDHGYSLVNRLYPDVGQLIDEKFHIAYNLTYNTMAMHKDVDTSMLRRAIWNYIHCMFGIRYDDYDYGEINQLLDRSFKVYIKTVVCTPEKVTKRMYDSFWRQFKHSEKVHVNLLLIEARMQAELLYALRAITRYMT

SEQ ID NO: 32565 - protein, 476 aa, Homo sapiens
MLRWLRDFVLPTAACQDAEQPTRYETLFQALDRNGDGVVDIGELQEGLRNLGIPLGQDAEEKIFTTGDVNKDGKLDFEEFMKYLKDHEKKMKLAFKSLDKNNDGKIEASEIVQSLQTLGLTISEQQAELILQSIDVDGTMTVDWNEWRDYFLFNPVTDIEEIIRFWKHSTGIDIGDSLTIPDEFTEDEKKSGQWWRQLLAGGIAGAVSRTSTAPLDRLKIMMQVHGSKSDKMNIFGGFRQMVKEGGIRSLWRGNGTNVIKIAPETAVKFWAYEQYKKLLTEEGQKIGTFERFISGSMAGATAQTFIYPMEVMKTRLAVGKTGQYSGIYDCAKKILKHEGLGAFYKGYVPNLLGIIPYAGIDLAVYELLKSYWLDNFAKDSVNPGVMVLLGCGALSSTCGQLASYPLALVRTRMQAQVLEGSPQLNMVGLFRRIISKEGIPGLYRGITPNFMKVLPAVGISYVVYENMKQTLGVTQK

SEQ ID NO: 32566 - protein, 458 aa, Homo sapiens
MDSLYGDLFWYLDYNKDGTLDIFELQEGLEDVGAIQSLEEAKKIFTTGDVNKDGKLDFEEFMKYLKDHEKKMKLAFKSLDKNNDGKIEASEIVQSLQTLGLTISEQQAELILQSIDVDGTMTVDWNEWRDYFLFNPVTDIEEIIRFWKHSTGIDIGDSLTIPDEFTEDEKKSGQWWRQLLAGGIAGAVSRTSTAPLDRLKIMMQVHGSKSDKMNIFGGFRQMVKEGGIRSLWRGNGTNVIKIAPETAVKFWAYEQYKKLLTEEGQKIGTFERFISGSMAGATAQTFIYPMEVMKTRLAVGKTGQYSGIYDCAKKILKHEGLGAFYKGYVPNLLGIIPYAGIDLAVYELLKSYWLDNFAKDSVNPGVMVLLGCGALSSTCGQLASYPLALVRTRMQAQAMLEGSPQLNMVGLFRRIISKEGIPGLYRGITPNFMKVLPAVGISYVVYENMKQTLGVTQK

SEQ ID NO: 32567 - protein, 702 aa, Homo sapiens
MDQHQHLNKTAESASSEKKKTRRCNGFKMFLAALSFSYIAKALGGIIMKISITQIERRFDISSSLAGLIDGSFEIGNLLVIVFVSYFGSKLHRPKLIGIGCLLMGTGSILTSLPHFFMGYYRYSKETHINPSENSTSSLSTCLINQTLSFNGTSPEIVEKDCVKESGSHMWIYVFMGNMLRGIGETPIVPLGISYIDDFAKEGHSSLYLGSLNAIGMIGPVIGFALGSLFAKMYVDIGYVDLSTIRITPKDSRWVGAWWLGFLVSGLFSIISSIPFFFLPKNPNKPQKERKISLSLHVLKTNDDRNQTANLTNQGKNVTKNVTGFFQSLKSILTNPLYVIFLLLTLLQVSSFIGSFTYVFKYMEQQYGQSASHANFLLGIITIPTVATGMFLGGFIIKKFKLSLVGIAKFSFLTSMISFLFQLLYFPLICESKSVAGLTLTYDGNNSVASHVDVPLSYCNSECNCDESQWEPVCGNNGITYLSPCLAGCKSSSGIKKHTVFYNCSCVEVTGLQNRNYSAHLGECPRDNTCTRKFFIYVAIQVINSLFSATGGTTFILLTVKIVQPELKALAMGFQSMVIRTLGGILAPIYFGALIDKTCMKWSTNSCGAQGACRIYNSVFFGRVYLGLSIALRFPALVLYIVFIFAMKKKFQGKDTKASDNERKVMDEANLEFLNNGEHFVPSAGTDSKTCNLDMQDNAAAN

SEQ ID NO: 32568 - protein, 723 aa, Homo sapiens
MFEEKASSPSGKMGGEEKPIGAGEEKQKEGGKKKNKEGSGDGGRAELNPWPEYIYTRLEMYNILKAEHDSILAEKAEKDSKPIKVTLPDGKQVDAESWKTTPYQIACGISQGLADNTVIAKVNNVVWDLDRPLEEDCTLELLKFEDEEAQAVYWHSSAHIMGEAMERVYGGCLCYGPPIENGFYYDMYLEEGGVSSNDFSSLEALCKKIIKEKQAFERLEVKKETLLAMFKYNKFKCRILNEKVNTPTTTVYRCGPLIDLCRGPHVRHTGKIKALKIHKNSSTYWEGKADMETLQRIYGISFPDPKMLKEWEKFQEEAKNRDHRKIGRDQELYFFHELSPGSCFFLPKGAYIYNALIEFIRSEYRKRGFQEVVTPNIFNSRLWMTSGHWQHYSENMFSFEVEKELFALKPMNCPGHCLMFDHRPRSWRELPLRLADFGVLHRNELSGALTGLTRVRRFQQDDAHIFCAMEQIEDEIKGCLDFLRTVYSVFGFSFKLNLSTRPEKFLGDIEVWDQAEKQLENSLNEFGEKWELNSGDGAFYGPKIDIQIKDAIGRYHQCATIQLDFQLPIRFNLTYVSHDGDDKKRPVIVHRAILGSVERMIAILTENYGGKWPFWLSPRQVMVVPVGPTCDEYAQKVRQQFHDAKFMADIDLDPGCTLNKKIRNAQLAQYNFILVVGEKEKISGTVNIRTRDNKVHGERTISETIERLQQLKEFRSKQAEEEF

SEQ ID NO: 32569 - protein, 549 aa, Homo sapiens
MNKRGKYTTLNLEEKMKVLSRIEAGRSLKSVMDEFGISKSTFYDIKKNKKLILDFVLKQDMPLVGAEKRKRTTGAKYGDVDDAVYMWYQQKRSAGVPVRGVELQAAAERFARCFGRTDFKASTGWLFRFRNRHAIGNRKGCGEQVLSSVSENVEPFRQKLSMIIKEEKLCLAQLYSGDETDLFWKSMPENSQASRKDICLPGKKINKERLSAFLCANADGTHKLKSIIIGKSKLPKSVKEDTSTLPVIYKPSKDVWFTRELFSEWFFQNFVPEVRHFQLNVLRFHDEDVRALLLLDSCPAHPSSESLTSEDGRIKCMFFPHNTSTLIQPMNQGVILSCKRLYRWKQLEESLVIFEESDDEQEKGDKGVSKIKIYNIKSAIFNWAKSWEEVKQITIANAWENLLYKKEPEYDFQGLEHGDYREILEKCGELETKLDDDRVWLNGDEEKGCLLKTKGGITKEVVQKGGEAEKQTAEFKLSAVRESLDYLLDFVDATPEFQRFHFTLKEMQQEIVKKQFQSKIHSRIGSFLKPRPHNIKDSFSGPSTSGSNH

SEQ ID NO: 32570 - protein, 1127 aa, Homo sapiens
MPMFLTVYLSNNEQHFTEVPVTPETICRDVVDLCKEPGESDCHLAEVWCGSERPVADNERMFDVLQRFGSQRNEVRFFLRHERPPGRDIVSGPRSQDPSLKRNGVKVPGEYRRKENGVNSPRMDLTLAELQEMASRQQQQIEAQQQLLATKEQRLKFLKQQDQRQQQQVAEQEKLKRLKEIAENQEAKLKKVRALKGHVEQKRLSNGKLVEEIEQMNNLFQQKQRELVLAVSKVEELTRQLEMLKNGRIDSHHDNQSAVAELDRLYKELQLRNKLNQEQNAKLQQQRECLNKRNSEVAVMDKRVNELRDRLWKKKAALQQKENLPVSSDGNLPQQAASAPSRVAAVGPYIQSSTMPRMPSRPELLVKPALPDGSLVIQASEGPMKIQTLPNMRSGAASQTKGSKIHPVGPDWSPSNADLFPSQGSASVPQSTGNALDQVDDGEVPLREKEKKVRPFSMFDAVDQSNAPPSFGTLRKNQSSEDILRDAQVANKNVAKVPPPVPTKPKQINLPYFGQTNQPPSDIKPDGSSQQLSTVVPSMGTKPKPAGQQPRVLLSPSIPSVGQDQTLSPGSKQESPPAAAVRPFTPQPSKDTLLPPFRKPQTVAASSIYSMYTQQQAPGKNFQQAVQSALTKTHTRGPHFSSVYGKPVIAAAQNQQQHPENIYSNSQGKPGSPEPETEPVSSVQENHENERIPRPLSPTKLLPFLSNPYRNQSDADLEALRKKLSNAPRPLKKRSSITEPEGPNGPNIQKLLYQRTTIAAMETISVPSYPSKSASVTASSESPVEIQNPYLHVEPEKEVVSLVPESLSPEDVGNASTENSDMPAPSPGLDYEPEGVPDNSPNLQNNPEEPNPEAPHVLDVYLEEYPPYPPPPYPSGEPEGPGEDSVSMRPPEITGQVSLPPGKRTNLRKTGSERIAHGMRVKFNPLALLLDSSLEGEFDLVQRIIYEVDDPSLPNDEGITALHNAVCAGHTEIVKFLVQFGVNVNAADSDGWTPLHCAASCNNVQVCKFLVESGAAVFAMTYSDMQTAADKCEEMEEGYTQCSQFLYGVQEKMGIMNKGVIYALWDYEPQNDDELPMKEGDCMTIIHREDEDEIEWWWARLNDKEGYVPRNLLGLYPRIKPRQRSLA

SEQ ID NO: 32571 - protein, 1005 aa, Homo sapiens
MDLTLAELQEMASRQQQQIEAQQQLLATKEQRLKFLKQQDQRQQQQVAEQEKLKRLKEIAENQEAKLKKVRALKGHVEQKRLSNGKLVEEIEQMNNLFQQKQRELVLAVSKVEELTRQLEMLKNGRIDSHHDNQSAVAELDRLYKELQLRNKLNQEQNAKLQQQRECLNKRNSEVAVMDKRVNELRDRLWKKKAALQQKENLPVSSDGNLPQQAASAPSRVAAVGPYIQSSTMPRMPSRPELLVKPALPDGSLVIQASEGPMKIQTLPNMRSGAASQTKGSKIHPVGPDWSPSNADLFPSQGSASVPQSTGNALDQVDDGEVPLREKEKKVRPFSMFDAVDQSNAPPSFGTLRKNQSSEDILRDAQVANKNVAKVPPPVPTKPKQINLPYFGQTNQPPSDIKPDGSSQQLSTVVPSMGTKPKPAGQQPRVLLSPSIPSVGQDQTLSPGSKQESPPAAAVRPFTPQPSKDTLLPPFRKPQTVAASSIYSMYTQQQAPGKNFQQAVQSALTKTHTRGPHFSSVYGKPVIAAAQNQQQHPENIYSNSQGKPGSPEPETEPVSSVQENHENERIPRPLSPTKLLPFLSNPYRNQSDADLEALRKKLSNAPRPLKKRSSITEPEGPNGPNIQKLLYQRTTIAAMETISVPSYPSKSASVTASSESPVEIQNPYLHVEPEKEVVSLVPESLSPEDVGNASTENSDMPAPSPGLDYEPEGVPDNSPNLQNNPEEPNPEAPHVLDVYLEEYPPYPPPPYPSGEPEGPGEDSVSMRPPEITGQVSLPPGKRTNLRKTGSERIAHGMRVKFNPLALLLDSSLEGEFDLVQRIIYEVDDPSLPNDEGITALHNAVCAGHTEIVKFLVQFGVNVNAADSDGWTPLHCAASCNNVQVCKFLVESGAAVFAMTYSDMQTAADKCEEMEEGYTQCSQFLYGVQEKMGIMNKGVIYALWDYEPQNDDELPMKEGDCMTIIHREDEDEIEWWWARLNDKEGYVPRNLLGLYPRIKPRQRSLA

SEQ ID NO: 32572 - protein, 139 aa, Homo sapiens
MTHSLVCPETVSRVSSVLNRNTRQFGKKHLFDQDEETCWNSDQGPSQWVTLEFPQLIRVSQLQIQFQGGFSSRRGCLEGSQGTQALHKIVDFYPEDNNSLQTFPIPAAEVDRLKVTFEDATDFFGRVVIYHLRVLGEKV

SEQ ID NO: 32573 - protein, 804 aa, Homo sapiens
MAAHRPGPLKQQNKAHKGGRHRGRGSAQRDGKGRLALKTLSKKVRKELSRVDQRHRASQLRKQKKEAVLAEKRQLGGKDGPPHQVLVVPLHSRISLPEAMQLLQDRDTGTVHLNELGNTQNFMLLCPRLKHRWFFTSARPGDLHVVLDMAKVADTILFLLDPLEGWDSTGDYCLSCLFAQGLPTYTLAVQGISGLPLKKQIDTRKKLSKAVEKRFPHDKLLLLDTQQEAGMLLRQLANQKQQHLAFRDRRAYLFAHAVDFVPSEENNLVGTLKISGYVRGQTLNVNRLLHIVGYGDFQMKQIDAPGDPFPLNPRGIKPQKDPDMAMEICATDAVDDMEEGLKVLMKADPGRQESLQAEVIPDPMEGEQTWPTEEELSEAKDFLKESSKVVKKVPKGTSSYQAEWILDGGSQSGGEGDEYEYDDMEHEDFMEEESQDESSEEEEEYETMTIGESVHDDLYDKKVDEEAEAKMLEKYKQERLEEMFPDEVDTPRDVAARIRFQKYRGLKSFRTSPWDPKENLPQDYARIFQFQNFTNTRKSIFKEVEEKEVEGAEVGWYVTLHVSEVPVSVVECFRQGTPLIAFSLLPHEQKMSVLNMVVRRDPGNTEPVKAKEELIFHCGFRRFRASPLFSQHTAADKHKLQRFLTADMALVATVYAPITFPPASVLLFKQKSNGMHSLIATGHLMSVDPDRMVIKRVVLSGHPFKIFTKMAVVRYMFFNREDVLWFKPVELRTKWGRRGHIKEPLGTHGHMKCSFDGKLKSQDTVLMNLYKRVFPKWTYDPYVPEPVPWLKSEISSTVPQGGME

SEQ ID NO: 32574 - protein, 499 aa, Homo sapiens
  MOD_RES 498: Xaa = Selenocysteine
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCXG

SEQ ID NO: 32575 - protein, 499 aa, Homo sapiens; identical to SEQ ID NO: 32574
  MOD_RES 498: Xaa = Selenocysteine

SEQ ID NO: 32576 - protein, 499 aa, Homo sapiens; identical to SEQ ID NO: 32574
  MOD_RES 498: Xaa = Selenocysteine

SEQ ID NO: 32577 - protein, 499 aa, Homo sapiens; identical to SEQ ID NO: 32574
  MOD_RES 498: Xaa = Selenocysteine

SEQ ID NO: 32578 - protein, 1006 aa, Homo sapiens
MDSSQQKTFRGHDAPVLSLSFDPKDIFLASASCDGSVRVWQISDQTCAISWPLLQKCNDVINAKSICRLAWQPKSGKLLAIPVEKSVKLYRRESWSHQFDLSDNFISQTLNIVTWSPCGQYLAAGSINGLIIVWNVETKDCMERVKHEKGYAICGLAWHPTCGRISYTDAEGNLGLLENVCDPSGKTSSSKVSSRVEKDYNDLFDGDDMSNAGDFLNDNAVEIPSFSKGIINDDEDDEDLMMASGRPRQRSHILEDDENSVDISMLKTGSSLLKEEEEDGQEGSIHNLPLVTSQRPFYDGPMPTPRQKPFQSGSTPLHLTHRFMVWNSIGIIRCYNDEQDNAIDVEFHDTSIHHATHLSNTLNYTIADLSHEAILLACESTDELASKLHCLHFSSWDSSKEWIIDLPQNEDIEAICLGQGWAAAATSALLLRLFTIGGVQKEVFSLAGPVVSMAGHGEQLFIVYHRGTGFDGDQCLGVQLLELGKKKKQILHGDPLPLTRKSYLAWIGFSAEGTPCYVDSEGIVRMLNRGLGNTWTPICNTREHCKGKSDHYWVVGIHENPQQLRCIPCKGSRFPPTLPRPAVAILSFKLPYCQIATEKGQMEEQFWRSVIFHNHLDYLAKNGYEYEESTKNQATKEQQELLMKMLALSCKLEREFRCVELADLMTQNAVNLAIKYASRSRKLILAQKLSELAVEKAAELTATQVEEEEEEEDFRKKLNAGYSNTATEWSQPRFRNQVEEDAEDSGEADDEEKPEIHKPGQNSFSKSTNSSDVSAKSGAVTFSSQGRVNPFKVSASSKEPAMSMNSARSTNILDNMGKSSKKSTALSRTTNNEKSPIIKPLIPKPKPKQASAASYFQKRNSQTNKTEEVKEENLKNVLSETPAICPPQNTENQRPKTGFQMWLEENRSNILSDNPDFSDEADIIKEGMIRFRVLSTEERKVWANKAKGETASEGTEAKKRKRVVDESDETENQEEKAKENLNLSKKQKPLDFSTNQKLSAFAFKQE

SEQ ID NO: 32579 - protein, 1129 aa, Homo sapiens
MPATRKPMRYGHTEGHTEVCFDDSGSFIVTCGSDGDVRIWEDLDDDDPKFINVGEKAYSCALKSGKLVTAVSNNTIQVHTFPEGVPDGILTRFTTNANHVVFNGDGTKIAAGSSDFLVKIVDVMDSSQQKTFRGHDAPVLSLSFDPKDIFLASASCDGSVRVWQISDQTCAISWPLLQKCNDVINAKSICRLAWQPKSGKLLAIPVEKSVKLYRRESWSHQFDLSDNFISQTLNIVTWSPCGQYLAAGSINGLIIVWNVETKDCMERVKHEKGYAICGLAWHPTCGRISYTDAEGNLGLLENVCDPSGKTSSSKVSSRVEKDYNDLFDGDDMSNAGDFLNDNAVEIPSFSKGIINDDEDDEDLMMASGRPRQRSHILEDDENSVDISMLKTGSSLLKEEEEDGQEGSIHNLPLVTSQRPFYDGPMPTPRQKPFQSGSTPLHLTHRFMVWNSIGIIRCYNDEQDNAIDVEFHDTSIHHATHLSNTLNYTIADLSHEAILLACESTDELASKLHCLHFSSWDSSKEWIIDLPQNEDIEAICLGQGWAAAATSALLLRLFTIGGVQKEVFSLAGPVVSMAGHGEQLFIVYHRGTGFDGDQCLGVQLLELGKKKKQILHGDPLPLTRKSYLAWIGFSAEGTPCYVDSEGIVRMLNRGLGNTWTPICNTREHCKGKSDHYWVVGIHENPQQLRCIPCKGSRFPPTLPRPAVAILSFKLPYCQIATEKGQMEEQFWRSVIFHNHLDYLAKNGYEYEESTKNQATKEQQELLMKMLALSCKLEREFRCVELADLMTQNAVNLAIKYASRSRKLILAQKLSELAVEKAAELTATQVEEEEEEEDFRKKLNAGYSNTATEWSQPRFRNQVEEDAEDSGEADDEEKPEIHKPGQNSFSKSTNSSDVSAKSGAVTFSSQGRVNPFKVSASSKEPAMSMNSARSTNILDNMGKSSKKSTALSRTTNNEKSPIIKPLIPKPKPKQASAASYFQKRNSQTNKTEEVKEENLKNVLSETPAICPPQNTENQRPKTGFQMWLEENRSNILSDNPDFSDEADIIKEGMIRFRVLSTEERKVWANKAKGETASEGTEAKKRKRVVDESDETENQEEKAKENLNLSKKQKPLDFSTNQKLSAFAFKQE

SEQ ID NO: 32580 - protein, 246 aa, Homo sapiens
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVLELLDKYLIPNATQPESKVFYLKMKGDYFRYLSEVASGDNKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 32581 - protein, 246 aa, Homo sapiens; identical to SEQ ID NO: 32580

SEQ ID NO: 32582 - protein, 683 aa, Homo sapiens
MASGPGSQEREGLLIVKLEEDCAWSQELPPPDPGPSPEASHLRFRRFRFQEAAGPREALSRLQELCHGWLRPEMRTKEQILELLVLEQFLTILPQEIQSRVQELHPESGEEAVTLVEDMQRELGRLRQQVTNHGRGTEVLLEEPLPLETARESPSFKLEPMETERSPGPRLQELLGPSPQRDPQAVKERALSAPWLSLFPPEGNMEDKEMTGPQLPESLEDVAMYISQEEWGHQDPSKRALSRDTVQESYENVDSLESHIPSQEVPGTQVGQGGKLWDPSVQSCKEGLSPRGPAPGEEKFENLEGVPSVCSENIHPQVLLPDQARGEVPWSPELGRPHDRSQGDWAPPPEGGMEQALAGASSGRELGRPKELQPKKLHLCPLCGKNFSNNSNLIRHQRIHAAERLCMGVDCTEIFGGNPRFLSLHRAHLGEEAHKCLECGKCFSQNTHLTRHQRTHTGEKPYQCNICGKCFSCNSNLHRHQRTHTGEKPYKCPECGEIFAHSSNLLRHQRIHTGERPYKCPECGKSFSRSSHLVIHERTHERERLYPFSECGEAVSDSTPFLTNHGAHKAEKKLFECLTCGKSFRQGMHLTRHQRTHTGEKPYKCTLCGENFSHRSNLIRHQRIHTGEKPYTCHECGDSFSHSSNRIRHLRTHTGERPYKCSECGESFSRSSRLMSHQRTHTG

SEQ ID NO: 32583 - protein, 654 aa, Homo sapiens
MAAVALRDSAQGMTFEDVAIYFSQEEWELLDESQRFLYCDVMLENFAHVTSLGYCHGMENEAIASEQSVSIQVRTSKGNTPTQKTHLSEIKMCVPVLKDILPAAEHQTTSPVQKSYLGSTSMRGFCFSADLHQHQKHYNEEEPWKRKVDEATFVTGCRFHVLNYFTCGEAFPAPTDLLQHEATPSGEEPHSSSSKHIQAFFNAKSYYKWGEYRKASSHKHTLVQHQSVCSEGGLYECSKCEKAFTCKNTLVQHQQIHTGQKMFECSECEESFSKKCHLILHKIIHTGERPYECSDREKAFIHKSEFIHHQRRHTGGVRHECGECRKTFSYKSNLIEHQRVHTGERPYECGECGKSFRQSSSLFRHQRVHSGERPYQCCECGKSFRQIFNLIRHRRVHTGEMPYQCSDCGKSFSCKSELIQHQRIHSGERPYECRECGKSFRQFSNLIRHRSIHTGDRPYECSECEKSFSRKFILIQHQRVHTGERPYECSECGKSFTRKSDLIQHRRIHTGTRPYECSECGKSFRQRSGLIQHRRLHTGERPYECSECGKSFSQSASLIQHQRVHTGERPYECSECGKSFSQSSSLIQHQRGHTGERPYECSQCGKPFTHKSDLIQHQRVHTGERPYECSECGKSFSRKSNLIRHRRVHTEERP

SEQ ID NO: 32584 - protein, 230 aa, Homo sapiens
MEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLREAFEQLQAKKQMAMEKRRAVQNQWQLQQEKHLQHLAEVSAEGKLLFPEAEAEAENLPDDKPQQPTRPQEQSTGDTMGRDPGVSFKAVGLQPAGDVNLP

SEQ ID NO: 32585 - protein, 48 aa, Homo sapiens
MEAAETEAEAAALEVLAEVAGILEPVGLQEEAELPAKILVEFVVVCTR

SEQ ID NO: 32586 - protein, 277 aa, Homo sapiens
MEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLREAFEQLQAKKQMAMEKRRAVQNQWQLQQEKHLQHLAEVSAEVRERKTGTQQELDRVFQKLGNLKQQAEQERDKLQRYQTFLQLLYTLQGKLLFPEAEAEAENLPDDKPQQPTRPQEQSTGDTMGRDPGVSFKAVGLQPAGDVNLP

SEQ ID NO: 32587 - protein, 277 aa, Homo sapiens; identical to SEQ ID NO: 32586

SEQ ID NO: 32588 - DNA, 17 bp, Homo sapiens
gatcgtattctggattc

SEQ ID NO: 32589 - DNA, 17 bp, Homo sapiens
gatcccagcttctccgg

SEQ ID NO: 32590 - DNA, 17 bp, Homo sapiens
gatcctgtgcaacaaga

SEQ ID NO: 32591 - DNA, 17 bp, Homo sapiens
gatccaacatgtaaatg

SEQ ID NO: 32592 - DNA, 17 bp, Homo sapiens
gatcccccacgaaatgt

SEQ ID NO: 32593 - DNA, 17 bp, Homo sapiens
gatctcttccaggaagt

SEQ ID NO: 32594 - DNA, 17 bp, Homo sapiens
gatctttgttggtatgc

SEQ ID NO: 32595 - DNA, 17 bp, Homo sapiens
gatctttggatacttga

SEQ ID NO: 32596 - DNA, 17 bp, Homo sapiens
gatctgttctggaagct

SEQ ID NO: 32597 - DNA, 17 bp, Homo sapiens
gatcttgtttacagcag

SEQ ID NO: 32598 - DNA, 17 bp, Homo sapiens
gatcatattctttcgaa

SEQ ID NO: 32599 - DNA, 17 bp, Homo sapiens
gatcacgtaagcatggg

SEQ ID NO: 32600 - DNA, 17 bp, Homo sapiens
gatctcggtttgccaaa

SEQ ID NO: 32601 - DNA, 17 bp, Homo sapiens
gatcagaactgataaaa

SEQ ID NO: 32602 - DNA, 17 bp, Homo sapiens
gatcagatgaagctgta

SEQ ID NO: 32603 - DNA, 17 bp, Homo sapiens
gatcactgaggaacagg

SEQ ID NO: 32604 - DNA, 17 bp, Homo sapiens
gatcagaataatgaata

SEQ ID NO: 32605 - DNA, 17 bp, Homo sapiens
gatctgtctgccccagc

SEQ ID NO: 32606 - DNA, 17 bp, Homo sapiens
gatctctgtcagccact

SEQ ID NO: 32607 - DNA, 17 bp, Homo sapiens
gatccgcacaccttggc

SEQ ID NO: 32608 - DNA, 17 bp, Homo sapiens
gatccggtgcagcggga

SEQ ID NO: 32609 - DNA, 17 bp, Homo sapiens
gatcattgagaatcgag

SEQ ID NO: 32610 - DNA, 17 bp, Homo sapiens
gatcacgctgagcagca

SEQ ID NO: 32611 - DNA, 17 bp, Homo sapiens
gatctggtagaagttca

SEQ ID NO: 32612 - DNA, 17 bp, Homo sapiens
gatcatcataatacaat

SEQ ID NO: 32613 - DNA, 17 bp, Homo sapiens
gatcaaaaacagaaaaa

SEQ ID NO: 32614 - DNA, 17 bp, Homo sapiens
gatccccattccatgca

SEQ ID NO: 32615 - DNA, 17 bp, Homo sapiens
gatccttttatccttgg

SEQ ID NO: 32616 - DNA, 17 bp, Homo sapiens
gatctttatccaaatcc

SEQ ID NO: 32617 - DNA, 17 bp, Homo sapiens
gatcatcagtcaccgaa

SEQ ID NO: 32618 - DNA, 17 bp, Homo sapiens
gatctaccgaaaagatt

SEQ ID NO: 32619 - DNA, 17 bp, Homo sapiens
gatcaaggatagacaag

SEQ ID NO: 32620 - DNA, 17 bp, Homo sapiens
gatcttcaacaactcac

SEQ ID NO: 32621 - DNA, 17 bp, Homo sapiens
gatctaggcctcatctt

SEQ ID NO: 32622 - DNA, 17 bp, Homo sapiens
gatcctcaacagattca

SEQ ID NO: 32623 - DNA, 17 bp, Homo sapiens
gatctattatcatattt

SEQ ID NO: 32624 - DNA, 17 bp, Homo sapiens
gatccagctaataaata

SEQ ID NO: 32625 - DNA, 17 bp, Homo sapiens
gatcctggtcctcactt

SEQ ID NO: 32626 - DNA, 17 bp, Homo sapiens
gatcctgttggatgtga

SEQ ID NO: 32627 - DNA, 17 bp, Homo sapiens
gatcccttccttatggc

SEQ ID NO: 32628 - DNA, 17 bp, Homo sapiens
gatcaccatcaagccag

SEQ ID NO: 32629 - DNA, 17 bp, Homo sapiens
gatcatggcagaatgag

SEQ ID NO: 32630 - DNA, 17 bp, Homo sapiens
gatctctttatttttat

SEQ ID NO: 32631 - DNA, 17 bp, Homo sapiens
gatcgtttaataaaaat

SEQ ID NO: 32632 - DNA, 17 bp, Homo sapiens
gatcaactagaagaatt

SEQ ID NO: 32633 - DNA, 17 bp, Homo sapiens
gatccccaaactaataa

SEQ ID NO: 32634 - DNA, 17 bp, Homo sapiens
gatcctttttacctgtt

SEQ ID NO: 32635 - DNA, 17 bp, Homo sapiens
gatcgggagaggcaaga

SEQ ID NO: 32636 - DNA, 17 bp, Homo sapiens
gatcctgcgaaaacaca

SEQ ID NO: 32637 - DNA, 17 bp, Homo sapiens
gatcatattctacatgt

SEQ ID NO: 32638 - DNA, 17 bp, Homo sapiens
gatccattttctatttt

SEQ ID NO: 32639 - DNA, 17 bp, Homo sapiens
gatctgctggtttcagg

SEQ ID NO: 32640 - DNA, 17 bp, Homo sapiens
gatcagtacaaggaagg

SEQ ID NO: 32641 - DNA, 17 bp, Homo sapiens
gatcaacgaacttcatg

SEQ ID NO: 32642 - DNA, 17 bp, Homo sapiens
gatcagaattatcatct

SEQ ID NO: 32643 - DNA, 17 bp, Homo sapiens
gatcttaacaatgtgga

SEQ ID NO: 32644 - DNA, 17 bp, Homo sapiens
gatccatcacaatgtga

SEQ ID NO: 32645 - DNA, 17 bp, Homo sapiens
gatcaacaagagttacc

SEQ ID NO: 32646 - DNA, 17 bp, Homo sapiens
gatccacagagacagca

SEQ ID NO: 32647 - DNA, 17 bp, Homo sapiens
gatcctgcaaatatttt

SEQ ID NO: 32648 - DNA, 17 bp, Homo sapiens
gatccaggctcactgtg

SEQ ID NO: 32649 - DNA, 17 bp, Homo sapiens
gatcaagagaatcaaca

SEQ ID NO: 32650 - DNA, 17 bp, Homo sapiens
gatccctcgggttttgt

SEQ ID NO: 32651 - DNA, 17 bp, Homo sapiens
gatcagcagctcagtca

SEQ ID NO: 32652 - DNA, 17 bp, Homo sapiens
gatctgtgtgcgcagta

SEQ ID NO: 32653 - DNA, 17 bp, Homo sapiens
gatcgggttttctgatt

SEQ ID NO: 32654 - DNA, 17 bp, Homo sapiens
gatcaggaaaatctgca

SEQ ID NO: 32655 - DNA, 17 bp, Homo sapiens
gatccacgcgtggctgt

SEQ ID NO: 32656 - DNA, 17 bp, Homo sapiens
gatccaggcaatcgttc

SEQ ID NO: 32657 - DNA, 17 bp, Homo sapiens
gatcaacagaaaaggaa

SEQ ID NO: 32658 - DNA, 17 bp, Homo sapiens
gatcattcacaggtgag

SEQ ID NO: 32659 - DNA, 17 bp, Homo sapiens
gatctggtcatgataac

SEQ ID NO: 32660 - DNA, 17 bp, Homo sapiens
gatcacctgtgtatgtc

SEQ ID NO: 32661 - DNA, 17 bp, Homo sapiens
gatcagagaagatgata

SEQ ID NO: 32662 - DNA, 17 bp, Homo sapiens
gatccactatctcaaaa

SEQ ID NO: 32663 - DNA, 17 bp, Homo sapiens
gatcctttcattcttct

SEQ ID NO: 32664 - DNA, 17 bp, Homo sapiens
gatccccgactctgccc

SEQ ID NO: 32665 - DNA, 17 bp, Homo sapiens
gatcatccatctgctga

SEQ ID NO: 32666 - DNA, 17 bp, Homo sapiens
gatcgcttgagtcccga

SEQ ID NO: 32667 - DNA, 17 bp, Homo sapiens
gatcttgctgcagcccg

SEQ ID NO: 32668 - DNA, 17 bp, Homo sapiens
gatctcttgaaaacatc

SEQ ID NO: 32669 - DNA, 17 bp, Homo sapiens
gatctcagctttgagaa

SEQ ID NO: 32670 - DNA, 17 bp, Homo sapiens
gatcttttttataaccg

SEQ ID NO: 32671 - DNA, 17 bp, Homo sapiens
gatcatcagtaaagact

SEQ ID NO: 32672 - DNA, 17 bp, Homo sapiens
gatcaggatgagttaga

SEQ ID NO: 32673 - DNA, 17 bp, Homo sapiens
gatctatagctcagttt

SEQ ID NO: 32674 - DNA, 17 bp, Homo sapiens
gatcctgtatatggtga

SEQ ID NO: 32675 - DNA, 17 bp, Homo sapiens
gatcctgggccccagca

SEQ ID NO: 32676 - DNA, 17 bp, Homo sapiens
gatcttctttttctatg

SEQ ID NO: 32677 - DNA, 17 bp, Homo sapiens
gatctccttactagtgt

SEQ ID NO: 32678 - DNA, 17 bp, Homo sapiens
gatcgaagtggtatcac

SEQ ID NO: 32679 - DNA, 17 bp, Homo sapiens
gatctgtcatgaataac

SEQ ID NO: 32680 - DNA, 17 bp, Homo sapiens
gatcttccagattactt

SEQ ID NO: 32681 - DNA, 17 bp, Homo sapiens
gatctggcattcagttg

SEQ ID NO: 32682 - DNA, 17 bp, Homo sapiens
gatcatagggaaaagtg

SEQ ID NO: 32683 - DNA, 17 bp, Homo sapiens
gatctggagaatggagg

SEQ ID NO: 32684 - DNA, 17 bp, Homo sapiens
gatctcaagaaatgtta

SEQ ID NO: 32685 - DNA, 17 bp, Homo sapiens
gatctcaagacttcatg

SEQ ID NO: 32686 - DNA, 17 bp, Homo sapiens
gatctgagcttgctttt

SEQ ID NO: 32687 - DNA, 17 bp, Homo sapiens
gatcaactaaaatggag

SEQ ID NO: 32688 - DNA, 17 bp, Homo sapiens
gatcaaattcatggtca

SEQ ID NO: 32689 - DNA, 17 bp, Homo sapiens
gatccgtagatttaata

SEQ ID NO: 32690 - DNA, 17 bp, Homo sapiens
gatctttcaggaatagc

SEQ ID NO: 32691 - DNA, 17 bp, Homo sapiens
gatccaaaagcaaagca

SEQ ID NO: 32692 - DNA, 17 bp, Homo sapiens
gatcctgtcactatggt

SEQ ID NO: 32693 - DNA, 17 bp, Homo sapiens
gatcaaattctgcattt

SEQ ID NO: 32694 - DNA, 17 bp, Homo sapiens
gatcttcaacctttacc

SEQ ID NO: 32695 - DNA, 17 bp, Homo sapiens
gatcatttcagttacct

SEQ ID NO: 32696 - DNA, 17 bp, Homo sapiens
gatctaaggtccctgca

SEQ ID NO: 32697 - DNA, 17 bp, Homo sapiens
gatcctcagggccccag

SEQ ID NO: 32698 - DNA, 17 bp, Homo sapiens
gatcagataccaccaag

SEQ ID NO: 32699 - DNA, 17 bp, Homo sapiens
gatcatcaacgacaatg

SEQ ID NO: 32700 - DNA, 17 bp, Homo sapiens
gatcagatatttgctcc

SEQ ID NO: 32701 - DNA, 17 bp, Homo sapiens
gatcattgcccaaagtt

SEQ ID NO: 32702 - DNA, 17 bp, Homo sapiens
gatctgtgattgtactg

SEQ ID NO: 32703 - DNA, 17 bp, Homo sapiens
gatcatgaggatgtttc

SEQ ID NO: 32704 - DNA, 17 bp, Homo sapiens
gatcggtagcaacaaac

SEQ ID NO: 32705 - DNA, 17 bp, Homo sapiens
gatctcatccaaccaac

SEQ ID NO: 32706 - DNA, 17 bp, Homo sapiens
gatcttttctgcttttt

SEQ ID NO: 32707 - DNA, 17 bp, Homo sapiens
gatcccatcgttttgtt

SEQ ID NO: 32708 - DNA, 17 bp, Homo sapiens
gatccttggagaagtca

SEQ ID NO: 32709 - DNA, 17 bp, Homo sapiens
gatcttcaaaaccaaac

SEQ ID NO: 32710 - DNA, 17 bp, Homo sapiens
gatcaaaagtctacata

SEQ ID NO: 32711 - DNA, 17 bp, Homo sapiens
gatcttgaagaatgtat

SEQ ID NO: 32712 - DNA, 17 bp, Homo sapiens
gatcagagaaaccaact

SEQ ID NO: 32713 - DNA, 17 bp, Homo sapiens
gatccaggaggatggct

SEQ ID NO: 32714 - DNA, 17 bp, Homo sapiens
gatctcttcctacatct

SEQ ID NO: 32715 - DNA, 17 bp, Homo sapiens
gatcttaactagtaact

SEQ ID NO: 32716 - DNA, 17 bp, Homo sapiens
gatctgttatgctttgt

SEQ ID NO: 32717 - DNA, 17 bp, Homo sapiens
gatcacaccactgtgta

SEQ ID NO: 32718 - DNA, 17 bp, Homo sapiens
gatcagcacgaattgcg

SEQ ID NO: 32719 - DNA, 17 bp, Homo sapiens
gatcatgaatgaggtgt

SEQ ID NO: 32720 - DNA, 17 bp, Homo sapiens
gatccagaacacttcga

SEQ ID NO: 32721 - DNA, 17 bp, Homo sapiens
gatcataatggttccga

SEQ ID NO: 32722 - DNA, 17 bp, Homo sapiens
gatcagggcagaggcag

SEQ ID NO: 32723 - DNA, 17 bp, Homo sapiens
gatcttttggccccatt

SEQ ID NO: 32724 - DNA, 17 bp, Homo sapiens
gatcacatgagagcaaa

SEQ ID NO: 32725 - DNA, 17 bp, Homo sapiens
gatctaactccactttt

SEQ ID NO: 32726 - DNA, 17 bp, Homo sapiens
gatcgagatggtccagt

SEQ ID NO: 32727 - DNA, 17 bp, Homo sapiens
gatcataatcctaaaaa

SEQ ID NO: 32728 - DNA, 17 bp, Homo sapiens
gatcaatccacttcatg

SEQ ID NO: 32729 - DNA, 17 bp, Homo sapiens
gatcaaaggagaggata

SEQ ID NO: 32730 - DNA, 17 bp, Homo sapiens
gatcagtattactttat

SEQ ID NO: 32731 - DNA, 17 bp, Homo sapiens
gatcctgcagaagaaat

SEQ ID NO: 32732 - DNA, 17 bp, Homo sapiens
gatctgagcactatcag

SEQ ID NO: 32733 - DNA, 17 bp, Homo sapiens
gatcactgtgctataat

SEQ ID NO: 32734 - DNA, 17 bp, Homo sapiens
gatccttcattgggtac

SEQ ID NO: 32735 - DNA, 17 bp, Homo sapiens
gatcaagaattttcaga

SEQ ID NO: 32736 - DNA, 17 bp, Homo sapiens
gatcaaatgccacttcc

SEQ ID NO: 32737 - DNA, 17 bp, Homo sapiens
gatccgggaaatcaatg

SEQ ID NO: 32738 - DNA, 17 bp, Homo sapiens
gatcagctgtttgtcat

SEQ ID NO: 32739 - DNA, 17 bp, Homo sapiens
gatcaacattccagcct

SEQ ID NO: 32740 - DNA, 17 bp, Homo sapiens
gatcttttcctaattca

SEQ ID NO: 32741 - DNA, 17 bp, Homo sapiens
gatccagaaagaaaaga

SEQ ID NO: 32742 - DNA, 17 bp, Homo sapiens
gatctcactgttattat

SEQ ID NO: 32743 - DNA, 17 bp, Homo sapiens
gatctactgtacaactt

SEQ ID NO: 32744 - DNA, 17 bp, Homo sapiens
gatccagtttcagggtg

SEQ ID NO: 32745 - DNA, 17 bp, Homo sapiens
gatctgcacaccttgag

SEQ ID NO: 32746 - DNA, 17 bp, Homo sapiens
gatctaaaagacatttt

SEQ ID NO: 32747 - DNA, 17 bp, Homo sapiens
gatcacatctgattgtc

SEQ ID NO: 32748 - DNA, 17 bp, Homo sapiens
gatcatttgcaatggaa

SEQ ID NO: 32749 - DNA, 17 bp, Homo sapiens
gatcttaagtaaaggtt

SEQ ID NO: 32750 - DNA, 17 bp, Homo sapiens
gatccaaaaaggaaaga

SEQ ID NO: 32751 - DNA, 17 bp, Homo sapiens
gatccgttcagtgtcac

SEQ ID NO: 32752 - DNA, 17 bp, Homo sapiens
gatcagccctcactgtg

SEQ ID NO: 32753 - DNA, 17 bp, Homo sapiens
gatcattatcagaaaat

SEQ ID NO: 32754 - DNA, 17 bp, Homo sapiens
gatcacatagaaagtaa

SEQ ID NO: 32755 - DNA, 17 bp, Homo sapiens
gatctgatgaaactaaa

SEQ ID NO: 32756 - DNA, 17 bp, Homo sapiens
gatccagggattttaat

SEQ ID NO: 32757 - DNA, 2534 bp, Homo sapiens
gggattgggagggcttcttgcaggctgctgggctggggctaagggctgctcagtttccttcagcggggcactgggaagcgccatggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaa

SEQ ID NO: 32758 - DNA, 2373 bp, Homo sapiens
gggattgggagggcttcttgcaggctgctgggctggggctaagggctgctcagtttccttcagcggggcactgggaagcgccatggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaa

SEQ ID NO: 32759 - DNA, 4314 bp, Homo sapiens
cgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaac

SEQ ID NO: 32760 - DNA, 1765 bp, Homo sapiens
gctgcgagcagagagggattcctcggaggtcatctgttccatcttcttgcctatgcaaatgcctgcctgaagctgctggaggctggctttgtaccggactttgtacagggaaccagggaaacgaatgcagagtgctcctgacattgcctgtcactttttcccatgatactctggcttcacagtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaac

SEQ ID NO: 32761 - DNA, 2024 bp, Homo sapiens
gtgcgcgcgcccggtccgcgcctccgccgctttttatagcggccgcgggcggcggcggcagcggttggaggttgtaggaccggcgaggaataggaatcatggcggctgcgctgttcgtgctgctgggattcgcgctgctgggcacccacggagcctccggggctgccggcttcgtccaggcgccgctgtcccagcagaggtgggtggggggcagtgtggagctgcactgcgaggccgtgggcagcccggtgcccgagatccagtggtggtttgaagggcagggtcccaacgacacctgctcccagctctgggacggcgcccggctggaccgcgtccacatccacgccacctaccaccagcacgcggccagcaccatctccatcgacacgctcgtggaggaggacacgggcacttacgagtgccgggccagcaacgacccggatcgcaaccacctgacccgggcgcccagggtcaagtgggtccgcgcccaggcagtcgtgctagtcctggaacccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaaaaaaaaaaaaaaaaaaa

SEQ ID NO: 32762 - DNA, 1676 bp, Homo sapiens
gtgcgcgcgcccggtccgcgcctccgccgctttttatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaaaaaaaaaaaaaaaaaaa

SEQ ID NO: 32763 - DNA, 1766 bp, Homo sapiens
ttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaaaaaaaaaaaaaaaaaaa

SEQ ID NO: 32764 - DNA, 1609 bp, Homo sapiens
ttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaagggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaaaaaaaaaaaaaaaaaaa

SEQ ID NO: 32765 - DNA, 1871 bp, Homo sapiens
gagatgggttggctgcagtagtgagaggctgggggtgcggctctttccctgcagtcctgccgaggaagcgtgcgtccctggcgcttccttcttctcttccggcggagagcttgggatgtggtaatgccagccacactcctcagagccgtggccagatctcatcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcacaccttccaaccatgaaatcctttggtactcacaggagagtgacccacaaaccaaatctgttgggttctaaatggtttataaaaatattaaagaggcatttctcatctgtatcaatggaaacatttgttccaaaacaagacttcccacaggtgaagagaccactaaaagcatccaggaccagacagccatccaggaccaaccttccagttctgtctgtgaacgaggacccaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctgatcaagtgataaccaaagtgtcactgcaagagatattcaagttctacaatcaaaaattaaatgttcggcccggcgcggtgcctcatgcctgtaatcccagcactttcggaggccaagaagggtggcttgagatgagatcaggagctcaagacaagcctggccaacatggtgaaaccccatctctactaaaaataccaaaattagccaggtgtgttggcacacgcccgtcatctcagctactcaggaggctgaggcaggagaatctcttgaacttgggaggcggaggttgcagtgagctaagatcacaccactgcactccagccagggcaacagtgagactcagtctcaaaaataaacaataaaataaataaataaatgttcaaaaaaaaaaaaaaaaaa

SEQ ID NO: 32766 - DNA, 2547 bp, Homo sapiens
agcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagttgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctcaaaaaaaaaaaaaaaaaa

SEQ ID NO: 32767 - DNA, 2682 bp, Homo sapiens
agcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagttgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctcaaaaaaaaaaaaaaaaaa

SEQ ID NO: 32768 - DNA, 3338 bp, Homo sapiens
gacgccaccgggcgctgacagacctatggagagtcagggtgtgcctcccgggccttatcgggccaccaagctgtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcagatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaataatccaacttatgttggatttgaacgagatgtattcagaacaatcgcagattattttctagatctccctgaacctctacttacttttgaatattacgaattatttgtaaacattttgggcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacagtttcagaaggaatatcctttgatatatcagaaaagatttccaaccacggagagtgaagcagcactttttggtgacaaacctacaatcaagcaaccaatgctgattttaagaaaaccaaagttccgtagtctaagataactaactgaattaaaaattatgtaatacttgtggaactttgataaatgaagccatatctgagaatgtagctactcaaaaggaagtctgtcattaataaggtatttctaaataaacacattatgtaaggaagtgccaaaatagttatcaatgtgagactcttaggaaactaactagatctcaattgagagcacataacaatagatgataccaaatactttttgtttttaacacagctatccagtaaggctatcatgatgtgtgctaaaattttatttacttgaattttgaaaactgagctgtgttagggattaaactataattctgttcttaaaagaaaatttatctgcaaatgtgcaagttctgagatattagctaatgaattagttgtttggggttacttctttgtttctaagtataagaatgtgaagaatatttgaaaactcaatgaaataattctcagctgccaaatgttgcactcttttatatattctttttccacttttgatctatttatatatatgtatgtgtttttaaaatatgtgtatattttatcagatttggttttgccttaaatattatccccaattgcttcagtcattcatttgttcagtatatatattttgaattctagttttcataatctattagaagatggggatataaaagaagtataaggcaatcatatattcattcaaaagatatttatttagcaactgctatgtgcctttcgttgttccagatatgcagagacaatgataaataaaacatataatctcttccataaggtatttattttttaatcaagggagatacacctatcagatgtttaaaataacaacactacccactgaaatcagggcatatagaatcattcagctaaagagtgacttctatgatgatggaacaggtctctaagctagtggttttcaaactggtacacattagactcacccgaggaattttaaaacagcctatatgcccagggcctaacttacactaattaaatctgaattttggggatgttgtatagggattagtattttttttaatctaggtgattccaatattcagccaactgtgagaatcaatggcctaaatgctttttataaacatttttataagtgtcaagataatggcacattgactttattttttcattggaagaaaatgcctgccaagtataaatgactctcatcttaaaacaaggttcttcaggtttctgcttgattgacttggtacaaacttgaagcaagttgccttctaatttttactccaagattgtttcatatctattccttaagtgtaaagaaatatataatgcatggtttgtaataaaatcttaatgtttaatgactgttctcatttctcaatgtaatttcatactgtttctctataaaatgatagtattccatttaacattactgatttttattaaaaacctggacagaaaattataaattataaatatgactttatcctggctataaaattattgaaccaaaatgaattctttctaaggcatttgaatactaaaacgtttattgtttatagatatgtaaaatgtggattatgttgcaaattgagattaaaattatttggggttttgtaacaatataattttgcttttgtattatagacaaatatataaataataaaggcaggcaactttcatttgcaaaaaaaaaaaaaaaaaaaaaaaaaaaaaaaaaaaaaaaaaaaaaaaaaaaaa

SEQ ID NO: 32769 - DNA, 4571 bp, Homo sapiens
gcagtcagagctgcctctcgccctcgctagctgggctcgcagcctcttcctccctccctggctcctggctttttgtttaaagcaacacccaccctccatccaggctttttttctttctttctttattggtagcggccaaaaagagttgattgctattgggatccgctgagtaaagacacgggcaggggtgcgcggaggtgagaaaactgaagacctggaagatttttttttccttcaaaaacccgtttccatccagtcttcagccagtccagtctactttaatcctcaccaggacaatggattaagtttctcttccctggaccagaagtcgggttcggacttggggcaaaatgaaggaaaaggccatgatcaagaccgctaagatgcaggggaacgtgatggagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatatatcaacactcgtatactggatattacgtcctgagcaaaattcctcatggggatcctcaaagtctggacccaccagaagtcagcaatgcaaaacttcagtatgcaggatggggccctaaaggccaacagctgatatttatttttgaaaacaatatctactactgtgcacatgtcgggaaacaggccatccgtgtggtctccactggcaaggaaggtgtgatttacaatggcctcagtgactggctgtatgaagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggctggaagtgagaaccccagcatttccctacacgttattggcttaaatggacccacccatgatctggagatgatgccgcctgatgatccacggatgagggagtactacatcaccatggtgaagtgggccaccagcaccaaggtcgccgtgacctggctgaaccgggcgcagaacgtgtccatcctcaccctctgcgacgccaccacgggggtctgcacgaagaaacacgaggatgaaagtgaggcctggctccacagacagaatgaagaacctgtgttctccaaggatggccgaaagtttttcttcatcagagccatcccccagggaggacgagggaaattctatcacatcacggtgtcctcgtcccagcccaacagcagcaacgacaacatccagtccatcacctccggggactgggacgtgaccaagatcctagcctacgatgagaaggggaataagatctacttcctgagcacggaggacctgcctcggagacgacaactctacagtgccaacacggtgggcaacttcaacaggcagtgcctctcctgtgacctggttgagaactgcacctacttcagcgcttccttcagccatagcatggacttcttcctgctcaagtgcgaaggtcctggtgttcctatggtgacggtgcacaacacaacagataagaaaaaaatgtttgacctagaaacaaatgaacatgtcaagaaggccataaatgaccgacagatgcctaaagtggaatacagggacattgagattgatgattacaacctgcccatgcagatactgaagccagcaaccttcaccgacaccacccactaccctctgctcctggtggtggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggacgatgctgaaggagcagtacattgacaggacgcgcgtggccgtgtttgggaaggattacggtggctacctgagcacctacatcctcccagcaaagggagaaaatcaaggccagacattcacctgcggctctgctctctctccaataacagacttcaaactctatgcctctgcgttttccgagaggtacttgggcctccatggacttgacaacagagcatacgagatgaccaaggtagcccatcgagtctccgcgctggaagaacagcagttcctgatcattcatcccactgccgatgaaaaaattcatttccagcacacagcagaactcattacacaactaattaggggaaaggctaattacagcttacagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttaccaaaaaaaaaaa

SEQ ID NO: 32770 - DNA, 4460 bp, Homo sapiens
actaagcagcggcagcttcctgcttcggatcctctctctgctgcttgcatttaaagagcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatatatcaacactcgtatactggatattacgtcctgagcaaaattcctcatggggatcctcaaagtctggacccaccagaagtcagcaatgcaaaacttcagtatgcaggatggggccctaaaggccaacagctgatatttatttttgaaaacaatatctactactgtgcacatgtcgggaaacaggccatccgtgtggtctccactggcaaggaaggtgtgatttacaatggcctcagtgactggctgtatgaagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggctggaagtgagaaccccagcatttccctacacgttattggcttaaatggacccacccatgatctggagatgatgccgcctgatgatccacggatgagggagtactacatcaccatggtgaagtgggccaccagcaccaaggtcgccgtgacctggctgaaccgggcgcagaacgtgtccatcctcaccctctgcgacgccaccacgggggtctgcacgaagaaacacgaggatgaaagtgaggcctggctccacagacagaatgaagaacctgtgttctccaaggatggccgaaagtttttcttcatcagagccatcccccagggaggacgagggaaattctatcacatcacggtgtcctcgtcccagcccaacagcagcaacgacaacatccagtccatcacctccggggactgggacgtgaccaagatcctagcctacgatgagaaggggaataagatctacttcctgagcacggaggacctgcctcggagacgacaactctacagtgccaacacggtgggcaacttcaacaggcagtgcctctcctgtgacctggttgagaactgcacctacttcagcgcttccttcagccatagcatggacttcttcctgctcaagtgcgaaggtcctggtgttcctatggtgacggtgcacaacacaacagataagaaaaaaatgtttgacctagaaacaaatgaacatgtcaagaaggccataaatgaccgacagatgcctaaagtggaatacagggacattgagattgatgattacaacctgcccatgcagatactgaagccagcaaccttcaccgacaccacccactaccctctgctcctggtggtggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggacgatgctgaaggagcagtacattgacaggacgcgcgtggccgtgtttgggaaggattacggtggctacctgagcacctacatcctcccagcaaagggagaaaatcaaggccagacattcacctgcggctctgctctctctccaataacagacttcaaactctatgcctctgcgttttccgagaggtacttgggcctccatggacttgacaacagagcatacgagatgaccaaggtagcccatcgagtctccgcgctggaagaacagcagttcctgatcattcatcccactgccgatgaaaaaattcatttccagcacacagcagaactcattacacaactaattaggggaaaggctaattacagcttacagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttaccaaaaaaaaaaa

SEQ ID NO: 32771 - DNA, 4542 bp, Homo sapiens
gctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccgcgggcgcaggcggcggcgccccgggagcgcggcggcggcggcggcggcgcgggtggccggccccggttccagtaccaggcgcggagcgatggtgacgaggaggacgagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatatatcaacactcgtatactggatattacgtcctgagcaaaattcctcatggggatcctcaaagtctggacccaccagaagtcagcaatgcaaaacttcagtatgcaggatggggccctaaaggccaacagctgatatttatttttgaaaacaatatctactactgtgcacatgtcgggaaacaggccatccgtgtggtctccactggcaaggaaggtgtgatttacaatggcctcagtgactggctgtatgaagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggctggaagtgagaaccccagcatttccctacacgttattggcttaaatggacccacccatgatctggagatgatgccgcctgatgatccacggatgagggagtactacatcaccatggtgaagtgggccaccagcaccaaggtcgccgtgacctggctgaaccgggcgcagaacgtgtccatcctcaccctctgcgacgccaccacgggggtctgcacgaagaaacacgaggatgaaagtgaggcctggctccacagacagaatgaagaacctgtgttctccaaggatggccgaaagtttttcttcatcagagccatcccccagggaggacgagggaaattctatcacatcacggtgtcctcgtcccagcccaacagcagcaacgacaacatccagtccatcacctccggggactgggacgtgaccaagatcctagcctacgatgagaaggggaataagatctacttcctgagcacggaggacctgcctcggagacgacaactctacagtgccaacacggtgggcaacttcaacaggcagtgcctctcctgtgacctggttgagaactgcacctacttcagcgcttccttcagccatagcatggacttcttcctgctcaagtgcgaaggtcctggtgttcctatggtgacggtgcacaacacaacagataagaaaaaaatgtttgacctagaaacaaatgaacatgtcaagaaggccataaatgaccgacagatgcctaaagtggaatacagggacattgagattgatgattacaacctgcccatgcagatactgaagccagcaaccttcaccgacaccacccactaccctctgctcctggtggtggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggacgatgctgaaggagcagtacattgacaggacgcgcgtggccgtgtttgggaaggattacggtggctacctgagcacctacatcctcccagcaaagggagaaaatcaaggccagacattcacctgcggctctgctctctctccaataacagacttcaaactctatgcctctgcgttttccgagaggtacttgggcctccatggacttgacaacagagcatacgagatgaccaaggtagcccatcgagtctccgcgctggaagaacagcagttcctgatcattcatcccactgccgatgaaaaaattcatttccagcacacagcagaactcattacacaactaattaggggaaaggctaattacagcttacagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttaccaaaaaaaaaaa

SEQ ID NO: 32772 - DNA, 6864 bp, Homo sapiens
ccaagtacctagggtggtggccgagtcccgcctcccgccagcgggggcgaggacctgcgacgcgcacccctgcctggcccggtctcctcagcaccagccccacgcacaccctacttcctcagcttctcgccctcaccctgccaacttccctgcgaggagggacctgccgccagcctgcttcctcgtccgcaggccctgcgctgaacgctgccgcgcccagggttcaccttgcgccgtcgggaaagcccatgaactctccagaaacggcgtaaaggagggtcccgccgcggcgcagggctggggcgcctgggttccccctgggtggagcagcggcagcagagcgggaaagtggtggaggatgatcttgcggccaaaggggacctcggcgcagtaatgtcaacatgatgtttcgctcagatcgaatgtggagctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcaaaatgtttgttgaataatgcattacctgtcaaagaaaaagaagacatttttgcagaaagctttgaacagctctgccttgtttggaataattctttgggctctattggtgtaaatttcaaaagaaactatgaaacagttccatgtgattctaccattagtaaagttattcctgggaatgggaaattgttgttgggctccaatcaaaatgaaattgtctctctaaaaggggacatttataactttcgactttggaattttaccatgaatgccaaaatcctctccaacctcagctgtaatgtgaaagggaatgtagtcgactggcaaaatgacttctggaatatcccaaacctagctctgaaagctgaaagcaacctaagctgtggttcctacctgatcccgctcccagcagcagaactggccagctgtgcagacctggggaccctctgtcaagatggaattatctatagaatatccgtagtgattcagaacatccttcgtcaccctgaggtaaaagtacagagcaaggtggcagaatggctcaattcaaccttccaaaattggaactacacggtttatgtcgttaatatcagttttcacctgagtgctggagaggacaagattaaagtcaagagaagccttgaggatgagccaaggttggtgctttgggcccttctagtttacaatgctaccaacaatactaatttagaaggaaaaatcattcagcagaagctcctaaaaaataatgagtccttggatgaaggcttgaggctacatacagtgaatgtgagacaactgggtcattgtcttgccatggaggaacccaaaggctactactggccatctatccaaccttctgaatacgttcttccttgtccagacaagcctggcttttctgcttctcggatatgtttttacaatgctaccaacccattggtaacctactggggacctgttgatatctccaactgtttaaaagaagcaaatgaagttgctaaccagattttaaatttaactgctgatgggcagaacttaacctcagccaatattaccaacattgtggaacaggtcaaaagaattgtgaataaagaagaaaacattgatataacacttggctcaactctaatgaatatattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcggcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagataatgtctcctatgagcattccttcaacaaaagtggatcactcagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctacttttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatataggtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttc

SEQ ID NO: 32773 - DNA, 6818 bp, Homo sapiens
ccaagtacctagggtggtggccgagtcccgcctcccgccagcgggggcgaggacctgcgacgcgcacccctgcctggcccggtctcctcagcaccagccccacgcacaccctacttcctcagcttctcgccctcaccctgccaacttccctgcgaggagggacctgccgccagcctgcttcctcgtccgcaggccctgcgctgaacgctgccgcgcccagggttcaccttgcgccgtcgggaaagcccatgaactctccagaaacggcgtaaaggagggtcccgccgcggcgcagggctggggcgcctgggttccccctgggtggagcagcggcagcagagcgggaaagtggtggaggatgatcttgcggccaaaggggacctcggcgcagtaatgtcaacatgatgtttcgctcagatcgaatgtggagctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcaaaatgtttgttgaataatgcattacctgtcaaagaaaaagaagacatttttgcagaaagctttgaacagctctgccttgtttggaataattctttgggctctattggtgtaaatttcaaaagaaactatgaaacagttccatgtgattctaccattagtaaagttattcctgggaatgggaaattgttgttgggctccaatcaaaatgaaattgtctctctaaaaggggacatttataactttcgactttggaattttaccatgaatgccaaaatcctctccaacctcagctgtaatgtgaaagggaatgtagtcgactggcaaaatgacttctggaatatcccaaacctagctctgaaagctgaaagcaacctaagctgtggttcctacctgatcccgctcccagcagcagaactggccagctgtgcagacctggggaccctctgtcaagatggaattatctatagaatatccgtagtgattcagaacatccttcgtcaccctgaggtaaaagtacagagcaaggtggcagaatggctcaattcaaccttccaaaattggaactacacggtttatgtcgttaatatcagttttcacctgagtgctggagaggacaagattaaagtcaagagaagccttgaggatgagccaaggttggtgctttgggcccttctagtttacaatgctaccaacaatactaatttagaaggaaaaatcattcagcagaagctcctaaaaaataatgagtccttggatgaaggcttgaggctacatacagtgaatgtgagacaactgggtcattgtcttgccatggaggaacccaaaggctactactggccatctatccaaccttctgaatacgttcttccttgtccagacaagcctggcttttctgcttctcggatatgtttttacaatgctaccaacccattggtaacctactggggacctgttgatatctccaactgtttaaaagaagcaaatgaagttgctaaccagattttaaatttaactgctgatgggcagaacttaacctcagccaatattaccaacattgtggaacaggtcaaaagaattgtgaataaagaagaaaacattgatataacacttggctcaactctaatgaatatattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcggcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctacttttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatataggtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttc

SEQ ID NO: 32774 - DNA, 6948 bp, Homo sapiens
ccaagtacctagggtggtggccgagtcccgcctcccgccagcgggggcgaggacctgcgacgcgcacccctgcctggcccggtctcctcagcaccagccccacgcacaccctacttcctcagcttctcgccctcaccctgccaacttccctgcgaggagggacctgccgccagcctgcttcctcgtccgcaggccctgcgctgaacgctgccgcgcccagggttcaccttgcgccgtcgggaaagcccatgaactctccagaaacggcgtaaaggagggtcccgccgcggcgcagggctggggcgcctgggttccccctgggtggagcagcggcagcagagcgggaaagtggtggaggatgatcttgcggccaaaggggacctcggcgcagtaatgtcaacatgatgtttcgctcagatcgaatgtggagctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcaaaatgtttgttgaataatgcattacctgtcaaagaaaaagaagacatttttgcagaaagctttgaacagctctgccttgtttggaataattctttgggctctattggtgtaaatttcaaaagaaactatgaaacagttccatgtgattctaccattagtaaagttattcctgggaatgggaaattgttgttgggctccaatcaaaatgaaattgtctctctaaaaggggacatttataactttcgactttggaattttaccatgaatgccaaaatcctctccaacctcagctgtaatgtgaaagggaatgtagtcgactggcaaaatgacttctggaatatcccaaacctagctctgaaagctgaaagcaacctaagctgtggttcctacctgatcccgctcccagcagcagaactggccagctgtgcagacctggggaccctctgtcaagctactgtaaactctcctagtactacaccacccactgtcaccactaacatgcctgttactaacagaatcgataaacaaaggaatgatggaattatctatagaatatccgtagtgattcagaacatccttcgtcaccctgaggtaaaagtacagagcaaggtggcagaatggctcaattcaaccttccaaaattggaactacacggtttatgtcgttaatatcagttttcacctgagtgctggagaggacaagattaaagtcaagagaagccttgaggatgagccaaggttggtgctttgggcccttctagtttacaatgctaccaacaatactaatttagaaggaaaaatcattcagcagaagctcctaaaaaataatgagtccttggatgaaggcttgaggctacatacagtgaatgtgagacaactgggtcattgtcttgccatggaggaacccaaaggctactactggccatctatccaaccttctgaatacgttcttccttgtccagacaagcctggcttttctgcttctcggatatgtttttacaatgctaccaacccattggtaacctactggggacctgttgatatctccaactgtttaaaagaagcaaatgaagttgctaaccagattttaaatttaactgctgatgggcagaacttaacctcagccaatattaccaacattgtggaacaggtcaaaagaattgtgaataaagaagaaaacattgatataacacttggctcaactctaatgaatatattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcggcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagataatgtctcctatgagcattccttcaacaaaagtggatcactcagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctacttttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatataggtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttc

SEQ ID NO: 32775 - DNA, 6902 bp, Homo sapiens
ccaagtacctagggtggtggccgagtcccgcctcccgccagcgggggcgaggacctgcgacgcgcacccctgcctggcccggtctcctcagcaccagccccacgcacaccctacttcctcagcttctcgccctcaccctgccaacttccctgcgaggagggacctgccgccagcctgcttcctcgtccgcaggccctgcgctgaacgctgccgcgcccagggttcaccttgcgccgtcgggaaagcccatgaactctccagaaacggcgtaaaggagggtcccgccgcggcgcagggctggggcgcctgggttccccctgggtggagcagcggcagcagagcgggaaagtggtggaggatgatcttgcggccaaaggggacctcggcgcagtaatgtcaacatgatgtttcgctcagatcgaatgtggagctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcaaaatgtttgttgaataatgcattacctgtcaaagaaaaagaagacatttttgcagaaagctttgaacagctctgccttgtttggaataattctttgggctctattggtgtaaatttcaaaagaaactatgaaacagttccatgtgattctaccattagtaaagttattcctgggaatgggaaattgttgttgggctccaatcaaaatgaaattgtctctctaaaaggggacatttataactttcgactttggaattttaccatgaatgccaaaatcctctccaacctcagctgtaatgtgaaagggaatgtagtcgactggcaaaatgacttctggaatatcccaaacctagctctgaaagctgaaagcaacctaagctgtggttcctacctgatcccgctcccagcagcagaactggccagctgtgcagacctggggaccctctgtcaagctactgtaaactctcctagtactacaccacccactgtcaccactaacatgcctgttactaacagaatcgataaacaaaggaatgatggaattatctatagaatatccgtagtgattcagaacatccttcgtcaccctgaggtaaaagtacagagcaaggtggcagaatggctcaattcaaccttccaaaattggaactacacggtttatgtcgttaatatcagttttcacctgagtgctggagaggacaagattaaagtcaagagaagccttgaggatgagccaaggttggtgctttgggcccttctagtttacaatgctaccaacaatactaatttagaaggaaaaatcattcagcagaagctcctaaaaaataatgagtccttggatgaaggcttgaggctacatacagtgaatgtgagacaactgggtcattgtcttgccatggaggaacccaaaggctactactggccatctatccaaccttctgaatacgttcttccttgtccagacaagcctggcttttctgcttctcggatatgtttttacaatgctaccaacccattggtaacctactggggacctgttgatatctccaactgtttaaaagaagcaaatgaagttgctaaccagattttaaatttaactgctgatgggcagaacttaacctcagccaatattaccaacattgtggaacaggtcaaaagaattgtgaataaagaagaaaacattgatataacacttggctcaactctaatgaatatattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcggcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctacttttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatataggtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttc

SEQ ID NO: 32776 - DNA, 1715 bp, Homo sapiens
tagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaagtacatttctggatttgggaatgagtgttcttcagaggatcctcgctgcccaggttccctgccagaaggacagaataatcctcaggtctgcccctacaatctctatgctgagcagctctcaggatcggctttcacttgtccacggagcaccaataagagaagctggctgtataggattctaccttcagtttctcacaagccctttgaatccattgacgaaggccatgtcactcacaactgggatgaagttgatcctgatcctaaccagcttagatggaaaccatttgagattccaaaagcatctcagaagaaagtagactttgtgagtggcctgcataccttgtgtggagctggagacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattggggccaatggcttggccaatcctcgtgatttcttgatacccattgcctggtatgaggatcgccaagtaccaggtggttacacggtcattaataaataccagggcaagctgtttgctgccaaacaggatgtctccccgttcaatgttgtggcctggcacgggaattatacaccctacaagtacaacctgaagaatttcatggttatcaactcagtggcctttgaccatgcagacccatccattttcacagtattgactgctaagtctgtccgccctggagtggccattgctgattttgtcatcttcccacctcgatggggggttgctgataagaccttcaggcctccttattaccataggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagattcttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtgga

SEQ ID NO: 32777 - DNA, 1457 bp, Homo sapiens
actgcaacgcggaggagcaggatggagatccctgtgcctgtgcagccgtcttggctgcgccgcgcctcggccccgttgcccggactttcggcgcccggacgcctctttgaccagcgcttcggcgaggggctgctggaggccgagctggctgcgctctgccccaccacgctcgccccctactacctgcgcgcacccagcgtggcgctgcccgtcgcccaggtgccgacggaccccggccacttttcggtgctgctagacgtgaagcacttctcgccggaggaaattgctgtcaaggtggtgggcgaacacgtggaggtgcacgcgcgccacgaggagcgcccggatgagcacggattcgtcgcgcgcgagttccaccgtcgctaccgcctgccgcctggcgtggatccggctgccgtgacgtccgcgctgtcccccgagggcgtcctgtccatccaggccgcaccagcgtcggcccaggccccaccgccagccgcagccaagtaggagggggctgggccgcgcccgcaccccgggagcctcctcaggctccctctattaaagccgatctgactccgcccagccagatgtcccgagtgcgccaaggactgtcctctcacccactcctggattctgccctgacctccatcctggacactgccttgataacatagacccttccactgacaccctcgctctcacaccccctccagctttccgaccccacaccgacaactcctcggcttccagaccctaccagcactaccctaaccctcagccgacagtctcagccccaccgacccactttcttggcatatagccccacttaagacccctcctctacttccttctgagtcctctacaaagacatccgggtactacatttccatcccttccctattttgacaccaaattatggtgtagacagccctcccccaaccccaggccagtcaggcacaatccccccaccccccaaacgtcctggactgcacagacctcccactccagaccatccaggcctggttcccaagacccgatccttcccctgcaaccagacagtctacaactgccccctccagcccattttctgccgtgaaaccccagccagccacaccagactctggaaccctttttcgactgccccaactcttggacaccaggccaactagaacacccaacaccaaactgtacagactctcccaccccaacctccccagactctgcacggatgtcctaggccccctccccaactctaaccagaccccatccccctaagtccctttgtcttgacccccaagtcttcaaccagatatcctcggcaacccacctcccaccctcctcctcttctccttcaagacccaactgagcacccgctctgattccccacagcctttctccctgccaccactcccttagtctttcccaggcttactctcccaataaatgtgctagagctctgc

SEQ ID NO: 32778 - DNA, 1345 bp, Homo sapiens
gagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccaggtgcggtggctcacgcctgtaatcccagcactctgggaggccgaggcgggtggatcatgaggtcaggagatcgagaccatcctgcctaacaaggtgaaaccccgtctctactaaaaatacaaaaaattagccgggcgcggtggcgggcgcctgtagtcccagctactcgggaggctgaggcaggagaatggcgtgaacccgggaagtggagcttgcagtgagccgagattgcgccactgcagtcggcagtccggcttgggcgacagagcgagactccgtctcaaaaaaaaaaaaaaaaaaaaaaaa

SEQ ID NO: 32779 - DNA, 1508 bp, Homo sapiens
gagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccaggtgcggtggctcacgcctgtaatcccagcactctgggaggccgaggcgggtggatcatgaggtcaggagatcgagaccatcctgcctaacaaggtgaaaccccgtctctactaaaaatacaaaaaattagccgggcgcggtggcgggcgcctgtagtcccagctactcgggaggctgaggcaggagaatggcgtgaacccgggaagtggagcttgcagtgagccgagattgcgccactgcagtcggcagtccggcttgggcgacagagcgagactccgtctcaaaaaaaaaaaaaaaaaaaaaaaa

SEQ ID NO: 32780 - DNA, 4994 bp, Homo sapiens
acagtccctggtaaacacaagtagtattacaagtcgggagctcttcaagtcttggatgagactgtagagcggtcttgtgcggcaatgtgctaccttaaaataaataaataaataaacccctgttatgtccggagtttgtttccacccggagaggaatggaagagcaccagagagcgcttagctttctggttggatgttttgggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaatgtctcactttgtctcacaggctggagtgatcacagtggggtgatcacaactcactgcagtctctacctcctcaggctcatgagatcctcccacctcagcctcccgagtagctgggactacagagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcgtgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcctcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactgcctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaagtttcaccaggtgatatggatcggacacaaattgagcttaatccgtacctcacatgtgtattttcaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtcattataaaaaaaaaaaaaaaaaaaaaaaaaaaaaa

SEQ ID NO: 32781 - DNA, 2157 bp, Homo sapiens
atggcggatgagtctgataaagttcaggcgcgaatgcagcgtgcagcggaccgtcagagcgcggcattaaagagcgtgggcgacgctggcgcggcggctgccgcagatatgaaagcccgacagtctgctgcaacggaagggctggccaaagactggcagaacgtttctaagtccgttgatgaaactcaccgccgcgtgaccgagcttaatcagcgtatgcgggaaaatgacggagaggccgcagcgcatgcccgccgtcaggatgaactggcggcatcctttttcctcttagaggaacggcgttcgccagctcaatgggaaaggaagtcgcttgcgaacgtgcagggccgcgcctgcccacggtggcggggcacgcccaggtctctggctcctgggctgggtcgcggcaggggcggagcgcgtgcgaaggcgacgcccccagcccctaggcctcgcccaggcggcttccgcccgcctcttcaacgcgcacgctgctaccgagctgcaggaggccgcgggcgcgagactgggaatgcgcagggcccccgcctggctctacaagcccgggccgcggcccccgccttccccgccgcctcccggcgctccgtgcccgccccacgaggccggcggctgctgctacctggggccgttgctgcttgtgccgtgagcgacggccagccattgtccccgccgctccgtcagccgcgcccggccgcgcgcgcaccggaaggcgcattggcgtcttgcgggctccgggccgggtgggcaggatggcctccacaagccgcatggcgcgcatggggagcctccgttgatgccgccgcgccgccctccgaggctgcatccgcggaagcccggctccccgagcgctccggcccggcccggcgccccggacctgagtgcgtccccatgaaggcgcccgggctggcccaggcggccgtggcagaggagaccccggactgggcgcccgagctctgccccagctccgaggcgcggtcgccggagccgcctgccaaccgccttcaagacttcgacacgctggtcaccgtgggaaagcaactagaagccatttgtgtcaaggtaacgtctggagaaacaaaaggtcaggaacggccaacgtccctactggccacagtccagccccaatctgcaagacagagccagccgccccgggggaattcccgcctggtgggactccacgtcaccagcccccagctgctcagggtacagcccctcgtgagaaccgagccacagtcatgtttcctacatcagcctcctgctcaggggtttgtacagagaccactgccagccctctaggtggtccctgcaaagagagtcccagctcccaaggctccaaatggacagggcaccatgttgaccccttcgttggcctccagttcgccgactgtaacatgtttcatccagttcaggacgtttatttatttccaacttgcatacaaaacatactgagaaactaaaaccatcgttaaaagtgaagacacgttgagacaggtatctcgacctgccaagtatacagctaaagctgagttcataaaaagggatgatttggccgacggtcatctgccagattctgatgatgattcagaactcagtgtggaagaacatcagagggagaggcaggcgctctttgacttatcaagctgctccctgaggcccaaaagcttcaagtgtcagacttgtaaaaagtcatatatagggaagtggggactggcccagcattttaaacttaatccaggccatggccagctggaccctgagatggtgctatctgagaaagccaatgggagcaccctccgtgggtgcacagaggaaaggacgctcagcctgaccttcccggggctgtccgtgccagcggctccgcgtgagggaggggcccgctcctgcttggtgagagagtcagcacgcggtggcctggtctcgctctgtagcctaggctggagtacagtggcgcgatctcggctcactgcaagctccgcctcctggtttcacgccattctcctgcctcagcctcccgactacttaggaggctgaggcaggagaatcacttgaacccaggaggcagaggttgcagtgagctgagactgcgctattgcactccagcctgggcgacagagcgagactctgtctcaaaaaaaa

SEQ ID NO: 32782 - DNA, 4457 bp, Homo sapiens
tgtgattggctgttgccatggatacgctttgtgtagcggctatgggcgctgtcttacaacaaagccaaggaatctcgctgctgagggttctgtgctttattatgaagaataatggacgatgatgatgcaaagctcaaagcagaaatagaagctgaattggataaactcagcatttcctccttggaaaaagaagacattgagagtgatgcaaaatcagaaacccagagtgatgatagtgatacagattcagttgaattaccagaatcagttcttcactgtattaacatcataaagaacaggagtaaagctgttgaagagctcattcttcaggacctggaagatactgatattttaagctgtagttatggagcagtttctaataatcatatgcatttaagaacaggactatcaactgaatatgaagaaagttcagagcaattaattaagatattatctgaaatagaaaaagaagaatttatgagaagtaaaaccgattgtgccactcctgattttgttcctgagcctagtcctcatgacttgcctatggatgaacatgttttaccagatgatgctgatataaattttggatactgtgaagtggaagaaaaatgtagacagtcttttgaggcttggcaagagaaacagaaggaattagaagataaagagaaacaaactctcaaagctcagagggatagagaagaaaaacaatttcaagaagaagaagaaaagcgacattgctggatgaaacaatttaaagttgaaaagaagaaattagagaacattcagaagcaagaacaggacaagatgaatgatgaactctataaagaagagaaaatttggaaagagaaatttaaacagcatgaggagtatattagaaacttgcatttacaaatggaagaagaaagaacaagatttaaagaccaacaagaaaaagaaaaaaattctttgttaaaacagcagaataatgcagctgttaaaattcaagctaaatataaagcatttgtagcctatcaaaaatatggcccaattattaaagagcaaattgaaagtaagaaaaggaaagcacaagagtggaaggaaaaggaagcaaaaatacgacaaaaggaggaagaaaatcgaaaaagattagaggaggaacaaaggataaaagaagagagaaaaaagcaaaaggaagaggaaaggaaaaggagagaaaaagaatatgaagaaaaaaagaatattgtgaaacaggaaagagagcaactaataagcaaggaaaaaataatattaagagaagatgcaagccaacagctaataataagtagtgcattaaagaagagcggatataataacaaacatttaagtcttgaagatatttcaaatgataagggtgatatagccaaaaatctagtggatgaaaattcaaagaagcaggaagatgttctcctttggctagttgaggaatcaaatatgaaagaaaatgtagatagacagactatattaaaagaatcaatacaagtaaagttaaaagaatctatatcaagccaaacaattctggcagattttaaaatggaagaaaaaaatgaaaacctagcaaaaaaacgatgttcagaagaattggtcaagcaagaaagaaaatatgaaaatacagataacaaaactgaattgggaaactctgatctaaaaggaaatctgaaagaacagtttccattgcaagaattaaagtctgatgcacaaaaagaagaaaaaatcatgaaacatgtcataaatgagaatacaggacaaaaaacccagataatattaggacataaccaagaaatcagtgaggtgaaaaccaatgaagagcagaaaataatcaaagataatcagcagaaaaagatacaaaaagtagaaaaagaagagatacaagaacagaatggattattatataaagataaggatactttagttatttcagtgaaacaaagatcactctcactaacatcagaaaattccaaagatgtaagagaaaacgtaatattacaagaaaaagaaatttattcaaaatccaaagaaattgaggagaacccaaaagacaatgcttggaatagtggcattgtgatttttaacacaactgataccatgataaatatagaaggcaaaagaaatgaccaagattatgtgttaggtagacatgctccttgtgagggcttgagtaactataatgcagaaagctccatggtatctaaagaagtcaactctcttaaatctgagattagaaatatttcagaaaaatgccatgaaaatgcacctgaacctgatagcatgacctgctgtgtatcagagtcaacccttctatattctattgaagaaaggagactagcctggataaaatcatttaaaccttggcttgaaattttcaagcaaaatcaacaaaagaaaattgttagaagaaagagacctgtgaaatgcccagccaacatgacacccgctttggataaactggaaattcttcgatgtggcccttgggatactttacagcaggttacaacagttacatttcaagatttgccaggctgtgttctctccacactggcagagtgtacaaatcttcagtttctatcccttcgacgctgtggattaacttctttgcacagcctgagtaattgtaaaaaacttaagtacattgatgcacaggaaaaccatattgaggctattgagtgtgaaaatttggaaaatctctgtgttgttcttcttaataaaaatcaactgacttctcttcatggtttggatggctgtactaatattcagtgtcttgaactttcatataataaaattactcgaattggatattccttctttctggaagaaaaacttgttgacaatacagggttctgccatcacttgggcacctccacttcttacttatccctggcacaagtctggattccaactggattatgttggtcctggatacctattacctcacttacaaaaaattcagattgtaatttccttatctcccacttatactggaattgtggtttagaatctttgaaaaatcttcaacaactaattttggaccacaatcagttaattaatacaaaaggtctttgtgatacacctaccattgtatacctagattgctcccataatcatcttactgatgtagagggcgttgaaaattgtggattgctccaaatattgaagttacagggaaattatctgagtgagcttccatccttggagaatcttgttttactaagagaattgcacttggatgataacagcatttcaactgtggaagcattttcttcatactggctgcctttactacaaaatattactatctctcaaaacagcttgactaaaatcgtaccactttttcattttgtttcattggaaaagctagatgtcagccacaattgtctttctgatcttaaaagtgccataaaatggtttgatgcatgctattctctccatgaattgtctcttactggaaacccacttcttcaagaaacaaactggagggattctctacttaaagtgttgcctgctctgagaatcctcaatggcaatatactaaactctaattcagaaagccgcactgaagaacacaatcaactgggatcagcaggtttcctggcactttgtcagtctcagattcgagaattcaacttgctaattgaaaattatataactggaaaaggagatgtatttaccttggatactgcagaaaatctctgtcattattttaagaaattgatgatacttagtactgaataccgacatgcacacgaacgaggggatgtaactatcaccaagaaagatgaatcagaagcccagaaaaatcatttggcccctacaaacagtgacagcactctgcaaaatggagtcttctactcttgtgcacgtgaaggtgagccagactcaccagatattcctgagaaatggatggactctgtctccagccactccccattaagcaaatccgccacatgtgaaaatatggaaggaagacatcaggaaatattagtatgtcagaagagagaagacagcaaggcaagcagtattcccaccataagaatcccatttaaggaagtagtaatgacaaattctttgctgaggaatcaccaaaatattgagcctagtgaaaaaatgtaagatatataaataatgtttcttttatagatgtatgtttactccttttgatggatgatattagtcaatggtacctagtaatttgctgaaggattcaaatcacaatcatatttcataccgattccattatgttttcgtgaggtgcattatgttttcatgaggtgcacaaatcattaattatagtgcatattaatttgattaaattctcatttaatttctagtagtatttaaatgagtaaatgtgagtttttttctgccttgtaatttctaaataattaatatgttttaaggagaaataaaatatcacagtctaaaaataataaaaacattttctgagt

SEQ ID NO: 32783 - DNA, 2563 bp, Homo sapiens
aaaaacatggaggagcgggagcggggggcgaggtcggctggcgccgggagccccgcgcgcccgcccagcccgcggctggatgtcagctctgacagcttcgacccgctgctggccctgtacgcgccccgcctgcctcccattccctaccccaatgccccctgcttcaacaacgtggcggagtacgagagcttcctcaggaccggagtccggggcggcgggcgcgggcgcgggcgagctcggggcgcggccgcgggctctggggttcccgccgcacccgggccctcgggcaggactcgtcgccgcccggacgcgcccgccccggaccccgagcgcatccagcgcctccgccgtctcatggtggccaaagaggaaggggacggggccgcaggagcgggccggaggggtccgggtcggagcaggaaggcgccacgcaacgtgctcacgcgaatgcccttgcacgaaggcagccctctgggtgaactccatcgctgtatccgtgagggggtgaaggtgaatgttcacatccgcactttcaagggacttcggggcgtctgtacaggcttccttgttgcattcgacaagttctggaatatggcacttactgatgtggacgagacctaccgaaaacctgtcctaggcaaagcatatgaacgggattcttcactgactctcactaggctatttgatcggctgaaacttcaagattcctccaagaaggaagcagattctaagtctgcagttgaagattccactctgtctagatactcacagacatccacttggaagttggcttcagtgtggggaagagcagacactggccggggctcacacaagcgttcccgctctgtcccttcttccctgcaggcctctgcaagggaggagtccaggtcagagctgtcagggaggactacacggacagacggctccagtgtgggaggtaccttttccagggctaccaccctttccagaggccagtcccgtaagaaaaagcgaaagcccaaagtggattaccagcaggtattcactcgacacataaatcagattttcattcgaggcgagaatgtcctgctggttcatcttgcacagtgaccagctcagcctgagctttggtttttagaaataaagtgcatgaattgctgctatgctgtatcctagtatcccagtgaaactctgagttggaatgattccctctggtcctgcatatgcagaggacggagcaggctcagccccctggaagatgagctcaaggggaggacaggccttgggagggcaggcgtttgcattaatatcaaggcaaaaagcattcatagatacatgcatctgatttggtattgtgatttacttcagaccctgaaaccaaatatctgatcttccattagacttaggggtcatgatatgagtggaatttacattttagatactataggggaaagaaaagtctcaaaaagaagtattgcatgtctaaaagctagtgccctgagtactcatgaattcgattccaagagtagtggtgtaaattgccttggagccctgcatccacgtcttgtaactaacttttgaattttgcctgacatgattctctcttgatgaagaaatgacatatattatctttgaatatctacaaggaaagttaccaacttatgtaggggtgaaatttggataggcggtatgctcaaagcagccagcaatgagtgctctgttttgatccttcttattattatggaaaggagtacaggacctcttcagtcttccccttaccagaggtagcctctgcaaatggcataccagatgggactctaagatgcttgtgtggtggcttcttgtccttctctttgacttctgtggcatggtgctagtgcatgtaccctgtggtattgcccctctgtccgtagtgtgaactgtcctgtgagctttatgtcaggagactgtgaccttcatgtccagcttcaaagagttgtgcatgaactcggtaatacacatcacacggctgagagtcccctttccaggcagggccagcatgtgtagaatatctttcagaatatggtttcaccatgaaacaggggtggtagatttattcccttgtgtcaggccaaagaagttcttacaaagtacagtgggtagtgtctaaagcgacactttactcacagcctggcttgagtcaacaggaacaccatagcacccacaaatacttctacttgaatcatattctgtgctttttcaatcactagtgcagaataggctgcatttgacacagactgttaggcaatattgatttttttgttttgtttttatttggttttatctgagataacttatgttcaaggtgagaataagaaatagccaactagttaaaatgtatgaaaagaaaactttcccctgctgtatttgttgtgtaacataaataagccttctgagaagcagggtgaataaagtttagggagctgggacacctggtcctgctagctggaccactggctcatcatgcaatgaaaaggtgagcagacttaacccctccgtgcctcagctttttccccacagacacctacctcacaggggcattgag

SEQ ID NO: 32784 - DNA, 1206 bp, Homo sapiens
ctttttcagttctgcttgctgtcggcaccgctgcgttacccggaaccgccgggccgaacagcatgacgtccgctttggagaactacatcaaccgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgagtgtgtcactggattttgactccttattgattcattgtaatatgtaaattaaaatatttctacattttattgaaaaaaaaaaccttttttttttgcctaaatataagtttggtagcttggtttcttttttttattaaatagtgtgaaaatataatgggcattctgaaaacttttagaaaaaagtagtactttttgatactttagtatttatggaaactagtggaaaagagaaattagtgtgctatataaatcaggcattcaagtaacagtaatacaggatatatgtgttttctttccctgatgtttaggaaaatcacaggagggtaaatctttgctggagttatctgaatcattggcatttatccgattccactggtggtagtttgctagtgcttctaaaagttgctccctagcactgagaggtgtgggtaggtaaaaatgtgtttgcttgagaaaagcaaaaatgctaacaaggttttgatagattggcccaaaattctaacttgaatattaagaatgactaggaatggtagaattgacagagatgattagtaaagtctcttgatgcccaattggttaggtatgaaagtaatatgaacacattaatgttgaattttacagacagtatatttgaaaaaaattgattccatgtagtcttcaatttttaatttttaagaattggagaatttctaatgttaaagttagtttataaatgtgagtaaataaactctaagtttgtatcgaaaaaaaaaaaaaaaaaaaaaaaaaaaaa

SEQ ID NO: 32785 - DNA, 5271 bp, Homo sapiens
gcgccgaacaatccccggcagggctcgcctcgccggtgacatcactcctgaagatactcctcgctcccagcgcctgccttccccaggcgtccgttcgtgtgcccgtctccgcctttccgcctcggaagagcgctcatcactggctggggacagagccgggcaccaaggagcgacaggatcccgaagagagagagagaaggcagcgagggaaggaggaccccggcaggcagcagcatgaaattcagcccagcgcactacctgctgcctctcctgcctgcgctggtcctcagcaccagacaggactatgaagagctagaaaagcagctgaaagaagtctttaaggagcgaagcaccattcttcgtcagctgacaaagacatcaagagaacttgatggaattaaagtcaatcttcagtccttaaaaaacgatgagcagtctgccaaaactgatgttcagaaacttctggaattaggacagaaacaaagagaagaaatgaagtctcttcaggaggccctgcaaaatcagcttaaggagacatcagagaaagcagaaaaacaccaggctactattaattttttaaagactgaagttgaaagaaagagcaaaatgatccgagacctccagaatgagaataaaagcttgaaaaacaaactcttgtcaggaaacaagctctgtggcattcacgcagaagagtcaaaaaaaatccaagcccagctgaaggagcttcgttatgggaagaaggatttattatttaaggcgcagcagcttactgatctggaacaaaaattagctgtagccaaaaatgaactggagaaagcagctcttgacagggagtcacagatgaaagcaatgaaagagactgtgcagctctgcttgacatctgttttccgtgatcagcctcctccccctttgagtttaatcacatcaaatccaactcggatgttactcccacccaggaatattgcctctaagcttccagatgcagcggccaaaagcaagcctcaacaaagtgcttctggaaacaatgagagctctcaagttgagtcaacaaaggaaggaaatccaagtaccactgcctgtgactctcaagatgagggcagaccgtgttccatgaagcacaaagaaagtcccccaagtaatgccactgcagaaaccgagcctatcccacagaaattgcaaatgcctccttgctctgaatgtgaggtgaaaaaagccccagaaaaaccattgaccagctttgaagggatggcagctagagaagaaaaaatactgtaaatactaagaaactgtgttaaaaacgtccatttgctattgtcttcatattctttttagaccacaagcttgatggaaatactgtttctaaagcatgcaactttttcacaattttatgtaactttataaagtagcctacacattttcaaagattccagaccaattatgatccttaagcaataacctcattgaattgaatacccacagtcagaaatattttgttgtcaacagtaaattgtcccatataaattggtctggtttaactcaaatgctatctaacatgtaattctcccggttcatttggatatctagtacttctatgatatagttgtcaaaatcaactggaggataataaaatattgtgggttctcagcattcttagaatccaaattacaaccatatcagtaagggtttggtccacatgagccaactgaagtcattttcctcaaggttggaatttgtgccaacctaaatacgttgtttctttgatggtgtttattgctattggtattattttgaactaataacaattattttgtctaaataatgctaagacaattctgttaagaattttgtcagctaacataattcattaagtatgtttggcatcatatggacaaaatatttggatgaatgactaaatttctgacacaattaaatattttggcattctatagacacatctcctatgtatgtctactgtaattaatccaagttaataaccaagttttctgaaatacttggcaggatttttggtatgaagttgggtagtggaatagggaatgaagagtgagttctaaaatacaaatatgaaagcaggtaatatatatcacaaaacaggggtctgatgaaagtacaatagccatgttgattcaataaacccagatgcatattttttgaaaaccaatgtgttattgaaacaaatcaatggcagtgttaatccataagagttctgattttctataggaatatcactaatcaaaaaaatgcactcatgaataattggaagatagctcacaagcaagaggaattgacccttgaataattatctgattaataggtttcatagggcattcaaagttgcagactcagttaatgactacagttaagttgtctggactgaaaagtcatttcttttgtttagaacctttttgcaaccgtagaaagcatattaaaccattggttttgcaggatggatctgtcaaaccacaatatatacatttggatcagtgtatcctaggagacagttaataaaaatgtattaaaggaaatctttaatcaataaatgaacttagattctgagatttaatggcatacctctgatcaaaatggcatatttaaagaaatttaaagatttggagaattggaaaatatcgttagctgtaaaagtaatattatgacatatttatgtagcacttctattttcagaatagttcagtgtcattcattagcacaggcaggtcccaaccacaatggttcaacttaacggttttttcatgattctgtgaaagcttcataatttctacatgctttgaattttgaattttgttattttttggagggctagtgatacatggtccatgaaatattcaacactttattataaaatagggtttgtgttagacaatttgcccaactgtaggatgaggtatatgttctgagcacgtttaagcaggtttaagttagggtgggctatgattttccatttaggtatctgaaatgcatttcagacttacaatgttttcaacctttgatttctttatctgtatgtaatcctattgttaaatcaaggagcattcatatttttcataaaaccggctacccaaggaaaaaaataattagctttatggatgatccatagagctttcagatgaagtgactaggataaaataaaagatgaaggtctgaggtttcttctgactccttcatatttctaaaaataatcatacaaactagaatactgctagtctcccaagtcctgttccttgtaattctcccactgttctcagtggccctaaccatctctataggttcctgacagggaagcagatcatttagttttaatttatgttcagtctcccacctccaccctggggcccaacttcccttgcaggccttgtgggtcctatagaaagttattcaccatgtaatctagcacagcatgttttgaagcatctttggaatgaaaaaaaagaagaatcaggctgttatttcctgaaattgttatgagagataacatgttgaaaggtaagaactcaggttgatattaatcatgtttttatcaatcttcattttaaagttgtttttgttctgtatattctaaattccttttattaattcctggcttgatcaagtgggctttggatccatatgatttttttttttttttttttttgagatgaaatctcgctcttgttgcccaggctggagtgcaatggagcgatcttggctcactgcaactctgcttcccaggttcaagtgattctccctgcctccgcctcccaagtagctgggattacaggtacctgccaccatgcccggctaatttttatatttttaatagagacggggtttcaccatgttggccaggctggtctcgaactcctgacctcaggcgatccacctgcctcagtctcctcccaaaatgctgggattacaggtgtgagccaccgtgcctggccagtgtgtttttttcctttaaatatatatggcattatacatccagcaaagtttactgtgttatactcattgcatcatttgtttaaaaaaaaaaaagaaacttgtagcaggagacatttaaaaatatatttaggagttccttttaataactaagttagagactctctttcagtaagttctatgactgtaccttaatgaatgcattttatttatctcaatttttatttgcttcaaaatagaatcggataagtttaaaatgttcctcttacatttgtgaatgtgtctatgagagaggggccatttctcacatattttaattaacaactaaataaacagacgttgttttaaaggaattaacacttaaatcccaaccatcctcatatagaataaaatatcaacctaaatctttactatagatagtataattctattatgtacctgtaatgataagcattgaaagattatttacattttgaaaaacatggaattgattcttattaagaaaaaagatattttccaatggagtaacttgttttaatagaggtacaaccagaaccaacaattgtatttctctatagttattttaaaatagtaatcaatgctatgtatttgatgtatatgtttctaaattagaaatttcttttggctttgtgtttttttaatgtgcgttaaatatgtaaactgaacctgttcctaaaatgcattaaacttgaatgctgtgtctatccaatgccaaaatgctcagaagaaaagtgaataattcagtcattcatctggatgtagttttctgtgtaatctcaaatatctgaatattgaaaaaactaggttgctaacttttttcattccttatgcaaatgtttagcatcatagtgctgtttcagatacagatctgtttcatcaaatatcctcaattacaagtctaagacagttatatgtaaagaaaatgtattattttagatgaacaatgtggataactgaactaaaacgatatttgtgaactttgctataatgaaatcttttatttttatagctcaggtattgtaattagcactaattgcagcagagactgaaataattattgacaccgtagagtaccatagagtaggttgaactggccagacctagacaatgaagaaaacacatactgtttacttaggagacattttcttagtcgtgtgtatagtcctaaatttccccaaactatgtgttcatttggattgtgttatataataacagtcgaatgatgaagaataaaagatgctgaaagatggcctatttttgttcaataaagattgttacaagaataaaaaaaaaaaaaaa

SEQ ID NO: 32786 - DNA, 1979 bp, Homo sapiens
aacggcctgacgtcggcggagggaagcaggcgcaggctccgtgaggaggcaaggtaagacgccgagggaggactgaggcgggcctcaccccagacagagggcccccaataatccagcgctgcctctgctgccgggcctggaccaccctgcaggggaagacttctcaggctcagtcgccaccacctcaccccgccaccccccgccgctttaaccgcagggaactctggcatctcagggagttgatgaccttgttttcagaaggtgactcaggtcaacacaggggcccccatctggtcgacagatgcagtggttctaggatctgccaagcatccaggtggagagcctgaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttc

SEQ ID NO: 32787 - DNA, 1965 bp, Homo sapiens
aacggcctgacgtcggcggagggaagcaggcgcaggctccgtgaggaggcaagggaactctggcgtaagagctttgtgtgaccagggcagggctggttagaagtgctcagggcccagactcagccaggaatcaagaatccgggctttgcccctgcaatcaacccacggaagctccgggaatggcggccaagcacgcggatcctgacgttcacatatctcagggagttgatgaccttgttttcagaaggtgactcaggtcaacacaggggcccccatctggtcgacagatgcagtggttctaggatctgccaagcatccaggtggagagcctgaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttc

SEQ ID NO: 32788 - DNA, 1981 bp, Homo sapiens
aacggcctgacgtcggcggagggaagcaggcgcaggctccgtgaggaggcaagaatccgggctttgcccctgcaatcaacccacggaagctccgggaatggcggccaagcacgcggatcctgacgttcacatatctcagggagttgatgaccttgttttcagaaggtgactcaggtcaacacaggggcccccatctggtcgacagatgcagtggttctaggatctgccaagcatccaggtggagagcctgaggaatcaggagctccaggaaccaggcagtgaggccttggtctgagtcagtgtcctcaggtcacagagcagaggggacgcagacagtgccaacactgaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttc

SEQ ID NO: 32789 - DNA, 1629 bp, Homo sapiens
ggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaaaaaaaaaaaaaa

SEQ ID NO: 32790 - DNA, 4303 bp, Homo sapiens
cgccgcggcggcagctgagttgggctgaggtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggaggaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcaggtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccaggccaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaaacctgggaaggaggtggcagccactggcaccagcattctgaaggaagccaactggctcgtggcagggccaggagcagagacgggggaccctcgcatgaagcccaagcaagtgagccgagacctgggccttgcagcggacctgcccggtggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcatcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcggccgtgcgtggaggtgcgcatggctgctcatggtcccaacacaggctactgtgagagccagcatccaaccccacgcttgcagtgactcagaatgataattattatgactgtttatcgatgcttcccacagtgtggtagaaagtcttgaataaacacttttgccttcacccagaaaaaaaaaaa

SEQ ID NO: 32791 - DNA, 3078 bp, Homo sapiens
cgccgcggcggcagctgagttgggctgaggtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggagggtaaggcctccgccctacagccgcctgcctcaggcccagggagcggcagccccctcccccagccctggggtgatgcccaggtcatcctcgggagccctgccaggccccccttctctttccagccgcctgctgagcagacccctcggagagctttctgctcccttcccatcagcagcttgctttctgggaaccttttatctgccttactcccctttaaacacctgcggcatcgtcacatggcttgtgattaccgttttatctcccttgctcccctttaaaacacctgcggcattgtcacttggcttgtgattaccatttcgtctttaaagcaggtttgttaacagttttaacactcggagtatttaaagccagccaggtgtgggcgtgcctgcacccagatgtggaggtttattttaaggctgtgccccaaggggacccagtttgggggtggctgtgcccgccctggtcctagcatagccctggcccagagcactgctcccacaccctcgggcctcggagctcggctgtgttcatctacagggatctgtcacctgtccctccaggaaagctccttacgcctttgctctcctgagaataaaacttgctctgaatcctcctccaaaaaaaaaaaaaaaaaa

SEQ ID NO: 32792 - DNA, 5278 bp, Homo sapiens
aggaagccagcctcagcccggccgctgtcgccgccctgtcctggtgcccgtccgcgtcgtcgccctcttcactggccctcatcacttctcaccgcgccctccagcttcacccgtacaggtagccccgccgccgcgcacctgccttcgctcccgcaccggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaavagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaaatgatggaacaagacccaaaatgacaccggaacaaatggccaaagaaatgtcagaatttttgagtagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgattttgcaccatttttgaacaattcacctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacactagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacattttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagta

SEQ ID NO: 32793 - DNA, 1360 bp, Homo sapiens
agtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctatgaatgttttctgaagtttgttagtcatttgtaaaactaaatcagattgtaatcccagtactttgggaggccaaggcaggctgattgcttgaggtcaggagtttgagaccagcctggccaaaatctatactaaaaaaaatacaaaaattagctgggcatcccagctatgcagaagctgaagcacaagaattgcttgaaccctggaggtggaggttgcagtgagctgagatcgtcccactgcactccagcccgggcaacagagtaagaccctgcctcaagaa

SEQ ID NO: 32794 - DNA, 1214 bp, Homo sapiens
agtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctatgaatgttttctgaagtttgttagtcatttgtaaaactaaatcagattgtaatcccagtactttgggaggccaaggcaggctgattgcttgaggtcaggagtttgagaccagcctggccaaaatctatactaaaaaaaatacaaaaattagctgggcatcccagctatgcagaagctgaagcacaagaattgcttgaaccctggaggtggaggttgcagtgagctgagatcgtcccactgcactccagcccgggcaacagagtaagaccctgcctcaagaa

SEQ ID NO: 32795 - DNA, 1849 bp, Homo sapiens
acagccacactgcagtatgtcaggaacagtcatggagctgttctcattgtttgcctctccttttcctcctttttaccttctggcccctctcttcattcagagatgctggcagagccattccctaaggttgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagatggaccttttggcttttctccaataattggacgtttctgtggacaacaaaatccacctgtcataaaatccagtggaagatttctatggattaaattttttgctgatggagagctggaatctatgggattttcagctcgatacaatttcacacctgaataaaaggcaaactccttagcaggatctacagagtgtttcgtgatctctccttctccatcatctcatctctggatgctgtggtgcccagaacgttgatctaacaccatcttgaagcacacatgctgatctccaggtgcaccacgatttgtgcccttgaaaatgctgtttgctcaatctttctggagaaagtttgccacatattcggacttagtaaattagaactcctaccttgaaacccagatgaaggttcaattttccccaggattcctttcctcaccattctcctatgtgagggacttcttgtattataatcttttaatataatattatattttatgtaatattgtgttaaattatattgttttatgtaatatattattttaaatgttattttatatatgatattaaaagattataattatataatctttttcgataatttattcttgtattacaatctttttattataatagtctccactctccccaaaatattgtgaattcttcagctgaggagttttgctttagtttcttatcgccatggactgggaattaacatgtatttaacacattttgctcaaacaatcaaacagtaaaagctgaagagagcgtattattattcgcccattccgagagaaagttgaagatgactgaagaactaaaaatacataaatgaattaagtaattataaacataaatttcctgtagctccaacatgactttgatctgagtaatagtgttgtgaaatagattactacatgattttcattgcttttatattatatatagtaattaatattcagaatagttgattaactttcttaagtgtcacataatttaaaaatgaaattgctgtttgccccagatatgtttttctgtgttctttttaaatttcagtgaaattttcttatactcccttcattaaatctattatctggtttctaaacctttacctatttaatgtctcttttcctttctttctaaaaagtaactggttaaactacagttttgtcatttatgaaattttttctgttattattgtagggatagtcaatattatcattttaaggatagttaaaacttattttgcaattaatacgtattttacagtacactaatatgcatatatgttgtattttattaaaatattaaaatgttttttaaacaaaaatattgtccgaagctctaaataccagagtattgattttaaagtctgccaagacaataatacaagtaacacaactaagcctttctttaaataataaaacgagtatctaaa

SEQ ID NO: 32796 - DNA, 1856 bp, Homo sapiens
attgcgggcggcggcgttcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagggggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccaat

SEQ ID NO: 32797 - DNA, 3279 bp, Homo sapiens
gcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaagcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatcctcacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgagtttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagtgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaaaaa

SEQ ID NO: 32798 - DNA, 3405 bp, Homo sapiens
gcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaagcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgagtttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagtgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaaaaa

SEQ ID NO: 32799 - DNA, 3510 bp, Homo sapiens
gcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatcctcacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgagtttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagtgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaaaaa

SEQ ID NO: 32800 - DNA, 3429 bp, Homo sapiens
gcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaagcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatcctcacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgagtttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagtgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaaaaa

SEQ ID NO: 32801 - DNA, 3570 bp, Homo sapiens
gcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaagcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatcctcacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgagtttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagtgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaaaaa

SEQ ID NO: 32802 - DNA, 1854 bp, Homo sapiens
gcccgctgcggtcacgctgcgcccggcgccgcagggtgggcggcgaggcactcacgagggggacgctgagggcttccgcgcgggccacccgggtcaagcgcgctccgccgggaaacttctgcgggcgccgggctgaagctccgggcagggctgggaaggaaaggaaataccaaaatatttgcagactggatccaaatcaggagcccagatgaacttaaagaagcgagcatgggattcttagtttttcaagatccgtacacacgaagcctttaatcagcatcaactccagtgtccgttttctctggttttgtgaagactgcacaaaactctcatgatggagaaccaaaggacttagttacctgtttcagtgtcatctaaagtcaactgaaaagtgaagcaggcagtaatacagccatggaaagaaattcaagtttatggaagaacctaatagatgaacacccagtctgcacaacctggaagcaagaggccgaaggagccatttatcatcttgccagtattttatttgtagtaggtttcatgggtggcagtggattcttcgggctcctttatgtcttcagtttgctggggttgggttttctctgttctgctgtctgggcttgggtagatgtctgtgcagctgacatattttcctggaattttgtactgtttgtcatctgcttcatgcaatttgttcatattgcatatcaagttcgcagcataacctttgcccgagaattccaagtgttgtacagctcccttttccagcccctggggatctctttgcctgtcttcagaacgattgctttgagctctgaagtggttactttggaaaaggaacactgttatgccatgcaggggaaaacttccattgataaactctccttgcttgtttcaggaaggatcagagtgacagttgatggcgaatttctgcattacattttcccccttcagttcctggattctcctgagtgggattcactgagacccacagaggaaggcatttttcaggtaaccctcactgcagaaactgattgtcgatatgtgtcttggaggagaaagaaattatatctgctctttgctcagcatcgctacatctcccgccttttttcagtgctaattggcagtgacattgcagataaactctatgccttgaatgacagggtatatataggaaaaagatatcactatgatattcggctacccaacttctatcaaatgtcaactccagaaatacgcagatcacccctgacacaacattttcagaattccagacgatactgtgataaatgacatcaaagtctgaaatttataagtataaaaaaagactctctcttcatcattccccagtgaaatagcaaaatacaaaaaaagagctccctaatgtttttataaatcaaattcagaagcgagatgccattgccaactgttttattcctttcaacaactgcattgtgaataaactttacaaatttttcttgtatttctcattgttataattggggagggggtggataactatgggcagtttgcccttttctgcatcaaaactgggagaatgaaattccactttctcaattcttttctcacatttactcaaatgcattgtcttgccctatggactcaggagttgcttctcaagaaacagccagcaagtattctcagcctgagggtgggttgctactgtccacataggcatttccggaattcacttttttgctacaacctccagtgaaagcaattattttaaatgtgcagttacttgatgtgactaaaaagtagaataaatgcaagagataataatatgtgaatcttgaagcctattttattgctacaaataaaataacatttaaaaag

SEQ ID NO: 32803 - DNA, 4540 bp, Homo sapiens
attctggggttcgtttagaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggataaaaccaccatcatgggttcgggtcccatagaccccaaagaacttctcaagggcctggacagcttccttaaccgagatggggaagtcaaaagtgtggatgggatttccaagatcttcagtttgatgaaggaagcacgaaagatggtgagtcgatgcacttacttgaacattctcctgcagacccgttcaccagaaatattggtcaaatttattgacgttggcggctacaaacttcttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctgagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggactagagctggagacaccatccttggtgcctgtgaagaagaatgccagcacagtggtggtttctgacaagtacaaccttaaacccatccccctcaaacgtcagagcaacgtagctgctccaggagatgccactccccctgcagagaagaaatacaagccactcaacacaacacctaatgccaccaaagagatcaaagtgaagatcatcccgccacagcctatggagggcctgggctttctggatgctcttaattcagcccctgttccaggcatcaaaattaagaagaaaaaaaaagtactgtcacctacggctgccaagccaagcccctttgaagggaaaacgagcacagaaccaagcacagccaaaccttcttccccagaaccagcaccaccttctgaggcaatggacgcagaccgtccaggcaccccggttccccctgttgaagtcccggagctcatggatacagcctctttggagccaggagctctggatgccaagccagtggagagtcctggagatcctaaccaactgacccggaaaggcaggaagaggaaaagtgtgacatggcctgaggaaggcaaactgagagaatatttctattttgaattggatgaaactgaacgagtaaatgtgaataagatcaaggactttggtgaggcggctaagcgagagatactgtcagaccgacatgcatttgagacagcgcggcgtctgagccatgataacatggaggagaaggtgccctgggtgtgcccccggcccctggttctgccctcacctcttgtcacccctggaagcaatagtcaggagcgatatatccaggctgagcgggagaagggaatccttcaggagctcttcctgaacaaggagagtcctcatgagcctgatcctgagccctacgagcccataccccctaaactcatccccctagatgaggagtgttccatggatgagactccgtatgttgagactctggaacctggggggtcaggtggctcacctgatggggcaggaggctccaagttgcctccagttctggccaatcttatgggaagcatgggtgctggaaagggcccccaaggccctggaggaggaggcattaatgtccaagagatcctcacctccatcatgggtagcccaaacagtcatccttcagaggaactactgaaacaaccagactattcggacaagatcaagcagatgctggtgccacatggactcctaggccctggcccaatagccaatggtttcccaccagggggtcctgggggccccaagggcatgcagcactttccccctggacctgggggacctatgccaggtccccatggaggccctggtgggccagtgggtccacgtcttctgggtcctccaccccctccccggggaggtgatcccttctgggatggcccgggcgaccctatgcggggtggcccaatgcgggggggtccaggaccaggtcctggaccataccatagaggccgaggtggccgaggaggaaacgaacctcctcctcctcctcctccattccgaggcgccagaggaggtcgctctggaggaggacccccaaatggacgagggggccctggtgggggcatggttggaggtggtgggcatcgtcctcacgaaggccctggtgggggcatgggcaacagcagtggacatcgtccccacgaaggccctggcggtggcatgggaagtgggcatcgcccccatgaaggccctggtggtagcatgggtgggggtggaggacatcgtccccacgaaggccctggcggtggcatcagtggtggcagtggccatcgtccccatgaaggccctggcggaggaatgggtgccggtggtggacatcgcccccacgaaggccctggcggaagcatgggtggaagtggtggacatcgtccccatgaaggccctggacacggggggccccatggccaccggcctcatgatgtccctggtcaccgaggccatgaccatcgagggccgccacctcatgagcaccgtggccatgatggtcctggccacgggggagggggccaccgagggcacgatggaggccacagccatggaggagacatgtcaaaccgccctgtctgccgacatttcatgatgaagggcaactgccgctatgagaacaactgtgccttctaccacccgggtgtcaatgggccccccctgccctagggaccatttgcctgccctgttcacacaacccctgtggactgcagcctcgctctttccaccctgttatggcttctgtgaggcccattttcccttttccccagctgatgaggagccggccccctcagttcccacttgcttgggttcctgggggttttctgatcactggtgcgcattgatgtacatattttcctccagtctggggaggagagagactggaaacgttcctggactgctgaagaggagacccagttggcttcactttttgagaagattcgccctgtaccccaaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaagcagcttaaaaaaaaaaaaaaaaaaaaaa

SEQ ID NO: 32804 - DNA, 403 bp, Homo sapiens
gtccttcctctcctagcctaaggcgtgcaaacagagcgccactgggaggctgaaacctttaggccgatgcttgcttgcaaggtcaggcaagctggattctggtccccacctttgcagagagaacagcgatgttgtgcgcccatttctcagatcaaggaccggcccatcttactacctccaagagtgcttttctctctaataagaaaacatctactttgaaacatctactgggcgagaccaggagtgatggctcagcctgtaattctggaatttcgggaggccgaggcaggaagattccttgagcacaggagttccagaccagcctgggcaatgtagcaagacgctgtctctatttatacaataaaatttttttaaaaaaggaaaaaaaaaaaaaaaaaaaaaa

SEQ ID NO: 32805 - DNA, 2770 bp, Homo sapiens
ctccttggcggtgcctggagcccgggcgcaccccaccgctcccgggacctgttgggggctggcccgaaccgtcgtcgaagggagccgctcggccacccccgacgttcctcgccccgcccgacgttccctcaagtggccgaaccagccggacgagccaaactcgccgggcctcccggcggcagcaggtggccccgtccttccagggagggccctgcgccccgcggcgctccggagccctctcggccgcccccgccaggcgggatggaggcggatggggacggagaggagctggcccggctgcgctcagtcttcgccgcctgcgacgcgaaccgctcggggcgcctggagcgcgaggagttccgggcactgtgcacggagctgcgggtgcggccggccgacgccgaggcagtattccagcggctggacgccgaccgtgacggcgccatcaccttccaggagttcgcgcgtggcttcctcgggtccctccgcggggggcggcgccgggactggggtcctctggatcccgcgcccgccgtgtctgaggcggggccggagacacacgacagcgaggaggacgaaggcgacgaggacgcggcggcggcgctggccacctcgtgcggcccggcgagtcccggccgggcttggcaggatttccaggcgcgacttggggacgaagccaagttcattcccagagaagagcaagttagtaccttgtaccaaaacatcaaccttgtggagccaagattaattcagccatatgaacatgttataaagaacttcatccgtgagatcagacttcaaagcacagaaatggaaaatttggccattgcggtgaagagagcccaggacaaggcagctatgcagttgagtgagttggaagaggaaatggatcagaggattcaggctgcagaacataagacacggaaagacgaaaaacgcaaagctgaggaagccctcagtgacctcagacgtcagtatgaaactgaagtaggagatctgcaggtgaccattaaaaagctaagaaagctcgaagaacaatcaaaacgcgtaagtcaaaaggaagatgtggctgcattgaaaaaacaaatttatgatttatcaatggaaaaccagaaagttaagaaagaccttttagaagcacagacaaacatagcctttcttcagagtgagttagatgctttgaaaagtgattatgctgatcagagtctgaatactgaaagggatctggaaataatccgagcatacacagaagatcgaaatagtcttgagaggcaaattgaaatactccaaacagctaaccggaagctacatgacagtaatgatggccttagaagtgcccttgaaaacagttatagcaagttcaacagatctttgcatataaataatatctcaccagggaatacaatttctagaagcagtcccaaattcattggtcattcccctcaacctctaggctatgacaggtcatcccgctcttcctatgtggatgaggactgtgactccctggccctctgtgatcctctgcagaggacaaattgtgaagttgacagcctgcctgaaagctgcttcgacagcggcttgtctaccttgagagatcccaatgagtatgactcagaagtggaatacaagcaccagaggggatttcagaggtcacacggggtgcaggagagctttggaggtgatgcttcagacacagatgttcctgacataagggatgaagagacatttggtttagaagatgtggcttccgtcttagactggaagccccaagggtctgttagtgaaggcagcattgttagttcatcaagaaagcccatctcagcactctcgccccagacagacctggtagatgacaacgctaaatcttttagctcacagaaggcttacaagattgtacttgctggggacgctgcagtggggaagtctagtttcctcatgagactttgcaagaatgaatttcgagaaaatataagcgccaccctgggagttgatttccaaatgaaaaccctcattgtggatggagaacgaacagttctgcagctctgggatacagctggtcaggagagattcagaagtattgccaagtcttacttcagaaaggcagatggtgttttgctgctgtatgatgttacatgtgagaaaagctttcttaacatacgagaatgggtagatatgattgaggatgcagcccatgagactgttcccattatgctggtaggaaacaaggctgacattcgtgacactgctgctacagagggacaaaaatgtgtcccagggcactttggagagaaactggccatgacgtatggggcattattctgtgaaacaagtgccaaagatggttctaacatagtggaggctgttctgcaccttgctcgagaagtgaaaaagagaactgacaaggatgacagcagatccattaccaatctaaccgggaccaattccaaaaagtcaccacagatgaagaattgttgcaatggctaaatcccaaacatccttggcctgtgaagtcttcatttccagaatactgaatttgtgtgacttatttggctcttaacagagtggcacatcctactgacactgtcctatggagagttacagtgcaggaaacctgaacccagctctcaggtccctctggaactttggctcttctttgttttgtctcagtgagtgatttgggccctctggctaaatagactagtcatgtccttacaggtcttaaaagataacatgtaaatgtttttaaaatggtaaaaaaaaaaaaaaaaaa

SEQ ID NO: 32806 - DNA, 1662 bp, Homo sapiens
gcggccgcgaccgccggggacgagcttggaggaaaaggaaccgggagccgcccacccgggggcgctctccggacccccagggtcctagcgcgcggcccttaccgagcctgggcgcccggatttcggsagcggatcgcctttccgggttggcggcccgcctgattgggaacagccggccggttgccgggggaacgcgggagtcgggcccgacctgagccacgcgggcttggtgcccacctgtgcgcgccgcctgcgaagaaggaacggtctagggagaaggcgccgccggccgcccccgtccccaccgcggccgtcgctggagagttcgagccgcctagcgcccctggagctccccaaccatgaagctcaacttctccctgcgactgcggatcttcaacctcaactgctggggcattccgtacttgagcaagcaccgggccgaccgcatgaggcgcctgggagactttctgaaccaggagagcttcgacctggctttgctggaggaggtgtggagtgagcaggacttccagtacctgagacagaagctgtcacctacctacccagctgcacaccacttccggagcggaatcattggcagtggcctctgtgtcttctccaaacatccaatccaggagcttacccagcacatctacactctcaatggctacccctacatgatccatcatggtgactggttcagtgggaaggctgtggggctgctggtgctccatctaagtggcatggtgctcaacgcctatgtgacccatctccatgccgaatacaatcgacagaaggacatctacctagcacatcgtgtggcccaagcttgggaattggcccagttcatccaccacacatccaagaaggcagacgtggttctgttgtgtggagacctcaacatgcacccagaagacctgggctgctgcctgctgaaggagtggacagggcttcatgatgcctatcttgaaactcgggacttcaagggctctgaggaaggcaacacaatggtacccaagaactgctacgtcagccagcaggagctgaagccatttccctttggtgtccgcattgactacgtgctttacaaggcagtttctgggttttacatctcctgtaagagttttgaaaccactacaggctttgaccctcacagtggcacccccctctctgatcatgaagccctgatggctactctgtttgtgaggcacagccccccacagcagaaccccagctctacccacggaccagcagagaggtcgccgttgatgtgtgtgctaaaggaggcctggacggagctgggtctgggcatggctcaggctcgctggtgggccaccttcgctagctatgtgattggcctggggctgcttctcctggcactgctgtgtgtcctggcggctggaggaggggccggggaagctgccatactgctctggacccccagtgtagggctggtgctgtgggcaggtgcattctacctcttccacgtacaggaggtcaatggcttatatagggcccaggctgagctccagcatgtgctaggaagggcaagggaggcccaggatctgggcccagagcctcagccagccctactcctggggcagcaggagggggacagaactaaagaacaataaagcttggccctttaaaaaaaaaaaaaaaaaa

SEQ ID NO: 32807 - DNA, 3307 bp, Homo sapiens
cctgcgtcccgagtgcgcggcggccggaccgggcgggcggagccgggcccgcggggctgctgcggggcgatcgggccgggccgctgccgcgccatggactcccgtgtccagcctgagttccagcctcactgagtggccacccccaaagtgctgccagccgaggaagcccccagcactgaccatgtctattatggaccacagccccaccacgggcgtggtcacagtcatcgtcatcctcattgccatcgcggccctgggggccttgatcctgggctgctggtgctacctgcggctgcagcgcatcagccagtcagaggacgaggagagcatcgtgggggatggggagaccaaggaacccttcctgctggtgcagtattcggccaagggaccgtgcgtggagagaaaggccaagctgatgactcccaacggcccggaagtccacggctgagccaggatgcaaggctcctggtcctgtttgcagccggccaagaggcgctgggaggggcaaaaccatacggatgcgctgctgtctgagaggaagggctgacacttgctggcatggcctctgcgggcttcgtcatcgcatgcactgatgcccggggacctggctgtcctgggcttcccctcggcctccaggtgaggctgcccattgcaggcactgggcaggcctgaccttgctggggctcatggccctgtagcgcttttgttacttgaatgtctagctgagcctgtttttgatggagctactactgtaatgcgtgaactaacaaacctgtgaactgtaaataggcccctggaagcacgtgcttaagcccttttgctgatttttaaaaatatcatctagcgcacacgggactggtattctggctgtactaatgacaagctgagtcaagaccctggagggtcataggcttgtaaaggcccacgccacactcggcaggggtctctcatgtgtgtccatctgcgtgtatgtcaaggaagtgagatgccaatttggggtcttgaggctgaccagttggggtgcttgggtgatctctgcttcattagtcatgggtggaagaaaaaccacaccccccgcacccctccgttctttctgcatagactcacttgttaaatagcagttctgttgagagtggagttactgcagggaagctaccggacctgcctgggagccagtgaagggcgagtcagggcacgcgtcctggaggctgccagcgtccttgtagcagagcagtttcttgccgcttgggtcttcagcacgccaagccccccaccaaccctccaccccgagtgaaggcttcgctgaaattgctttggtcctcatagagcctgtggtggctacttttggtctgaaacccacttggcccaggaaagagaaaaggttgtatgttttgtgttggtgtttcctattttctgcactggaggggaggggactgttgaggttctgtcttttttcttcttttcctcttccctcttcacatcacttggcttcctttcctctctgatgaccgtccgcctatggggttctgacttcactttcctcagcgggtctccagtcccctgacccagctctaaaggcacttaggacccagggaacatttctcacgtgcacattcccctaagagccaccagactgcttcctgccagcctgtgcttgcggcagggagccggggcagggcagaggtgaacttgaagttcaggacttgactctcccacaggtggtgagctggtggctctctggtgagctagtgtctccacagcctgtctccaaggcctcccctatgtacatttcagtgagctcactttgatttttaatcccaccacaagcacatactaattttatttatgattcaaatgtgactcgtgcctgcccatccctgtaatagatggaaggtcagccccggcttaaccacagagcactggcccttcatggctgagctcagagctctggcctcctgctcagactaaaggcacctcctctggcctcacccaagcctcttctaaaaaccatgttgaatgaatccacgttctggaaccccgaggcgggagaagtagggagctgttcgtttaagcagcatacacctaaattgggggtttaaacattaagtaggagcttggggtggaagagggacagccggctgggccacctgagcagaaggtggtaatgaaacacctcagctgggctcttgggagaccttaggaagcaggagaggcaacacctctggctactgatggtgtggcaagttcagaagaggtggtggtggggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatgcttctagaatgagtgaaccacatcatagctctcactgttttttcaatagctactttttttagcagacaccagagccacactcaaatggctaagtaggttatgacctctctggattatttttgaatgcccaactgttgcattcaagttttctgactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctgattttctagaccactgagaaaatctttatttacaataaatttcaataaaatttgcataaatatattcccaaaaaaaaaaaaaaaaaaaaagaaaaaaaaaaaaa

SEQ ID NO: 32808 - DNA, 800 bp, Homo sapiens
gccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttacgagctaccgatgggaagaagaagatcagcactgtggtgagctccaaggaagtgaataagtttcagatggcttattcaaacctccttagagctaacatggatgggctgaagaagagagacaaaaagaacaaaactaagaagaccaaagcagcagcagcagcagcagcagcagcacctgccgcagcagcaacagcagcaacaacagcagcagcaacagcagcaacagcagcacagtaaagggcatacatttcctgctttcaccaattgaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggcctgtgctgcatggttatatactcctggattatagattaaaagtctctgtagacatctctgtgaagagcaagctatcattaaacatgtctgtttatcaaaaaaaaaaaaaaaaaaaaaaaaa

SEQ ID NO: 32809 - DNA, 4409 bp, Homo sapiens
tggcggaaaggctgcggccccgcgccagagggccggtggctcctccgggcttctgaggacccgcagggagcgggcctcatcatttctgtctcctgtttctccacttccttctctattggttggtccactgatgtatggacttgcacatgatgaactgtgaacttctagccacatgtagtgcccttgggtacttggagggagacacttaccataaggaaccagattgcttagagagcgtgaaggatctgatccgctatttgaggcatgaggatgagacacgagatgtgcggcagcagctgggggcagcccagatcctacagagcgaccttctgcccatcctcacccagcaccaccaggacaagcctctctttgatgctgttatcagactgatggtgaacttgacacaaccagccttgctctgttttggcaatctgcctaaggagcccagctttcggcaccattttttgcaggtgctaacttatttgcaggcctacaaagaggcctttgccagtgagaaggcttttggagtcctcagtgaaaccttgtatgagctgctgcagctgggctgggaggaacggcaggaggaagacaacttgctgattgaacggatcctactgctggtcagaaatattctccatgtcccagctgaccttgatcaggagaagaagattgatgatgacgccagtgcccatgaccagctcctctgggcgattcacctcagcggcctggatgacctgctcctctttctggccagctcgtctgctgaggagcaatggagcctacatgtgctagagattgtctcccttatgtttcgtgaccagaaccccgagcagctggcgggagtagggcagggacgcttagctcaggagcggagtgcagattttgcagaactggaggtattgcgccagcgagagatggcagaaaagaagactcgagccctccagcgaggcaacaggcattctcgatttgggggctcctatattgtccaggggttgaaatccattggggagagggacctcatctttcacaaaggccttcacaacctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggatcacctgcttcgggagaaagctcagcagcatgatgagacctattatatgtgggccttggctttcttcatggccttcaaccgagctgcctccttccggccaggcctggtttctgagaccctcagtgtccgtaccttccacttcattgagcagaacctcaccaactactatgagatgatgctgactgaccgcaaggaagctgcctcctgggcacgccggatgcacttggctctgaaggcctatcaggagctgctggcaacagtgaatgagatggacttatctccagatgaggctgtgagggagagcagccgcatcatcaagaacaatattttctatgtgatggagtaccgagaactattcctggcactttttcgaaagtttgatgagagatgccagccccgctctttccttcgtgacctggtggagaccacccacctcttcctcaaaatgttggagcgattctgtcggagccgtgggaacctggtggtgcagaacaaacaaaagaagagaaggaagaagaagaagaaggtcctagaccaggccattgtttctggtaatgtcccatctagcccagaagaagtggaggctgtgtggccagccctggctgagcagctacagtgctgtgcccagaattctgagctcagcatggactccgtggttccctttgatgcggcctcagaggtgccagtggaggagcagcgggcagaagctatggtacggatccaagactgtctcctggctggccaggccccacaggccctgactctcctgaggtctgctcgggaggtgtggcctgaaggagatgtgtttggctctcaagacatttctccagaggaagagatccagttgctgaaacaaatcctctctgctccacttccccggcagcagggcccagaggaacgtggggcagaggaagaagaagaggaggaggaggaggaagaggaggagttgcaagtggtccaggtgtcggagaaagaatttaattttctggactacctgaaacgctttgcatgttcaactgtcgttcgagcctatgtgctgctactaaggagctaccagcagaatagtgcccacactaaccattgcattgtgaagatgctgcaccggctggcccatgacctcaaaatggaagccctactttttcagctgtcagtcttctgcctcttcaatcgtctgcttagtgaccctgctgctggagcctacaaagagctagtgacttttgccaaatacatcctgggcaaattttttgcactggctgcagtcaaccaaaaagcctttgtggagctgttgttctggaagaacacagctgtggttcgagagatgactgagggctatggctccctggatgacaggtcttccagtcgcagagcacctacatggagccccgaagaagaggctcatcttcaggagctgtacctcgccaataaggacgtggaagggcaggatgtggtggaagccatcttggcccacctgaatactgttcctcgaacacgcaagcagatcatccaccatctggtacagatgggactggctgacagtgtcaaggacttccaaaggaaaggaacccatattgtactgtggacgggggatcaggagttggagctgcagcggctttttgaggaattccgggactcagatgatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttgccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggcttttctatcccgctcctatggctccagaactgcctgatccgagcagctgatgatcgggaagaggatggctgctcccaggccgttccattggtgccactcacagaggaaaatgaggaagccatggaaaacgaacagtttcagcagctgttgcgcaagctaggggttcggccccctgcctctgggcaggaaaccttctggcgaattccagccaagctgagtcctacccagctccggagggcagcagcttctttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagaggaggaagacgctgttggtaaagagccgctgaaggcagcacccaagaaacgacaattgctggacagcgacgaggaacaggaagaagatgagggcaggaacagagcaccagagttgggagctccaggaatccaaaagaagaaacgataccagattgaggatgatgaggatgactgaagagctaagaagcctaggggtagagatagacacgtttttagatggtgcattcaagtcagagttggaagggtcatacaggacccagaagctcctcttactggacagagcagtagaatcccaggctctttcacggatttaggctgagaaacttcagcagcagtattggacttctctgctgtcagtctttgtttctcccagtttttatcggtatgccccagcagctctctggagatttagttctcttcttctaggaaccatttcttttggttattggagctccttagcaaataagaggagtgagtgaaatagagaaagcaccccggaccccttttattggtctgttcctttggctttctcttggaggtgggtcgcagcaccagatggggagctttatgacatgacaggcgggagttttgtaccacttttagaagataccagatgcctctgtcctcattttgtttcctatgatcatcctctagataccagatagaggcccattcctgcatttgagatagggttggaatatagtactctagatgatgaatgtgtttgctttgtgtttggtattaaacatgtaagattagaagttctcaaaaaaaaaaaaaaaaaaaaaaaaaaaaaaaaaaaaaaaaaaaaaaaaaaaaaaaa

SEQ ID NO: 32810 - DNA, 3502 bp, Homo sapiens
acatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgcggtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcactgcgccccctgtgcctacctctagcattgtaacgaccacatagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccgaaacaaa

SEQ ID NO: 32811 - DNA, 3125 bp, Homo sapiens
gcccagttggagccagacagcggggtggacaagtggcgtgtgtgctgcgaccccgagggaagatgaacgggacgcggaactggtgtaccctggtggacgtgcacccagaggaccaggcggcgggcagcgtggacattctcaggctgactctccagggtgaactgacaggagatgaacttgaacacatagcccagaaggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagagtggagcagaaagaggcagaagtcggagagctgcagaggcgcttgctagggatggagacggagcatcaggccttactggcgaaagtgagggaaggggaggtggccctagaggaacttcggagcaacaatgctgactgccaagcagaacgagaaaaggctgctaccctggaaaaggaagtggccgggttgcgggagaagatccaccacttggatgacatgctcaagagccagcagcggaaagtccggcaaatgatagagcagctccagaattcaaaagctgtgatccagtcaaaggacgccaccatccaggagctcaaggagaaaatcgcctatctggaggcagagaatttagagatgcatgaccggatggaacacctgatagaaaaacaaatcagtcatggcaacttcagcacccaggcccgggccaagacagagaacccgggcagtattaggatatccaagccgcctagcccgaagcccatgcctgtcatccgagtggtggaaacctgagctgcctggagatggttgctgccattgctgctgcctctgcctcggagaagcccactgcccctgttggctgttaacactgcctttgacttcctgactgtcccctggctgcacccaggacttcgggctcctgtgtctcaccattcccaagcccctggccactctaagctgggcagacggagcacgagcacctattcaaggcactgcagccctttggaagacattgtcctgcaagcaggagccagggcaatatctatattcctacagtgactatttttctctgtagagagcctcccttctgttgtagactggactctggctgcgccataagccaggccttcatcagattgggagaggtgacaagatttgcctcagccctaaaagctggagacacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttctgagacagagtctcactctgtcacccaggctggagtgcagtagcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgtgcccggcccatggtgtttttctttagggctcttcctacagccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttgaaaaaaaaaaaaaaaaa

SEQ ID NO: 32812 - DNA, 1122 bp, Homo sapiens
gtccttagccggtagcttccgggtttcctgggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactcccaaaaaaaaaaaaaaaaaaaaaa

SEQ ID NO: 32813 - protein, 382 aa, Homo sapiens
MALQGISVVELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGVLSKIGRSGENPYAPLNLLADFAGGGLMCALGIIMALFDRTRTGKGQVIDANMVEGTAYLSSFLWKTQKLSLWEAPRGQNMLDGGAPFYTTYRTADGEFMAVGAIEPQFYELLIKGLGLKSDELPNQMSMDDWPEMKKKFADVFAEKTKAEWCQIFDGTDACVTPVLTFEEVVHHDHNKERGSFITSEEQDVSPRPAPLLLNTPAIPSFKRDPFIGEHTEEILEEFGFSREEIYQLNSDKIIESNKVKASL

SEQ ID NO: 32814 - protein, 198 aa, Homo sapiens
MALQGISVVELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGGRNSIFKFFSVENSEIESVGSTSRTEHVGWWSTFLYDLQDSRWGIHGCWSNRTPVLRAADQRTWTKV

SEQ ID NO: 32815 - protein, 920 aa, Homo sapiens
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 32816 - protein, 388 aa, Homo sapiens
MILWLHSLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 32817 - protein, 385 aa, Homo sapiens
MAAALFVLLGFALLGTHGASGAAGFVQAPLSQQRWVGGSVELHCEAVGSPVPEIQWWFEGQGPNDTCSQLWDGARLDRVHIHATYHQHAASTISIDTLVEEDTGTYECRASNDPDRNHLTRAPRVKWVRAQAVVLVLEPGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 32818 - protein, 269 aa, Homo sapiens
MAAALFVLLGFALLGTHGASGAAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 32819 - protein, 176 aa, Homo sapiens
MGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 32820 - protein, 205 aa, Homo sapiens
MKQSDASPQERVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 32821 - protein, 449 aa, Homo sapiens
MPATLLRAVARSHHILSKAHQCRRIGHLMLKPLKEFENTTCSTLTIRQSLDLFLPDKTASGLNKSQILEMNQKKSDTSMLSPLNAARCQDEKAHLPTMKSFGTHRRVTHKPNLLGSKWFIKILKRHFSSVSMETFVPKQDFPQVKRPLKASRTRQPSRTNLPVLSVNEDPMHCTAFATADEYHLGNLSQDLASHGYVEVTSLPRDAANILVMGVENSAKEGDPGTIFFFREGAAVFWNVKDKTMKHVMKVLEKHEIQPYEIALVHWENEELNYIKIEGQSKLHRGEIKLNSELDLDDAILEKFAFSNALCLSVKLAIWEASLDKFIESIQSIPEALKAGKKVKLSHEEVMQKIGELFALRHRINLSSDFLITPDFYWDRENLEGLYDKTCQFLSIGRRVKVMNEKLQHCMELTDLMRNHLNEKRALRLEWMIVILITIEVMFELGRVFF

SEQ ID NO: 32822 - protein, 486 aa, Homo sapiens
MAAVKTLNPKAEVARAQAALAVNISAARGLQDVLRTNLGPKGTMKMLVSGAGDIKLTKDGNVLLHEMGLHPRIITEGFEAAKEKALQFLEEVKVSREMDRETLIDVARTSLRTKVHAELADVLTEAVVDSILAIKKQDEPIDLFMIEIMEMKHKSETDTSLIRGLVLDHGARHPDMKKRVEDAYILTCNVSLEYEKTEVNSGFFYKSAEEREKLVKAERKFIEDRVKKIIELKRKVCGDSDKGFVVINQKGIDPFSLDALSKEGIVALRRAKRRNMERLTLACGGVALNSFDDLSPDCLGHAGLVYEYTLGEEKFTFIEKCNNPRSVTLLIKGPNKHTLTQIKDAVRDGLRAVKNAIDDGCVVPGAGAVEVAMAEALIKHKPSVKGRAQLGVQAFADALLIIPKVLAQNSGFDLQETLVKIQAEHSESGQLVGVDLNTGEPMVAAEVGVWDNYCVKKQLLHSCTVIATNILLVDEIMRAGMSSLKG

SEQ ID NO: 32823 - protein, 531 aa, Homo sapiens
MAAVKTLNPKAEVARAQAALAVNISAARGLQDVLRTNLGPKGTMKMLVSGAGDIKLTKDGNVLLHEMQIQHPTASLIAKVATAQDDITGDGTTSNVLIIGELLKQADLYISEGLHPRIITEGFEAAKEKALQFLEEVKVSREMDRETLIDVARTSLRTKVHAELADVLTEAVVDSILAIKKQDEPIDLFMIEIMEMKHKSETDTSLIRGLVLDHGARHPDMKKRVEDAYILTCNVSLEYEKTEVNSGFFYKSAEEREKLVKAERKFIEDRVKKIIELKRKVCGDSDKGFVVINQKGIDPFSLDALSKEGIVALRRAKRRNMERLTLACGGVALNSFDDLSPDCLGHAGLVYEYTLGEEKFTFIEKCNNPRSVTLLIKGPNKHTLTQIKDAVRDGLRAVKNAIDDGCVVPGAGAVEVAMAEALIKHKPSVKGRAQLGVQAFADALLIIPKVLAQNSGFDLQETLVKIQAEHSESGQLVGVDLNTGEPMVAAEVGVWDNYCVKKQLLHSCTVIATNILLVDEIMRAGMSSLKG

SEQ ID NO: 32824 - protein, 527 aa, Homo sapiens
MESQGVPPGPYRATKLWNEVTTSFRAGMPLRKHRQHFKKYGNCFTAGEAVDWLYDLLRNNSNFGPEVTRQQTIQLLRKFLKNHVIEDIKGRWGSENVDDNNQLFRFPATSPLKTLPRRYPELRKNNIENFSKDKDSIFKLRNLSRRTPKRHGLHLSQENGEKIKHEIINEDQENAIDNRELSQEDVEEVWRYVILIYLQTILGVPSLEEVINPKQVIPQYIMYNMANTSKRGVVILQNKSDDLPHWVLSAMKCLANWPRSNDMNNPTYVGFERDVFRTIADYFLDLPEPLLTFEYYELFVNILGLLQPHLERVAIDALQLCCLLLPPPNRRKLQLLMRMISRMSQNVDMPKLHDAMGTRSLMIHTFSRCVLCCAEEVDLDELLAGRLVSFLMDHHQEILQVPSYLQTAVEKHLDYLKKGHIENPGDGLFAPLPTYSYCKQISAQEFDEQKVSTSQAAIAELLENIIKNRSLPLKEKRKKLKQFQKEYPLIYQKRFPTTESEAALFGDKPTIKQPMLILRKPKFRSLR

SEQ ID NO: 32825 - protein, 801 aa, Homo sapiens
MKEKAMIKTAKMQGNVMELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPIYQHSYTGYYVLSKIPHGDPQSLDPPEVSNAKLQYAGWGPKGQQLIFIFENNIYYCAHVGKQAIRVVSTGKEGVIYNGLSDWLYEEEILKTHIAHWWSPDGTRLAYAAINDSRVPIMELPTYTGSIYPTVKPYHYPKAGSENPSISLHVIGLNGPTHDLEMMPPDDPRMREYYITMVKWATSTKVAVTWLNRAQNVSILTLCDATTGVCTKKHEDESEAWLHRQNEEPVFSKDGRKFFFIRAIPQGGRGKFYHITVSSSQPNSSNDNIQSITSGDWDVTKILAYDEKGNKIYFLSTEDLPRRRQLYSANTVGNFNRQCLSCDLVENCTYFSASFSHSMDFFLLKCEGPGVPMVTVHNTTDKKKMFDLETNEHVKKAINDRQMPKVEYRDIEIDDYNLPMQILKPATFTDTTHYPLLLVVDGTPGSQSVAEKFEVSWETVMVSSHGAVVVKCDGRGSGFQGTKLLHEVRRRLGLLEEKDQMEAVRTMLKEQYIDRTRVAVFGKDYGGYLSTYILPAKGENQGQTFTCGSALSPITDFKLYASAFSERYLGLHGLDNRAYEMTKVAHRVSALEEQQFLIIHPTADEKIHFQHTAELITQLIRGKANYSLQIYPDESHYFTSSSLKQHLYRSIINFFVECFRIQDKLLTVTAKEDEEED

SEQ ID NO: 32826 - protein, 803 aa, Homo sapiens
MTTAKEPSASGKSVQQQEQELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPIYQHSYTGYYVLSKIPHGDPQSLDPPEVSNAKLQYAGWGPKGQQLIFIFENNIYYCAHVGKQAIRVVSTGKEGVIYNGLSDWLYEEEILKTHIAHWWSPDGTRLAYAAINDSRVPIMELPTYTGSIYPTVKPYHYPKAGSENPSISLHVIGLNGPTHDLEMMPPDDPRMREYYITMVKWATSTKVAVTWLNRAQNVSILTLCDATTGVCTKKHEDESEAWLHRQNEEPVFSKDGRKFFFIRAIPQGGRGKFYHITVSSSQPNSSNDNIQSITSGDWDVTKILAYDEKGNKIYFLSTEDLPRRRQLYSANTVGNFNRQCLSCDLVENCTYFSASFSHSMDFFLLKCEGPGVPMVTVHNTTDKKKMFDLETNEHVKKAINDRQMPKVEYRDIEIDDYNLPMQILKPATFTDTTHYPLLLVVDGTPGSQSVAEKFEVSWETVMVSSHGAVVVKCDGRGSGFQGTKLLHEVRRRLGLLEEKDQMEAVRTMLKEQYIDRTRVAVFGKDYGGYLSTYILPAKGENQGQTFTCGSALSPITDFKLYASAFSERYLGLHGLDNRAYEMTKVAHRVSALEEQQFLIIHPTADEKIHFQHTAELITQLIRGKANYSLQIYPDESHYFTSSSLKQHLYRSIINFFVECFRIQDKLLTVTAKEDEEED

SEQ ID NO: 32827 - protein, 865 aa, Homo sapiens
MASLYQRFTGKINTSRSFPAPPEASHLLGGQGPEEDGGAGAKPLGPRAQAAAPRERGGGGGGAGGRPRFQYQARSDGDEEDELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPIYQHSYTGYYVLSKIPHGDPQSLDPPEVSNAKLQYAGWGPKGQQLIFIFENNIYYCAHVGKQAIRVVSTGKEGVIYNGLSDWLYEEEILKTHIAHWWSPDGTRLAYAAINDSRVPIMELPTYTGSIYPTVKPYHYPKAGSENPSISLHVIGLNGPTHDLEMMPPDDPRMREYYITMVKWATSTKVAVTWLNRAQNVSILTLCDATTGVCTKKHEDESEAWLHRQNEEPVFSKDGRKFFFIRAIPQGGRGKFYHITVSSSQPNSSNDNIQSITSGDWDVTKILAYDEKGNKIYFLSTEDLPRRRQLYSANTVGNFNRQCLSCDLVENCTYFSASFSHSMDFFLLKCEGPGVPMVTVHNTTDKKKMFDLETNEHVKKAINDRQMPKVEYRDIEIDDYNLPMQILKPATFTDTTHYPLLLVVDGTPGSQSVAEKFEVSWETVMVSSHGAVVVKCDGRGSGFQGTKLLHEVRRRLGLLEEKDQMEAVRTMLKEQYIDRTRVAVFGKDYGGYLSTYILPAKGENQGQTFTCGSALSPITDFKLYASAFSERYLGLHGLDNRAYEMTKVAHRVSALEEQQFLIIHPTADEKIHFQHTAELITQLIRGKANYSLQIYPDESHYFTSSSLKQHLYRSIINFFVECFRIQDKLLTVTAKEDEEED

SEQ ID NO: 32828 - protein, 1193 aa, Homo sapiens
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRRHLCCGRFRLADNSDWSKTATNIIKKSSDNLGKSLSSSSIGSNSTYLTSKSKSSSTTYFKRNSHTDNVSYEHSFNKSGSLRQCFHGQVLVKTGPC

SEQ ID NO: 32829 - protein, 1222 aa, Homo sapiens
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRRHLCCGRFRLADNSDWSKTATNIIKKSSDNLGKSLSSSSIGSNSTYLTSKSKSSSTTYFKRNSHTDSASMDKSLSKLAHADGDQTSIIPVHQVIDKVKGYCNAHSDNFYKNIIMSDTFSHSTKF

SEQ ID NO: 32830 - protein, 1221 aa, Homo sapiens
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQATVNSPSTTPPTVTTNMPVTNRIDKQRNDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRRHLCCGRFRLADNSDWSKTATNIIKKSSDNLGKSLSSSSIGSNSTYLTSKSKSSSTTYFKRNSHTDNVSYEHSFNKSGSLRQCFHGQVLVKTGPC

SEQ ID NO: 32831 - protein, 1250 aa, Homo sapiens
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQATVNSPSTTPPTVTTNMPVTNRIDKQRNDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRRHLCCGRFRLADNSDWSKTATNIIKKSSDNLGKSLSSSSIGSNSTYLTSKSKSSSTTYFKRNSHTDSASMDKSLSKLAHADGDQTSIIPVHQVIDKVKGYCNAHSDNFYKNIIMSDTFSHSTKF

SEQ ID NO: 32832 - protein, 445 aa, Homo sapiens
MAELKYISGFGNECSSEDPRCPGSLPEGQNNPQVCPYNLYAEQLSGSAFTCPRSTNKRSWLYRILPSVSHKPFESIDEGHVTHNWDEVDPDPNQLRWKPFEIPKASQKKVDFVSGLHTLCGAGDIKSNNGLAIHIFLCNTSMENRCFYNSDGDFLIVPQKGNLLIYTEFGKMLVQPNEICVIQRGMRFSIDVFEETRGYILEVYGVHFELPDLGPIGANGLANPRDFLIPIAWYEDRQVPGGYTVINKYQGKLFAAKQDVSPFNVVAWHGNYTPYKYNLKNFMVINSVAFDHADPSIFTVLTAKSVRPGVAIADFVIFPPRWGVADKTFRPPYYHRNCMSEFMGLIRGHYEAKQGGFLPGGGSLHSTMTPHGPDADCFEKASKVKLAPERIADGTMAFMFESSLSLAVTKWGLKASRCLDENYHKCWEPLKSHFTPNSRNPAEPN

SEQ ID NO: 32833 - protein, 160 aa, Homo sapiens
MEIPVPVQPSWLRRASAPLPGLSAPGRLFDQRFGEGLLEAELAALCPTTLAPYYLRAPSVALPVAQVPTDPGHFSVLLDVKHFSPEEIAVKVVGEHVEVHARHEERPDEHGFVAREFHRRYRLPPGVDPAAVTSALSPEGVLSIQAAPASAQAPPPAAAK

SEQ ID NO: 32834 - protein, 65 aa, Homo sapiens
MVRTKADSVPGTYRKVVAARAPRKVLGSSTSATNSTSVSSRKEHVLCNLITQMMKKNRTFSFIFE

SEQ ID NO: 32835 - protein, 111 aa, Homo sapiens
MVRTKADSVPGTYRKVVAARAPRKVLGSSTSATNSTSVSSRKAENKYAGGNPVCVRPTPKWQKGIGEFFRLSPKDSEKENQIPEEAGSSGLGKAKRKACPLQPDHTNDEKE

SEQ ID NO: 32836 - protein, 1504 aa, Homo sapiens
MVSESDFSKDVAVQVLPLDKIEENNKQKANDIFISQYTMGQKDALRTVLKQNVSLCLTGWSDHSGVITTHCSLYLLRLMRSSHLSLPSSWDYRAQSMPVFKEVKVHLLEDAGIEKDAVTQETRISPSGIDSATTVAAATAAAIATAAPLIKVQSDLEAKVNSVTELLSKLQETDKHLQRVTEQQTSIQRKQEKLHCHDHEKQMNVFMEQHIRHLEKLQQQQIDIQTHFISAALKTSSFQPVSMPSSRAVEKYSVKPEHPNLGSCNPSLYNTFASKQAPLKEVEDTSFDKQKSPLETPAPRRFAPVPVSRDDELSKRENLLEEKENMEVSCHRGNVRLLEQILNNNDSLTRKSESSNTTSLTRSKIGWTPEKTNRFPSCEELETTKVTMQKSDDVLHDLGQKEKETNSMVQPKESLSMLKLPDLPQNSVKLQTTNTTRSVLKDAEKILRGVQNNKKVLEENLEAIIRAKDGAAMYSLINALSTNREMSEKIRIRKTVDEWIKTISAEIQDELSRTDYEQKRFDQKNQRTKKGQNMTKDIRTNTQDKTVNKSVIPRKHSQKQIEEHFRNLPMRGMPASSLQKERKEGLLKATTVIQDEDYMLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQSNSDTMPPAGVIVSKPHPVTVTTSIPPSSRKVETGVKKPNIAIVEMKSEKKDPPQLTVQVLPSVDIDSISNSSADVLSPLSSPKEASPPPVQTWIKTPEIMKVDEEEVKFPGTNFDEIIDVIQEEEKCDEIPDSEPILEFNRSVKADSTKYNGPPFPPVASTFQPTADILDKVIERKETLENSLIQWVEQEIMSRIISGLFPVQQQIAPSISVSVSETSEPLTSDIVEGTSSGALQLFVDAGVPVNSNVIKHFVNEALAETIAVMLGDREAKKQGPVATGVSGDASTNETYLPARVCTPLPTPQPTPPCSPSSPAKECVLVKTPDSSPCDSDHDMAFPVKEICAEKGDDMPAIMLVNTPTVTPTTTPPPAAAVFTPTLSDISIDKLKVSSPELPKPWGDGDLPLEEENPNSPQEELHPRAIVMSVAKDEEPESMDFPAQPPPPEPVPFMPFPAGTKAPSPSQMPGSDSSTLESTLSVTVTETETLDKPISEGEILFSCGQKLAPKILEDIGLYLTNLNDSLSSTLHDAVEMEDDPPSEGQVIRMSHKKFHADAILSFAKQNQESAVSQQAVYHSEDLENSVGELSEGQRPQLTAAAENILMGHSLYMQPPVTNTQSLDQQCDPKPLSRQFDTVSGSIYEDSCASHGPMSLGELELEPNSKLVLPTTLLTAQENDVNLPVAAEDFSQYQLKQNQDVKQVEHKPSQSYLRVRNKSDIAPSQQQVSPGDMDRTQIELNPYLTCVFSGGKAVPLSASQMPPAKMSVMLPSVNLEDCSQSLSLSTMQEDMESSGADTF

SEQ ID NO: 32837 - protein, 438 aa, Homo sapiens [sequence omitted]

SEQ ID NO: 32838 - protein, 1336 aa, Homo sapiens
MDDDDAKLKAEIEAELDKLSISSLEKEDIESDAKSETQSDDSDTDSVELPESVLHCINIIKNRSKAVEELILQDLEDTDILSCSYGAVSNNHMHLRTGLSTEYEESSEQLIKILSEIEKEEFMRSKTDCATPDFVPEPSPHDLPMDEHVLPDDADINFGYCEVEEKCRQSFEAWQEKQKELEDKEKQTLKAQRDREEKQFQEEEEKRHCWMKQFKVEKKKLENIQKQEQDKMNDELYKEEKIWKEKFKQHEEYIRNLHLQMEEERTRFKDQQEKEKNSLLKQQNNAAVKIQAKYKAFVAYQKYGPIIKEQIESKKRKAQEWKEKEAKIRQKEEENRKRLEEEQRIKEERKKQKEEERKRREKEYEEKKNIVKQEREQLISKEKIILREDASQQLIISSALKKSGYNNKHLSLEDISNDKGDIAKNLVDENSKKQEDVLLWLVEESNMKENVDRQTILKESIQVKLKESISSQTILADFKMEEKNENLAKKRCSEELVKQERKYENTDNKTELGNSDLKGNLKEQFPLQELKSDAQKEEKIMKHVINENTGQKTQIILGHNQEISEVKTNEEQKIIKDNQQKKIQKVEKEEIQEQNGLLYKDKDTLVISVKQRSLSLTSENSKDVRENVILQEKEIYSKSKEIEENPKDNAWNSGIVIFNTTDTMINIEGKRNDQDYVLGRHAPCEGLSNYNAESSMVSKEVNSLKSEIRNISEKCHENAPEPDSMTCCVSESTLLYSIEERRLAWIKSFKPWLEIFKQNQQKKIVRRKRPVKCPANMTPALDKLEILRCGPWDTLQQVTTVTFQDLPGCVLSTLAECTNLQFLSLRRCGLTSLHSLSNCKKLKYIDAQENHIEAIECENLENLCVVLLNKNQLTSLHGLDGCTNIQCLELSYNKITRIGYSFFLEEKLVDNTGFCHHLGTSTSYLSLAQVWIPTGLCWSWIPITSLTKNSDCNFLISHLYWNCGLESLKNLQQLILDHNQLINTKGLCDTPTIVYLDCSHNHLTDVEGVENCGLLQILKLQGNYLSELPSLENLVLLRELHLDDNSISTVEAFSSYWLPLLQNITISQNSLTKIVPLFHFVSLEKLDVSHNCLSDLKSAIKWFDACYSLHELSLTGNPLLQETNWRDSLLKVLPALRILNGNILNSNSESRTEEHNQLGSAGFLALCQSQIREFNLLIENYITGKGDVFTLDTAENLCHYFKKLMILSTEYRHAHERGDVTITKKDESEAQKNHLAPTNSDSTLQNGVFYSCAREGEPDSPDIPEKWMDSVSSHSPLSKSATCENMEGRHQEILVCQKREDSKASSIPTIRIPFKEVVMTNSLLRNHQNIEPSEKM

SEQ ID NO: 32839 - protein, 360 aa, Homo sapiens
MEERERGARSAGAGSPARPPSPRLDVSSDSFDPLLALYAPRLPPIPYPNAPCFNNVAEYESFLRTGVRGGGRGRGRARGAAAGSGVPAAPGPSGRTRRRPDAPAPDPERIQRLRRLMVAKEEGDGAAGAGRRGPGRSRKAPRNVLTRMPLHEGSPLGELHRCIREGVKVNVHIRTFKGLRGVCTGFLVAFDKFWNMALTDVDETYRKPVLGKAYERDSSLTLTRLFDRLKLQDSSKKEADSKSAVEDSTLSRYSQTSTWKLASVWGRADTGRGSHKRSRSVPSSLQASAREESRSELSGRTTRTDGSSVGGTFSRATTLSRGQSRKKKRKPKVDYQQVFTRHINQIFIRGENVLLVHLAQ

SEQ ID NO: 32840 - protein, 96 aa, Homo sapiens
MTSALENYINRTVAVITSDGRMIVGTLKGFDQTINLILDESHERVFSSSQGVEQVVLGLYIVRGDNVAVIGEIDEETDSALDLGNIRAEPLNSVAH

SEQ ID NO: 32841 - protein, 346 aa, Homo sapiens
MKFSPAHYLLPLLPALVLSTRQDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNENKSLKNKLLSGNKLCGIHAEESKKIQAQLKELRYGKKDLLFKAQQLTDLEQKLAVAKNELEKAALDRESQMKAMKETVQLCLTSVFRDQPPPPLSLITSNPTRMLLPPRNIASKLPDAAAKSKPQQSASGNNESSQVESTKEGNPSTTACDSQDEGRPCSMKHKESPPSNATAETEPIPQKLQMPPCSECEVKKAPEKPLTSFEGMAAREEKIL

SEQ ID NO: 32842 - protein, 314 aa, Homo sapiens
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFLLLKYRAREPVTKAEMLESVLRNCQDFFPVIFSKASEYLQLVFGIEVVEVVPISHLYILVTCLGLSYDGLLGDNQVMPKTGLLIIVLAIIAIEGDCAPEEKIWEELSMLEVFEGREDSVFAHPRKLLMQDLVQENYLEYRQVPGSDPACYEFLWGPRALIETSYVKVLHHTLKIGGEPHISYPPLHERALREGEE

SEQ ID NO: 32843 - protein, 314 aa, Homo sapiens; identical to SEQ ID NO: 32842

SEQ ID NO: 32844 - protein, 314 aa, Homo sapiens; identical to SEQ ID NO: 32842

SEQ ID NO: 32845 - protein, 314 aa, Homo sapiens; identical to SEQ ID NO: 32842

SEQ ID NO: 32846 - protein, 1119 aa, Homo sapiens
MTAAAASNWGLITNIVNSIVGVSVLTMPFCFKQCGIVLGALLLVFCSWMTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFVIVLSSLKHGLFSGQWLRRVSYVRWEGVFRCIPIFGMSFACQSQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEEAGRAEMLDHAVLLQVIKEQQVQQKRLLDQQEKLLAVIEEQHKEIHQQRQEDEEDKPRQVEVHQEPGAAVPRGQEAPEGKARETVENLPPLPLDPVLRAPGGRPAPSQDLNQRSLEHSEGPVGRDPAGPPDGGPDTEPRAAQAKLRDGQKDAAPRAAGTVKELPKGPEQVPVPDPAREAGGPEERLAEEFPGQSQDVTGGSQDRKKPGKEVAATGTSILKEANWLVAGPGAETGDPRMKPKQVSRDLGLAADLPGGAEGAAAQPQAVLRQPELRVISDGEQGGQQGHRLDHGGHLEMRKARGGDHVPVSHEQPRGGEDAAVQEPRQRPEPELGLKRAVPGGQRPDNAKPNRDLKLQAGSDLRRRRRDLGPHAEGQLAPRDGVIIGLNPLPDVQVNDLRGALDAQLRQAAGGALQVVHSRQLRQAPGPPEES

SEQ ID NO: 32847 - protein, 780 aa, Homo sapiens
MTAAAASNWGLITNIVNSIVGVSVLTMPFCFKQCGIVLGALLLVFCSWMTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFVIVLSSLKHGLFSGQWLRRVSYVRWEGVFRCIPIFGMSFACQSQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEGKASALQPPASGPGSGSPLPQPWGDAQVILGSPARPPFSFQPPAEQTPRRAFCSLPISSLLSGNLLSALLPFKHLRHRHMACDYRFISLAPL

SEQ ID NO: 32848 - protein, 1285 aa, Homo sapiens
  VARIANT 973: Xaa = Any Amino Acid
MEDGKPVWAPHPTDGFQMGNIVDIGPDSLTIEPLNQKGKTFLALINQVFPAEEDSKKDVEDNCSLMYLNEATLLHNIKVRYSKDRIYTYVANILIAVNPYFDIPKIYSSEAIKSYQGKSLGTRPPHVFAIADKAFRDMKVLKMSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIREKLHLSSPDNFRYLNRGCTRYFANKETDKQILQNRKSPEYLKAGSMKDPLLDDHGDFIRMCTAMKKIGLDDEEKLDLFRVVAGVLHLGNIDFEEAGSTSGGCNLKNKSAQSLEYCAELLGLDQDDLRVSLTTRVMLTTAGGTKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKXREDDEKRIQAEVEAQLARQKEEESQQQAVLEQERRDRELALRIAQSEAELISDEAQADLALRRNDGTRPKMTPEQMAKEMSEFLSRGPAVLATKAAAGTKKYDLSKWKYAELRDTINTSCDIELLAACREEFHRRLKVYHAWKSKNKKRNTETEQRAPKSVTDYDFAPFLNNSPQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 32849 - protein, 178 aa, Homo sapiens
MTTLRAFTCDDLFRFNNINLDPLTETYGIPFYLQYLAHWPEYFIVAEAPGGELMGYIMGKAEGSVAREEWHGHVTALSVAPEFRRLGLAAKLMELLEEISERKGGFFVDLFVRVSNQVAVNMYKQLGYSVYRTVIEYYSASNGEPDEDAYDMRKALSRDTEKKSIIPLPHPVRPEDIE

SEQ ID NO: 32850 - protein, 111 aa, Homo sapiens
MTTLRAFTCDDLFRFNNINLDPLTETYGIPFYLQYLAHWPEYFIVAEAPGGELMGYIMGKAEGSVAREEWHGHVTALSVAPEFRRLGLAAKLMELLEEISERYEESTFQGY

SEQ ID NO: 32851 - protein, 156 aa, Homo sapiens
MLAEPFPKVVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTPE

SEQ ID NO: 32852 - protein, 389 aa, Homo sapiens
MIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 32853 - protein, 788 aa, Homo sapiens
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 32854 - protein, 830 aa, Homo sapiens
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 32855 - protein, 865 aa, Homo sapiens
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 32856 - protein, 838 aa, Homo sapiens
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 32857 - protein, 885 aa, Homo sapiens
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 32858 - protein, 291 aa, Homo sapiens
MERNSSLWKNLIDEHPVCTTWKQEAEGAIYHLASILFVVGFMGGSGFFGLLYVFSLLGLGFLCSAVWAWVDVCAADIFSWNFVLFVICFMQFVHIAYQVRSITFAREFQVLYSSLFQPLGISLPVFRTIALSSEVVTLEKEHCYAMQGKTSIDKLSLLVSGRIRVTVDGEFLHYIFPLQFLDSPEWDSLRPTEEGIFQVTLTAETDCRYVSWRRKKLYLLFAQHRYISRLFSVLIGSDIADKLYALNDRVYIGKRYHYDIRLPNFYQMSTPEIRRSPLTQHFQNSRRYCDK

SEQ ID NO: 32859 - protein, 940 aa, Homo sapiens
MGSGPIDPKELLKGLDSFLNRDGEVKSVDGISKIFSLMKEARKMVSRCTYLNILLQTRSPEILVKFIDVGGYKLLNNWLTYSKTTNNIPLLQQILLTLQHLPLTVDHLKQNNTAKLVKQLSKSSEDEELRKLASVLVSDWMAVIRSQSSTQPAEKDKKKRKDEGKSRTTLPERPLTEVKAETRAEEAPEKKREKPKSLRTTAPSHAKFRSTGLELETPSLVPVKKNASTVVVSDKYNLKPIPLKRQSNVAAPGDATPPAEKKYKPLNTTPNATKEIKVKIIPPQPMEGLGFLDALNSAPVPGIKIKKKKKVLSPTAAKPSPFEGKTSTEPSTAKPSSPEPAPPSEAMDADRPGTPVPPVEVPELMDTASLEPGALDAKPVESPGDPNQLTRKGRKRKSVTWPEEGKLREYFYFELDETERVNVNKIKDFGEAAKREILSDRHAFETARRLSHDNMEEKVPWVCPRPLVLPSPLVTPGSNSQERYIQAEREKGILQELFLNKESPHEPDPEPYEPIPPKLIPLDEECSMDETPYVETLEPGGSGGSPDGAGGSKLPPVLANLMGSMGAGKGPQGPGGGGINVQEILTSIMGSPNSHPSEELLKQPDYSDKIKQMLVPHGLLGPGPIANGFPPGGPGGPKGMQHFPPGPGGPMPGPHGGPGGPVGPRLLGPPPPPRGGDPFWDGPGDPMRGGPMRGGPGPGPGPYHRGRGGRGGNEPPPPPPPFRGARGGRSGGGPPNGRGGPGGGMVGGGGHRPHEGPGGGMGNSSGHRPHEGPGGGMGSGHRPHEGPGGSMGGGGGHRPHEGPGGGISGGSGHRPHEGPGGGMGAGGGHRPHEGPGGSMGGSGGHRPHEGPGHGGPHGHRPHDVPGHRGHDHRGPPPHEHRGHDGPGHGGGGHRGHDGGHSHGGDMSNRPVCRHFMMKGNCRYENNCAFYHPGVNGPPLP

SEQ ID NO: 32860 - protein, 57 aa, Homo sapiens
MLCAHFSDQGPAHLTTSKSAFLSNKKTSTLKHLLGETRSDGSACNSGISGGRGRKIP

SEQ ID NO: 32861 - protein, 740 aa, Homo sapiens
MEADGDGEELARLRSVFAACDANRSGRLEREEFRALCTELRVRPADAEAVFQRLDADRDGAITFQEFARGFLGSLRGGRRRDWGPLDPAPAVSEAGPETHDSEEDEGDEDAAAALATSCGPASPGRAWQDFQARLGDEAKFIPREEQVSTLYQNINLVEPRLIQPYEHVIKNFIREIRLQSTEMENLAIAVKRAQDKAAMQLSELEEEMDQRIQAAEHKTRKDEKRKAEEALSDLRRQYETEVGDLQVTIKKLRKLEEQSKRVSQKEDVAALKKQIYDLSMENQKVKKDLLEAQTNIAFLQSELDALKSDYADQSLNTERDLEIIRAYTEDRNSLERQIEILQTANRKLHDSNDGLRSALENSYSKFNRSLHINNISPGNTISRSSPKFIGHSPQPLGYDRSSRSSYVDEDCDSLALCDPLQRTNCEVDSLPESCFDSGLSTLRDPNEYDSEVEYKHQRGFQRSHGVQESFGGDASDTDVPDIRDEETFGLEDVASVLDWKPQGSVSEGSIVSSSRKPISALSPQTDLVDDNAKSFSSQKAYKIVLAGDAAVGKSSFLMRLCKNEFRENISATLGVDFQMKTLIVDGERTVLQLWDTAGQERFRSIAKSYFRKADGVLLLYDVTCEKSFLNIREWVDMIEDAAHETVPIMLVGNKADIRDTAATEGQKCVPGHFGEKLAMTYGALFCETSAKDGSNIVEAVLHLAREVKKRTDKDDSRSITNLTGTNSKKSPQMKNCCNG

SEQ ID NO: 32862 - protein, 423 aa, Homo sapiens
MKLNFSLRLRIFNLNCWGIPYLSKHRADRMRRLGDFLNQESFDLALLEEVWSEQDFQYLRQKLSPTYPAAHHFRSGIIGSGLCVFSKHPIQELTQHIYTLNGYPYMIHHGDWFSGKAVGLLVLHLSGMVLNAYVTHLHAEYNRQKDIYLAHRVAQAWELAQFIHHTSKKADVVLLCGDLNMHPEDLGCCLLKEWTGLHDAYLETRDFKGSEEGNTMVPKNCYVSQQELKPFPFGVRIDYVLYKAVSGFYISCKSFETTTGFDPHSGTPLSDHEALMATLFVRHSPPQQNPSSTHGPAERSPLMCVLKEAWTELGLGMAQARWWATFASYVIGLGLLLLALLCVLAAGGGAGEAAILLWTPSVGLVLWAGAFYLFHVQEVNGLYRAQAELQHVLGRAREAQDLGPEPQPALLLGQQEGDRTKEQ

SEQ ID NO: 32863 - protein, 88 aa, Homo sapiens
MSIMDHSPTTGVVTVIVILIAIAALGALILGCWCYLRLQRISQSEDEESIVGDGETKEPFLLVQYSAKGPCVERKAKLMTPNGPEVHG

SEQ ID NO: 32864 - protein, 136 aa, Homo sapiens
MVLLESEQFLTELTRLFQKCRTSGSVYITLKKYDGRTKPIPKKGTVEGFEPADNKCLLRATDGKKKISTVVSSKEVNKFQMAYSNLLRANMDGLKKRDKKNKTKKTKAAAAAAAAAPAAAATAATTAAATAATAAQ

SEQ ID NO: 32865 - protein, 1208 aa, Homo sapiens
MDLHMMNCELLATCSALGYLEGDTYHKEPDCLESVKDLIRYLRHEDETRDVRQQLGAAQILQSDLLPILTQHHQDKPLFDAVIRLMVNLTQPALLCFGNLPKEPSFRHHFLQVLTYLQAYKEAFASEKAFGVLSETLYELLQLGWEERQEEDNLLIERILLLVRNILHVPADLDQEKKIDDDASAHDQLLWAIHLSGLDDLLLFLASSSAEEQWSLHVLEIVSLMFRDQNPEQLAGVGQGRLAQERSADFAELEVLRQREMAEKKTRALQRGNRHSRFGGSYIVQGLKSIGERDLIFHKGLHNLRNYSSDLGKQPKKVPKRRQAARELSIQRRSALNVRLFLRDFCSEFLENCYNRLMGSVKDHLLREKAQQHDETYYMWALAFFMAFNRAASFRPGLVSETLSVRTFHFIEQNLTNYYEMMLTDRKEAASWARRMHLALKAYQELLATVNEMDLSPDEAVRESSRIIKNNIFYVMEYRELFLALFRKFDERCQPRSFLRDLVETTHLFLKMLERFCRSRGNLVVQNKQKKRRKKKKKVLDQAIVSGNVPSSPEEVEAVWPALAEQLQCCAQNSELSMDSVVPFDAASEVPVEEQRAEAMVRIQDCLLAGQAPQALTLLRSAREVWPEGDVFGSQDISPEEEIQLLKQILSAPLPRQQGPEERGAEEEEEEEEEEEEELQVVQVSEKEFNFLDYLKRFACSTVVRAYVLLLRSYQQNSAHTNHCIVKMLHRLAHDLKMEALLFQLSVFCLFNRLLSDPAAGAYKELVTFAKYILGKFFALAAVNQKAFVELLFWKNTAVVREMTEGYGSLDDRSSSRRAPTWSPEEEAHLQELYLANKDVEGQDVVEAILAHLNTVPRTRKQIIHHLVQMGLADSVKDFQRKGTHIVLWTGDQELELQRLFEEFRDSDDVLGHIMKNITAKRSRARIVDKLLALGLVAERRELYKKRQKKLASSILPNGAESLKDFCQEDLEEEENLPEEDSEEEEEGGSEAEQVQGSLVLSNENLGQSLHQEGFSIPLLWLQNCLIRAADDREEDGCSQAVPLVPLTEENEEAMENEQFQQLLRKLGVRPPASGQETFWRIPAKLSPTQLRRAAASLSQPEEEQKLQPELQPKVPGEQGSDEEHCKEHRAQALRALLLAHKKKAGLASPEEEDAVGKEPLKAAPKKRQLLDSDEEQEEDEGRNRAPELGAPGIQKKKRYQIEDDEDD

SEQ ID NO: 32866 - protein, 563 aa, Homo sapiens
MGLQACLLGLFALILSGKCSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHRFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 32867 - protein, 390 aa, Homo sapiens
MNGTRNWCTLVDVHPEDQAAGSVDILRLTLQGELTGDELEHIAQKAGRKTYAMVSSHSAGHSLASELVESHDGHEEIIKVYLKGRSGDKMIHEKNINQLKSEVQYIQEARNCLQKLREDISSKLDRNLGDSLHRQEIQVVLEKPNGFSQSPTALYSSPPEVDTCINEDVESLRKTVQDLLAKLQEAKRQHQSDCVAFEVTLSRYQREAEQSNVALQREEDRVEQKEAEVGELQRRLLGMETEHQALLAKVREGEVALEELRSNNADCQAEREKAATLEKEVAGLREKIHHLDDMLKSQQRKVRQMIEQLQNSKAVIQSKDATIQELKEKIAYLEAENLEMHDRMEHLIEKQISHGNFSTQARAKTENPGSIRISKPPSPKPMPVIRVVET

SEQ ID NO: 32868 - protein, 176 aa, Homo sapiens
MAMSFEWPWQYRFPPFFTLQPNVDTRQKQLAAWCSLVLSFCRLHKQSSMTVMEAQESPLFNNVKLQRKLPVESIQIVLEELRKKGNLEWLDKSKSSFLIMWRRPEEWGKLIYQWVSRSGQNNSVFTLYELTNGEDTEDEEFHGLDEATLLRALQALQQEHKAEIITVSDGRGVKFF

SEQ ID NO: 32869 - DNA, 17 bp, Homo sapiens
gatctcaggacccccca

SEQ ID NO: 32870 - DNA, 17 bp, Homo sapiens
gatcaaaagatgaaaag

SEQ ID NO: 32871 - DNA, 17 bp, Homo sapiens
gatcctcatatggccca

SEQ ID NO: 32872 - DNA, 17 bp, Homo sapiens
gatctctaattctgtca

SEQ ID NO: 32873 - DNA, 17 bp, Homo sapiens
gatcctacgacaggacc

SEQ ID NO: 32874 - DNA, 17 bp, Homo sapiens
gatcataaagagtaaag

SEQ ID NO: 32875 - DNA, 17 bp, Homo sapiens
gatcccaggtacttgag

SEQ ID NO: 32876 - DNA, 17 bp, Homo sapiens
gatccaattgatgtata

SEQ ID NO: 32877 - DNA, 17 bp, Homo sapiens
gatcctgaggaatacag

SEQ ID NO: 32878 - DNA, 17 bp, Homo sapiens
gatcccgatgactgtac

SEQ ID NO: 32879 - DNA, 17 bp, Homo sapiens
gatctctactgattaaa

SEQ ID NO: 32880 - DNA, 17 bp, Homo sapiens
gatcagggactactgtt

SEQ ID NO: 32881 - DNA, 17 bp, Homo sapiens
gatctcagtggcttcat

SEQ ID NO: 32882 - DNA, 17 bp, Homo sapiens
gatctttcagattttgt

SEQ ID NO: 32883 - DNA, 17 bp, Homo sapiens
gatcacgccagtgcatt

SEQ ID NO: 32884 - DNA, 17 bp, Homo sapiens
gatctttcatctggttt

SEQ ID NO: 32885 - DNA, 17 bp, Homo sapiens
gatcttgcaagaccgtc

SEQ ID NO: 32886 - DNA, 17 bp, Homo sapiens
gatcaaatgtttatttt

SEQ ID NO: 32887 - DNA, 17 bp, Homo sapiens
gatccattagggttacc

SEQ ID NO: 32888 - DNA, 17 bp, Homo sapiens
gatctgactttctggtt

SEQ ID NO: 32889 - DNA, 17 bp, Homo sapiens
gatctggcaaagagaaa

SEQ ID NO: 32890 - DNA, 17 bp, Homo sapiens
gatcaaacatcaatcat

SEQ ID NO: 32891 - DNA, 17 bp, Homo sapiens
gatcaaaatcctattag

SEQ ID NO: 32892 - DNA, 17 bp, Homo sapiens
gatcagttatactctaa

SEQ ID NO: 32893 - DNA, 17 bp, Homo sapiens
gatcttcataaaaacgc

SEQ ID NO: 32894 - DNA, 17 bp, Homo sapiens
gatctttgaatctccag

SEQ ID NO: 32895 - DNA, 17 bp, Homo sapiens
gatcctgactggcctgg

SEQ ID NO: 32896 - DNA, 17 bp, Homo sapiens
gatccagagttccaatc

SEQ ID NO: 32897 - DNA, 17 bp, Homo sapiens
gatcacacaaatgatga

SEQ ID NO: 32898 - DNA, 17 bp, Homo sapiens
gatcagaagaatcagag

SEQ ID NO: 32899 - DNA, 17 bp, Homo sapiens
gatccatcatttaaaaa

SEQ ID NO: 32900 - DNA, 17 bp, Homo sapiens
gatcattattttcatcc

SEQ ID NO: 32901 - DNA, 17 bp, Homo sapiens
gatcctatctcatcttt

SEQ ID NO: 32902 - DNA, 17 bp, Homo sapiens
gatctccactgtaaact

SEQ ID NO: 32903 - DNA, 17 bp, Homo sapiens
gatccagatagtctttt

SEQ ID NO: 32904 - DNA, 17 bp, Homo sapiens
gatctgtgaggaaaaat

SEQ ID NO: 32905 - DNA, 17 bp, Homo sapiens
gatcggtggagaacctc

SEQ ID NO: 32906 - DNA, 17 bp, Homo sapiens
gatcattttctcagaga

SEQ ID NO: 32907 - DNA, 17 bp, Homo sapiens
gatctctttgagaaatt

SEQ ID NO: 32908 - DNA, 17 bp, Homo sapiens
gatcacttgaaccaaga

SEQ ID NO: 32909 - DNA, 17 bp, Homo sapiens
gatcaaggcactaatgt

SEQ ID NO: 32910 - DNA, 17 bp, Homo sapiens
gatcatgaagtctgacc

SEQ ID NO: 32911 - DNA, 17 bp, Homo sapiens
gatcattttcgactcac

SEQ ID NO: 32912 - DNA, 17 bp, Homo sapiens
gatccaagttaatgttg

SEQ ID NO: 32913 - DNA, 17 bp, Homo sapiens
gatctgagtaatagtgt

SEQ ID NO: 32914 - DNA, 17 bp, Homo sapiens
gatcgtgtcttcatttt

SEQ ID NO: 32915 - DNA, 17 bp, Homo sapiens
gatcctggaccacccag

SEQ ID NO: 32916 - DNA, 17 bp, Homo sapiens
gatcatattagttataa

SEQ ID NO: 32917 - DNA, 17 bp, Homo sapiens
gatcatccagtttgctt

SEQ ID NO: 32918 - DNA, 17 bp, Homo sapiens
gatctacataaagtcag

SEQ ID NO: 32919 - DNA, 17 bp, Homo sapiens
gatcttccgtccttctt

SEQ ID NO: 32920 - DNA, 17 bp, Homo sapiens
gatcctatcaaaacaca

SEQ ID NO: 32921 - DNA, 17 bp, Homo sapiens
gatccttatggaaatcg

SEQ ID NO: 32922 - DNA, 17 bp, Homo sapiens
gatccaatgaggccccc

SEQ ID NO: 32923 - DNA, 17 bp, Homo sapiens
gatcaaggaccggccca

SEQ ID NO: 32924 - DNA, 17 bp, Homo sapiens
gatcaatccaagtgcta

SEQ ID NO: 32925 - DNA, 17 bp, Homo sapiens
gatctaacagatattta

SEQ ID NO: 32926 - DNA, 17 bp, Homo sapiens
gatcaagaaaattcacc

SEQ ID NO: 32927 - DNA, 17 bp, Homo sapiens
gatccattaccaatcta

SEQ ID NO: 32928 - DNA, 17 bp, Homo sapiens
gatcagcaaccttttat

SEQ ID NO: 32929 - DNA, 17 bp, Homo sapiens
gatcttcttgattaaga

SEQ ID NO: 32930 - DNA, 17 bp, Homo sapiens
gatcaacactgtggtga

SEQ ID NO: 32931 - DNA, 17 bp, Homo sapiens
gatcaggagaaaaaaga

SEQ ID NO: 32932 - DNA, 17 bp, Homo sapiens
gatcagcttgagcaaga

SEQ ID NO: 32933 - DNA, 17 bp, Homo sapiens
gatccaatggtagaagg

SEQ ID NO: 32934 - DNA, 17 bp, Homo sapiens
gatccagtctttggggg

SEQ ID NO: 32935 - protein, 40 aa, Homo sapiens
RQNNTSLRLGVYAALGILQGFLVMLAAMAMAAGGIQAARV

SEQ ID NO: 32936 - protein, 19 aa, Homo sapiens
AGLGSGLSLSGLVHPELSR

SEQ ID NO: 32937 - protein, 25 aa, Homo sapiens
ELGAFGLQVPSELGGVGLCNTQYAR

SEQ ID NO: 32938 - protein, 12 aa, Homo sapiens
GFGGITHGPPEK

SEQ ID NO: 32939 - protein, 13 aa, Homo sapiens
GFGGITHGPPEKK

SEQ ID NO: 32940 - protein, 24 aa, Homo sapiens
GQLTTDQVFPYPSVLNEEQTQFLK

SEQ ID NO: 32941 - protein, 10 aa, Homo sapiens
IHNFGLIQEK

SEQ ID NO: 32942 - protein, 25 aa, Homo sapiens
LASGETVAAFCLTEPSSGSDAASIR

SEQ ID NO: 32943 - protein, 15 aa, Homo sapiens
NPFGNAGLLLGEAGK

SEQ ID NO: 32944 - protein, 14 aa, Homo sapiens
RFNPNISWQPIPVH

SEQ ID NO: 32945 - protein, 16 aa, Homo sapiens
RKNLTLMATTSQLPKL

SEQ ID NO: 32946 - protein, 24 aa, Homo sapiens
RNAQFLDMVANETGLTDLTLETVW

SEQ ID NO: 32947 - protein, 13 aa, Homo sapiens
RYHGFLNTSYHRQ

SEQ ID NO: 32948 - protein, 12 aa, Homo sapiens
DILTAIAADLCK

SEQ ID NO: 32949 - protein, 14 aa, Homo sapiens
EKDILTAIAADLCK

SEQ ID NO: 32950 - protein, 14 aa, Homo sapiens
EKPLALYVFSHNHK

SEQ ID NO: 32951 - protein, 12 aa, Homo sapiens
HLTPVTLELGGK

SEQ ID NO: 32952 - protein, 15 aa, Homo sapiens
HSFDTFSHQRPCLLK

SEQ ID NO: 32953 - protein, 26 aa, Homo sapiens
LLPQYLDQDLYIVINGGVEETTELLK

SEQ ID NO: 32954 - protein, 16 aa, Homo sapiens
SPCYIDKDCDLDIVCR

SEQ ID NO: 32955 - protein, 17 aa, Homo sapiens
VMQEEIFGPILPIVPVK

SEQ ID NO: 32956 - protein, 12 aa, Homo sapiens
DLSTVEALQNLK

SEQ ID NO: 32957 - protein, 19 aa, Homo sapiens
KLELSDNIISGGLEVLAEK

SEQ ID NO: 32958 - protein, 16 aa, Homo sapiens
SLDLFNCEITNLEDYR

SEQ ID NO: 32959 - protein, 25 aa, Homo sapiens
DDVSSFVDPALALQDAQDLYAAGEK

SEQ ID NO: 32960 - protein, 15 aa, Homo sapiens
GIGTNEQAIIDVLTK

SEQ ID NO: 32961 - protein, 10 aa, Homo sapiens
ILVCLLQGSR

SEQ ID NO: 32962 - protein, 16 aa, Homo sapiens
SETHGSLEEAMLTVVK

SEQ ID NO: 32963 - protein, 16 aa, Homo sapiens
SSSHFNPDPDAETLYK

SEQ ID NO: 32964 - protein, 8 aa, Homo sapiens
DVSSALDK

SEQ ID NO: 32965 - protein, 19 aa, Homo sapiens
DVSSALDKLKEFGNTLEDK

SEQ ID NO: 32966 - protein, 21 aa, Homo sapiens
DVSSALDKLKEFGNTLEDKAR

SEQ ID NO: 32967 - protein, 9 aa, Homo sapiens
EFGNTLEDK

SEQ ID NO: 32968 - protein, 11 aa, Homo sapiens
EFGNTLEDKAR

SEQ ID NO: 32969 - protein, 14 aa, Homo sapiens
ELISRIKQSELSAK

SEQ ID NO: 32970 - protein, 9 aa, Homo sapiens
EWFSETFQK

SEQ ID NO: 32971 - protein, 11 aa, Homo sapiens
GTPDVSSALDK

SEQ ID NO: 32972 - protein, 13 aa, Homo sapiens
GTPDVSSALDKLK

SEQ ID NO: 32973 - protein, 22 aa, Homo sapiens
GTPDVSSALDKLKEFGNTLEDK

SEQ ID NO: 32974 - protein, 24 aa, Homo sapiens
GTPDVSSALDKLKEFGNTLEDKAR

SEQ ID NO: 32975 - protein, 9 aa, Homo sapiens
IKQSELSAK

SEQ ID NO: 32976 - protein, 9 aa, Homo sapiens
LKEFGNTLE

SEQ ID NO: 32977 - protein, 11 aa, Homo sapiens
LKEFGNTLEDK

SEQ ID NO: 32978 - protein, 13 aa, Homo sapiens
LKEFGNTLEDKAR

SEQ ID NO: 32979 - protein, 11 aa, Homo sapiens
MREWFSETFQK

SEQ ID NO: 32980 - protein, 12 aa, Homo sapiens
MREWFSETFQKV

SEQ ID NO: 32981 - protein, 13 aa, Homo sapiens
MREWFSETFQKVK

SEQ ID NO: 32982 - protein, 15 aa, Homo sapiens
MREWFSETFQKVKEK

SEQ ID NO: 32983 - protein, 20 aa, Homo sapiens
MREWFSETFQKVKEKLKIDS

SEQ ID NO: 32984 - protein, 9 aa, Homo sapiens
PDVSSALDK

SEQ ID NO: 32985 - protein, 11 aa, Homo sapiens
PDVSSALDKLK

SEQ ID NO: 32986 - protein, 17 aa, Homo sapiens
SSALDKLKEFGNTLEDK

SEQ ID NO: 32987 - protein, 19 aa, Homo sapiens
SSALDKLKEFGNTLEDKAR

SEQ ID NO: 32988 - protein, 10 aa, Homo sapiens
TPDVSSALDK

SEQ ID NO: 32989 - protein, 12 aa, Homo sapiens
TPDVSSALDKLK

SEQ ID NO: 32990 - protein, 21 aa, Homo sapiens
TPDVSSALDKLKEFGNTLEDK

SEQ ID NO: 32991 - protein, 23 aa, Homo sapiens
TPDVSSALDKLKEFGNTLEDKAR

SEQ ID NO: 32992 - protein, 9 aa, Homo sapiens
VKEKLKIDS

SEQ ID NO: 32993 - protein, 18 aa, Homo sapiens
VSSALDKLKEFGNTLEDK

SEQ ID NO: 32994 - protein, 20 aa, Homo sapiens
VSSALDKLKEFGNTLEDKAR

SEQ ID NO: 32995 - protein, 32 aa, Homo sapiens
AIVQDQGCLPGLILFMDHPNPPVVHSALLALR

SEQ ID NO: 32996 - protein, 21 aa, Homo sapiens
VGSHPEGGASWLSTAANFLSR

SEQ ID NO: 32997 - protein, 14 aa, Homo sapiens
KELMFDANFTFKEG

SEQ ID NO: 32998 - protein, 19 aa, Homo sapiens
KEASDIILTDDNFTSIVKA

SEQ ID NO: 32999 - protein, 39 aa, Homo sapiens
KLVPSSSYVAVAPVKSSPTTSVPAVSSPPMGNQSGQSVP

SEQ ID NO: 33000 - protein, 17 aa, Homo sapiens
AFHSSLHESIQKPYNQK

SEQ ID NO: 33001 - protein, 19 aa, Homo sapiens
DALTQINVHYGGVQNLCSR

SEQ ID NO: 33002 - protein, 21 aa, Homo sapiens
NGQLIQLPVAEIVVGDIAQVK

SEQ ID NO: 33003 - protein, 19 aa, Homo sapiens
SIHSFMTHPEFAIEEELPR

SEQ ID NO: 33004 - protein, 13 aa, Homo sapiens
TECALLGFVTDLK

SEQ ID NO: 33005 - protein, 23 aa, Homo sapiens
TQDGVALEIQPLNSQEGIDNEEK

SEQ ID NO: 33006 - protein, 14 aa, Homo sapiens
FQSIVIGCALEDQK

SEQ ID NO: 33007 - protein, 7 aa, Homo sapiens
RLETLLR

SEQ ID NO: 33008 - protein, 19 aa, Homo sapiens
CLTTDEYDGHSTYPSHQYQ

SEQ ID NO: 33009 - protein, 9 aa, Homo sapiens
HDLGHFMLR

SEQ ID NO: 33010 - protein, 24 aa, Homo sapiens
LPSEGPRPAHVVVGDVLQAADVDK

SEQ ID NO: 33011 - protein, 10 aa, Homo sapiens
LQAVTDDHIR

SEQ ID NO: 33012 - protein, 14 aa, Homo sapiens
NDLSPTTVMSEGAR

SEQ ID NO: 33013 - protein, 17 aa, Homo sapiens
PAHVVVGDVLQAADVDK

SEQ ID NO: 33014 - protein, 15 aa, Homo sapiens
TVAGQDAVIVLLGTR

SEQ ID NO: 33015 - protein, 13 aa, Homo sapiens
VISKHDLGHFMLR

SEQ ID NO: 33016 - protein, 15 aa, Homo sapiens
VVACTSAFLLWDPTK

SEQ ID NO: 33017 - protein, 25 aa, Homo sapiens
YVAVMPPHIGDQPLTGAYTVTLDGR

SEQ ID NO: 33018 - protein, 17 aa, Homo sapiens
RNVTHLLQQELTEAQKG

SEQ ID NO: 33019 - protein, 21 aa, Homo sapiens
RGSVALVIHNITAQENGTYRC

SEQ ID NO: 33020 - protein, 12 aa, Homo sapiens
AAHLEEFHYQTK

SEQ ID NO: 33021 - protein, 12 aa, Homo sapiens
EFSPEEGLYYNK

SEQ ID NO: 33022 - protein, 25 aa, Homo sapiens
KTNKHIYSQLLRATANKTATLLERI

SEQ ID NO: 33023 - protein, 34 aa, Homo sapiens
GVSLSSYLEGLMASTISSNASKGREAMEWVIHKL

SEQ ID NO: 33024 - protein, 15 aa, Homo sapiens
ASLQHGQAAEKGPHR

SEQ ID NO: 33025 - protein, 15 aa, Homo sapiens
QPLDMSEVFAFHLDR

SEQ ID NO: 33026 - protein, 16 aa, Homo sapiens
KILGDKVNNTAVIEKQ

SEQ ID NO: 33027 - protein, 27 aa, Homo sapiens
RLVAMNMPLNSDGTVMFNATLFALVRT

SEQ ID NO: 33028 - protein, 9 aa, Homo sapiens
DGDGTITTK

SEQ ID NO: 33029 - protein, 12 aa, Homo sapiens
DGNGYISAAELR

SEQ ID NO: 33030 - protein, 22 aa, Homo sapiens
EADIDGDGQVNYEEFVQMMTAK

SEQ ID NO: 33031 - protein, 17 aa, Homo sapiens
EAFSLFDKDGDGTITTK

SEQ ID NO: 33032 - protein, 14 aa, Homo sapiens
SLFDKDGDGTITTK

SEQ ID NO: 33033 - protein, 34 aa, Homo sapiens
SLGQNPTEAELQDMINEVDADGNGTIDFPEFLTM

SEQ ID NO: 33034 - protein, 16 aa, Homo sapiens
VFDKDGNGYISAAELR

SEQ ID NO: 33035 - protein, 17 aa, Homo sapiens
ASAQQENSSTCIGSAIK

SEQ ID NO: 33036 - protein, 21 aa, Homo sapiens
SVSSQSSSSVSSQVTTAGSGK

SEQ ID NO: 33037 - protein, 15 aa, Homo sapiens
GLTFQEVENFFTFLK

SEQ ID NO: 33038 - protein, 26 aa, Homo sapiens
VELSDHVCDVVFALFDCDGNGELSNK

SEQ ID NO: 33039 - protein, 17 aa, Homo sapiens
KLALRNNSASTTQHLRL

SEQ ID NO: 33040 - protein, 17 aa, Homo sapiens
AQTTVTCTEKGWSPTPR

SEQ ID NO: 33041 - protein, 18 aa, Homo sapiens
CSKSDIEIENGFISESSS

SEQ ID NO: 33042 - protein, 16 aa, Homo sapiens
CYFPYLENGYNQNYGR

SEQ ID NO: 33043 - protein, 17 aa, Homo sapiens
CYFPYLENGYNQNYGRK

SEQ ID NO: 33044 - protein, 19 aa, Homo sapiens
FVQGNSTEVACHPGYGLPK

SEQ ID NO: 33045 - protein, 27 aa, Homo sapiens
IYILNKEIQYKCKPGYATADGNSSGSI

SEQ ID NO: 33046 - protein, 17 aa, Homo sapiens
KCYFPYLENGYNQNYGR

SEQ ID NO: 33047 - protein, 20 aa, Homo sapiens
KFVQGNSTEVACHPGYGLPK

SEQ ID NO: 33048 - protein, 21 aa, Homo sapiens
KFVQGNSTEVACHPGYGLPKA

SEQ ID NO: 33049 - protein, 19 aa, Homo sapiens
KLGYNANTSILSFQAVCRE

SEQ ID NO: 33050 - protein, 11 aa, Homo sapiens
LENGYNQNYGR

SEQ ID NO: 33051 - protein, 17 aa, Homo sapiens
LGYNANTSILSFQAVCR

SEQ ID NO: 33052 - protein, 10 aa, Homo sapiens
RPYFPVAVGK

SEQ ID NO: 33053 - protein, 33 aa, Homo sapiens
RTESEPSCGSPVVSGDPKEDHNYSSAKSSNARS

SEQ ID NO: 33054 - protein, 12 aa, Homo sapiens
LDAMLEEFKKGK

SEQ ID NO: 33055 - protein, 15 aa, Homo sapiens
RVYGQNINNETWSRI

SEQ ID NO: 33056 - protein, 7 aa, Homo sapiens
YDEKNKK

SEQ ID NO: 33057 - protein, 17 aa, Homo sapiens
AIGEMDNQVSQLTSELK

SEQ ID NO: 33058 - protein, 11 aa, Homo sapiens
ETESKIYLLVK

SEQ ID NO: 33059 - protein, 11 aa, Homo sapiens
YADAQLSCQGR

SEQ ID NO: 33060 - protein, 18 aa, Homo sapiens
MGDYGFGVLVQSNTGNKS

SEQ ID NO: 33061 - protein, 30 aa, Homo sapiens
RIDRMFPEMSIHLSRPNGTSAMLLVTLGKV

SEQ ID NO: 33062 - protein, 8 aa, Homo sapiens
DIMAEIYK

SEQ ID NO: 33063 - protein, 17 aa, Homo sapiens
GLVSGGLYESHVGCRPY

SEQ ID NO: 33064 - protein, 17 aa, Homo sapiens
GQDHCGIESEVVAGIPR

SEQ ID NO: 33065 - protein, 14 aa, Homo sapiens
HYGYNSYSVSNSEK

SEQ ID NO: 33066 - protein, 22 aa, Homo sapiens
HYGYNSYSVSNSEKDIMAEIYK

SEQ ID NO: 33067 - protein, 11 aa, Homo sapiens
ICEPGYSPTYK

SEQ ID NO: 33068 - protein, 18 aa, Homo sapiens
KGLVSGGLYESHVGCRPY

SEQ ID NO: 33069 - protein, 14 aa, Homo sapiens
LCGTFLGGPKPPQR

SEQ ID NO: 33070 - protein, 8 aa, Homo sapiens
LPASFDAR

SEQ ID NO: 33071 - protein, 18 aa, Homo sapiens
NGPVEGAFSVYSDFLLYK

SEQ ID NO: 33072 - protein, 15 aa, Homo sapiens
RLCGTFLGGPKPPQR

SEQ ID NO: 33073 - protein, 18 aa, Homo sapiens
SGVYQHVTGEMMGGHAIR

SEQ ID NO: 33074 - protein, 8 aa, Homo sapiens
TDQYWEKI

SEQ ID NO: 33075 - protein, 8 aa, Homo sapiens
VMFTEDLK

SEQ ID NO: 33076 - protein, 16 aa, Homo sapiens
VMFTEDLKLPASFDAR

SEQ ID NO: 33077 - protein, 24 aa, Homo sapiens
KNGDPELNVIQNYNEGIIDNLSKD

SEQ ID NO: 33078 - protein, 16 aa, Homo sapiens
LEQPDPGAVAAAAILR

SEQ ID NO: 33079 - protein, 30 aa, Homo sapiens
LVNSVAGCADDALAGLVACNPNLQLLQGHR

SEQ ID NO: 33080 - protein, 21 aa, Homo sapiens
VALLSGGGSGHEPAHAGFIGK

SEQ ID NO: 33081 - protein, 17 aa, Homo sapiens
VCSTLLGLEEHLNALDR

SEQ ID NO: 33082 - protein, 19 aa, Homo sapiens
AFYYPEEAGLAFGGPGSSR

SEQ ID NO: 33083 - protein, 10 aa, Homo sapiens
AGVLFGMSDR

SEQ ID NO: 33084 - protein, 14 aa, Homo sapiens
ALYSFAPISMHCNK

SEQ ID NO: 33085 - protein, 11 aa, Homo sapiens
ASQLHTHLTGR

SEQ ID NO: 33086 - protein, 21 aa, Homo sapiens
DYLIEDGTVHLVYGILEEPFR

SEQ ID NO: 33087 - protein, 13 aa, Homo sapiens
ETAFILTGYCTDK

SEQ ID NO: 33088 - protein, 19 aa, Homo sapiens
EWEIVNQDNHYSPHFQEIR

SEQ ID NO: 33089 - protein, 12 aa, Homo sapiens
FQGEWNLQPLPK

SEQ ID NO: 33090 - protein, 18 aa, Homo sapiens
GQIHLDPQQDYQLLQVQR

SEQ ID NO: 33091 - protein, 11 aa, Homo sapiens
HVLAAWALGAK

SEQ ID NO: 33092 - protein, 16 aa, Homo sapiens
KALYSFAPISMHCNKS

SEQ ID NO: 33093 - protein, 22 aa, Homo sapiens
KVVSVHPGDVLITSCTYNTEDR

SEQ ID NO: 33094 - protein, 14 aa, Homo sapiens
LEVHYHNPLVIEGR

SEQ ID NO: 33095 - protein, 21 aa, Homo sapiens
LEVHYHNPLVIEGRNDSSGIR

SEQ ID NO: 33096 - protein, 23 aa, Homo sapiens
RLEVHYHNPLVIEGRNDSSGIRL

SEQ ID NO: 33097 - protein, 18 aa, Homo sapiens
RSLEAINGSGLQMGLQRV

SEQ ID NO: 33098 - protein, 10 aa, Homo sapiens
SAVDAGFLQK

SEQ ID NO: 33099 - protein, 16 aa, Homo sapiens
SLEAINGSGLQMGLQR

SEQ ID NO: 33100 - protein, 14 aa, Homo sapiens
SPAGPTVVSIGGGK

SEQ ID NO: 33101 - protein, 15 aa, Homo sapiens
SPAGPTVVSIGGGKG

SEQ ID NO: 33102 - protein, 10 aa, Homo sapiens
TPEGLTLLFK

SEQ ID NO: 33103 - protein, 18 aa, Homo sapiens
VISTLEEPTPQCPTSQGR

SEQ ID NO: 33104 - protein, 21 aa, Homo sapiens
VVSVHPGDVLITSCTYNTEDR

SEQ ID NO: 33105 - protein, 7 aa, Homo sapiens
YFHLINR

SEQ ID NO: 33106 - protein, 7 aa, Homo sapiens
ATHAVVR

SEQ ID NO: 33107 - protein, 16 aa, Homo sapiens
DYAVSTVPVADGLHLK

SEQ ID NO: 33108 - protein, 8 aa, Homo sapiens
EFFVGLSK

SEQ ID NO: 33109 - protein, 10 aa, Homo sapiens
GAEILADTFK

SEQ ID NO: 33110 - protein, 26 aa, Homo sapiens
GAEILADTFKDYAVSTVPVADGLHLK

SEQ ID NO: 33111 - protein, 8 aa, Homo sapiens
GEEVDVAR

SEQ ID NO: 33112 - protein, 7 aa, Homo sapiens
GHVLLHR

SEQ ID NO: 33113 - protein, 9 aa, Homo sapiens
IMQQMSDHR

SEQ ID NO: 33114 - protein, 16 aa, Homo sapiens
LKDHMLIPVSMSELEK

SEQ ID NO: 33115 - protein, 25 aa, Homo sapiens
LQLNIVEMKDENATLDGGDVLFTGR

SEQ ID NO: 33116 - protein, 19 aa, Homo sapiens
LTVPDDIAANCIYLNIPNK

SEQ ID NO: 33117 - protein, 12 aa, Homo sapiens
QHQLYVGVLGSK

SEQ ID NO: 33118 - protein, 11 aa, Homo sapiens
SAKGEEVDVAR

SEQ ID NO: 33119 - protein, 10 aa, Homo sapiens
TPEEYPESAK

SEQ ID NO: 33120 - protein, 12 aa, Homo sapiens
DLMACAQTGSGK

SEQ ID NO: 33121 - protein, 23 aa, Homo sapiens
GADSLEDFLYHEGYACTSIHGDR

SEQ ID NO: 33122 - protein, 11 aa, Homo sapiens
GCHLLVATPGR

SEQ ID NO: 33123 - protein, 7 aa, Homo sapiens
HAIPIIK

SEQ ID NO: 33124 - protein, 17 aa, Homo sapiens
HVINFDLPSDIEEYVHR

SEQ ID NO: 33125 - protein, 24 aa, Homo sapiens
KGADSLEDFLYHEGYACTSIHGDR

SEQ ID NO: 33126 - protein, 17 aa, Homo sapiens
QEVPSWLENMAYEHHYK

SEQ ID NO: 33127 - protein, 12 aa, Homo sapiens
SFLLDLLNATGK

SEQ ID NO: 33128 - protein, 22 aa, Homo sapiens
TAAFLLPILSQIYSDGPGEALR

SEQ ID NO: 33129 - protein, 17 aa, Homo sapiens
VRPCVVYGGADIGQQIR

SEQ ID NO: 33130 - protein, 19 aa, Homo sapiens
WCDKSDEDDWSKPLPPSER

SEQ ID NO: 33131 - protein, 9 aa, Homo sapiens
YTRPTPVQK

SEQ ID NO: 33132 - protein, 23 aa, Homo sapiens
CLQQALHTFQNDIHVYPIWLCPF

SEQ ID NO: 33133 - protein, 14 aa, Homo sapiens
EEFWEMFDGSLYHK

SEQ ID NO: 33134 - protein, 13 aa, Homo sapiens
LGCQDAFPEVYDK

SEQ ID NO: 33135 - protein, 14 aa, Homo sapiens
LNSIGNYYKPWFFK

SEQ ID NO: 33136 - protein, 16 aa, Homo sapiens
LYEQHHVVQDMLVPMK

SEQ ID NO: 33137 - protein, 19 aa, Homo sapiens
SIFWELQDIIPFGNNPIFR

SEQ ID NO: 33138 - protein, 22 aa, Homo sapiens
FLPGYVGGIQEGAVTPAGVVNK

SEQ ID NO: 33139 - protein, 13 aa, Homo sapiens
VIECSYTSADGQR

SEQ ID NO: 33140 - protein, 10 aa, Homo sapiens
AELIVQPELK

SEQ ID NO: 33141 - protein, 20 aa, Homo sapiens
AESGPDLRYEVTSGGGGTSR

SEQ ID NO: 33142 - protein, 12 aa, Homo sapiens
AITGFDDPFSGK

SEQ ID NO: 33143 - protein, 14 aa, Homo sapiens
ALLQAILQTEDMLK

SEQ ID NO: 33144 - protein, 19 aa, Homo sapiens
AQIASGGVVDPVNSVFLPK

SEQ ID NO: 33145 - protein, 21 aa, Homo sapiens
AQQIHSQTSQQYPLYDLDLGK

SEQ ID NO: 33146 - protein, 8 aa, Homo sapiens
DLIDFDDR

SEQ ID NO: 33147 - protein, 12 aa, Homo sapiens
DQDITRFQNSLK

SEQ ID NO: 33148 - protein, 22 aa, Homo sapiens
DYELQLASYTSGLETLLNIPIK

SEQ ID NO: 33149 - protein, 10 aa, Homo sapiens
EHLMLEEELR

SEQ ID NO: 33150 - protein, 21 aa, Homo sapiens
ELDECFAQANDQMEILDSLIR

SEQ ID NO: 33151 - protein, 20 aa, Homo sapiens
ENAAYFQFFEEAQSTEAYLK

SEQ ID NO: 33152 - protein, 19 aa, Homo sapiens
FLEFQYLTGGLVDPEVHGR

SEQ ID NO: 33153 - protein, 17 aa, Homo sapiens
GFFDPNTEENLTYLQLK

SEQ ID NO: 33154 - protein, 9 aa, Homo sapiens
GLIDYETFK

SEQ ID NO: 33155 - protein, 19 aa, Homo sapiens
GYFNEELSEILSDPSDDTK

SEQ ID NO: 33156 - protein, 20 aa, Homo sapiens
HQNQNTIQELLQNCSDCLMR

SEQ ID NO: 33157 - protein, 14 aa, Homo sapiens
IEPHTGLLLLSVQK

SEQ ID NO: 33158 - protein, 9 aa, Homo sapiens
IEVLEEELR

SEQ ID NO: 33159 - protein, 30 aa, Homo sapiens
IGLVRPGTALELLEAQAATGFIVDPVSNLR

SEQ ID NO: 33160 - protein, 20 aa, Homo sapiens
IKDFLQGSSCIAGIYNETTK

SEQ ID NO: 33161 - protein, 9 aa, Homo sapiens
ISITEGIER

SEQ ID NO: 33162 - protein, 15 aa, Homo sapiens
ITNLTQQLEQASIVK

SEQ ID NO: 33163 - protein, 16 aa, Homo sapiens
IVHKGDECILKDNNER

SEQ ID NO: 33164 - protein, 11 aa, Homo sapiens
KSVEDRFDQQK

SEQ ID NO: 33165 - protein, 19 aa, Homo sapiens
LENINGVTDGYLNSLCTVR

SEQ ID NO: 33166 - protein, 25 aa, Homo sapiens
LISPESTVMLLEAQAATGGIIDPHR

SEQ ID NO: 33167 - protein, 19 aa, Homo sapiens
LLEAQACTGGIIHPTTGQK

SEQ ID NO: 33168 - protein, 37 aa, Homo sapiens
LLEAQACTGGIIHPTTGQKLSLQDAVSQGVIDQDMAT

SEQ ID NO: 33169 - protein, 22 aa, Homo sapiens
LLEAQIASGGVVDPVNSVFLPK

SEQ ID NO: 33170 - protein, 15 aa, Homo sapiens
LLEAQIATGGIIDPK

SEQ ID NO: 33171 - protein, 9 aa, Homo sapiens
LLQLQEQMR

SEQ ID NO: 33172 - protein, 8 aa, Homo sapiens
LPVDIAYK

SEQ ID NO: 33173 - protein, 10 aa, Homo sapiens
LQSLTENLTK

SEQ ID NO: 33174 - protein, 18 aa, Homo sapiens
LTEEETVCLDLDKVEAYR

SEQ ID NO: 33175 - protein, 9 aa, Homo sapiens
LTYEIEDEK

SEQ ID NO: 33176 - protein, 22 aa, Homo sapiens
NGVGTSSSMGSGVSDDVFSSSR

SEQ ID NO: 33177 - protein, 16 aa, Homo sapiens
NLPLADQGSSHHITVK

SEQ ID NO: 33178 - protein, 11 aa, Homo sapiens
NQFETEINITK

SEQ ID NO: 33179 - protein, 8 aa, Homo sapiens
QDSLESMK

SEQ ID NO: 33180 - protein, 16 aa, Homo sapiens
QESDQLVLNQHPASDK

SEQ ID NO: 33181 - protein, 11 aa, Homo sapiens
QLQNIIQATSR

SEQ ID NO: 33182 - protein, 10 aa, Homo sapiens
QVQNLVNKSK

SEQ ID NO: 33183 - protein, 15 aa, Homo sapiens
SAIYQLEEEYENLLK

SEQ ID NO: 33184 - protein, 10 aa, Homo sapiens
SMVEDITGLR

SEQ ID NO: 33185 - protein, 17 aa, Homo sapiens
SVQNDSQAIAEVLNQLK

SEQ ID NO: 33186 - protein, 13 aa, Homo sapiens
TGSQYDIQDAIDK

SEQ ID NO: 33187 - protein, 14 aa, Homo sapiens
TIADLELHYQEFIR

SEQ ID NO: 33188 - protein, 20 aa, Homo sapiens
TMIQSPSGVILQEAADVHAR

SEQ ID NO: 33189 - protein, 10 aa, Homo sapiens
VVIVDPETNK

SEQ ID NO: 33190 - protein, 14 aa, Homo sapiens
YCYLQNEVFGLFQK

SEQ ID NO: 33191 - protein, 9 aa, Homo sapiens
YETEINITK

SEQ ID NO: 33192 - protein, 9 aa, Homo sapiens
YGDGIQLTR

SEQ ID NO: 33193 - protein, 7 aa, Homo sapiens
YIELLTR

SEQ ID NO: 33194 - protein, 12 aa, Homo sapiens
DSCISPSEPETK

SEQ ID NO: 33195 - protein, 6 aa, Homo sapiens
EVLLLK

SEQ ID NO: 33196 - protein, 25 aa, Homo sapiens
KGEHQILVDEKPVPIFLVPTENSIK

SEQ ID NO: 33197 - protein, 16 aa, Homo sapiens
NTEPLKQECVSLADSK

SEQ ID NO: 33198 - protein, 21 aa, Homo sapiens
SSGGGECTVSTQEHEAPGTFR

SEQ ID NO: 33199 - protein, 12 aa, Homo sapiens
HLTHAQSTLDAK

SEQ ID NO: 33200 - protein, 16 aa, Homo sapiens
TTNAGPLHPYWPQHLR

SEQ ID NO: 33201 - protein, 17 aa, Homo sapiens
AGYAPVLDCHTAHIACK

SEQ ID NO: 33202 - protein, 25 aa, Homo sapiens
ASGTTLLEALDCILPPTRPTDKPLR

SEQ ID NO: 33203 - protein, 21 aa, Homo sapiens
DGNASGTTLLEALDCILPPTR

SEQ ID NO: 33204 - protein, 25 aa, Homo sapiens
DGNASGTTLLEALDCILPPTRPTDK

SEQ ID NO: 33205 - protein, 28 aa, Homo sapiens
DGNASGTTLLEALDCILPPTRPTDKPLR

SEQ ID NO: 33206 - protein, 12 aa, Homo sapiens
EHALLAYTLGVK

SEQ ID NO: 33207 - protein, 23 aa, Homo sapiens
HPGQISAGYAPVLDCHTAHIACK

SEQ ID NO: 33208 - protein, 11 aa, Homo sapiens
IGGIGTVPVGR

SEQ ID NO: 33209 - protein, 32 aa, Homo sapiens
IGYNPDTVAFVPISGWNGDNMLEPSANMPWFK

SEQ ID NO: 33210 - protein, 19 aa, Homo sapiens
ISAGYAPVLDCHTAHIACK

SEQ ID NO: 33211 - protein, 22 aa, Homo sapiens
KDGNASGTTLLEALDCILPPTR

SEQ ID NO: 33212 - protein, 26 aa, Homo sapiens
KDGNASGTTLLEALDCILPPTRPTDK

SEQ ID NO: 33213 - protein, 29 aa, Homo sapiens
KDGNASGTTLLEALDCILPPTRPTDKPLR

SEQ ID NO: 33214 - protein, 8 aa, Homo sapiens
LPLQDVYK

SEQ ID NO: 33215 - protein, 32 aa, Homo sapiens
NDPPMEAAGFTAQVIILNHPGQISAGYAPVLD

SEQ ID NO: 33216 - protein, 37 aa, Homo sapiens
NDPPMEAAGFTAQVIILNHPGQISAGYAPVLDCHTAH

SEQ ID NO: 33217 - protein, 24 aa, Homo sapiens
NHPGQISAGYAPVLDCHTAHIACK

SEQ ID NO: 33218 - protein, 29 aa, Homo sapiens
NMITGTSQADCAVLIVAAGVGEFEAGISK

SEQ ID NO: 33219 - protein, 9 aa, Homo sapiens
QTVAVGVIK

SEQ ID NO: 33220 - protein, 26 aa, Homo sapiens
RVETGVLKPGMVVTFAPVNVTTEVKS

SEQ ID NO: 33221 - protein, 13 aa, Homo sapiens
SGDAAIVDMVPGK

SEQ ID NO: 33222 - protein, 28 aa, Homo sapiens
SGDAAIVDMVPGKPMCVESFSDYPPLGR

SEQ ID NO: 33223 - protein, 10 aa, Homo sapiens
STTTGHLIYK

SEQ ID NO: 33224 - protein, 23 aa, Homo sapiens
SVEMHHEALSEALPGDNVGFNVK

SEQ ID NO: 33225 - protein, 31 aa, Homo sapiens
TAQVIILNHPGQISAGYAPVLDCHTAHIACK

SEQ ID NO: 33226 - protein, 15 aa, Homo sapiens
THINIVVIGHVDSGK

SEQ ID NO: 33227 - protein, 24 aa, Homo sapiens
VETGVLKPGMVVTFAPVNVTTEVK

SEQ ID NO: 33228 - protein, 28 aa, Homo sapiens
VIILNHPGQISAGYAPVLDCHTAHIACK

SEQ ID NO: 33229 - protein, 15 aa, Homo sapiens
YAPVLDCHTAHIACK

SEQ ID NO: 33230 - protein, 12 aa, Homo sapiens
YYVTIIDAPGHR

SEQ ID NO: 33231 - protein, 18 aa, Homo sapiens
ALLELQLEPEELYQTFQR

SEQ ID NO: 33232 - protein, 20 aa, Homo sapiens
ARPFPDGLAEDIDKGEVSAR

SEQ ID NO: 33233 - protein, 16 aa, Homo sapiens
AYLPVNESFGFTADLR

SEQ ID NO: 33234 - protein, 18 aa, Homo sapiens
CELLYEGPPDDEAAMGIK

SEQ ID NO: 33235 - protein, 17 aa, Homo sapiens
CFGPDGTGPNILTDITK

SEQ ID NO: 33236 - protein, 12 aa, Homo sapiens
CLYASVLTAQPR

SEQ ID NO: 33237 - protein, 27 aa, Homo sapiens
DGAGFLINLIDSPGHVDFSSEVTAALR

SEQ ID NO: 33238 - protein, 12 aa, Homo sapiens
DLEEDHACIPIK

SEQ ID NO: 33239 - protein, 13 aa, Homo sapiens
DLEEDHACIPIKK

SEQ ID NO: 33240 - protein, 18 aa, Homo sapiens
DPFDNSSRPSQVVAETRK

SEQ ID NO: 33241 - protein, 12 aa, Homo sapiens
DSVVAGFQWATK

SEQ ID NO: 33242 - protein, 10 aa, Homo sapiens
EDLYLKPIQR

SEQ ID NO: 33243 - protein, 13 aa, Homo sapiens
EGIPALDNFLDKL

SEQ ID NO: 33244 - protein, 13 aa, Homo sapiens
EGPPDDEAAMGIK

SEQ ID NO: 33245 - protein, 18 aa, Homo sapiens
EIQCPEQVVGGIYGVLNR

SEQ ID NO: 33246 - protein, 24 aa, Homo sapiens
EPIYLVEIQCPEQVVGGIYGVLNR

SEQ ID NO: 33247 - protein, 14 aa, Homo sapiens
ETVSEESNVLCLSK

SEQ ID NO: 33248 - protein, 10 aa, Homo sapiens
GEGQLGPAER

SEQ ID NO: 33249 - protein, 18 aa, Homo sapiens
GHVFEESQVAGTPMFVVK

SEQ ID NO: 33250 - protein, 12 aa, Homo sapiens
GPPDDEAAMGIK

SEQ ID NO: 33251 - protein, 21 aa, Homo sapiens
GVQYLNEIKDSVVAGFQWATK

SEQ ID NO: 33252 - protein, 9 aa, Homo sapiens
IKPVLMMNK

SEQ ID NO: 33253 - protein, 24 aa, Homo sapiens
IMIDPVLGTVGFGSGLHGWAFTLK

SEQ ID NO: 33254 - protein, 13 aa, Homo sapiens
IVGLVGVDQFLVK

SEQ ID NO: 33255 - protein, 19 aa, Homo sapiens
IWCFGPDGTGPNILTDITK

SEQ ID NO: 33256 - protein, 11 aa, Homo sapiens
KEDLYLKPIQR

SEQ ID NO: 33257 - protein, 20 aa, Homo sapiens
KIWCFGPDGTGPNILTDITK

SEQ ID NO: 33258 - protein, 22 aa, Homo sapiens
LINLIDSPGHVDFSSEVTAALR

SEQ ID NO: 33259 - protein, 26 aa, Homo sapiens
LMEPIYLVEIQCPEQVVGGIYGVLNR

SEQ ID NO: 33260 - protein, 15 aa, Homo sapiens
LYEGPPDDEAAMGIK

SEQ ID NO: 33261 - protein, 11 aa, Homo sapiens
MVNFTVDQIRA

SEQ ID NO: 33262 - protein, 12 aa, Homo sapiens
NMSVIAHVDHGK

SEQ ID NO: 33263 - protein, 7 aa, Homo sapiens
NPADLPK

SEQ ID NO: 33264 - protein, 22 aa, Homo sapiens
PAGDALLQMITIHLPSPVTAQK

SEQ ID NO: 33265 - protein, 10 aa, Homo sapiens
PALDNFLDKL

SEQ ID NO: 33266 - protein, 14 aa, Homo sapiens
PEQVVGGIYGVLNR

SEQ ID NO: 33267 - protein, 18 aa, Homo sapiens
PFPDGLAEDIDKGEVSAR

SEQ ID NO: 33268 - protein, 11 aa, Homo sapiens
PPDDEAAMGIK

SEQ ID NO: 33269 - protein, 20 aa, Homo sapiens
PVLGTVGFGSGLHGWAFTLK

SEQ ID NO: 33270 - protein, 23 aa, Homo sapiens
QFAEMYVAKFAAKGEGQLGPAER

SEQ ID NO: 33271 - protein, 30 aa, Homo sapiens
SDPMVQCIIEESGEHIIAGAGELHLEICLK

SEQ ID NO: 33272 - protein, 29 aa, Homo sapiens
SNTGGQAFPQCVFDHWQILPGDPFDNSSR

SEQ ID NO: 33273 - protein, 19 aa, Homo sapiens
STAISLFYELSENDLNFIK

SEQ ID NO: 33274 - protein, 10 aa, Homo sapiens
STLTDSLVCK

SEQ ID NO: 33275 - protein, 12 aa, Homo sapiens
TFCQLILDPIFK

SEQ ID NO: 33276 - protein, 11 aa, Homo sapiens
TGTITTFEHAH

SEQ ID NO: 33277 - protein, 14 aa, Homo sapiens
TGTITTFEHAHNMR

SEQ ID NO: 33278 - protein, 9 aa, Homo sapiens
VFDAIMNFK

SEQ ID NO: 33279 - protein, 11 aa, Homo sapiens
VFSGLVSTGLK

SEQ ID NO: 33280 - protein, 24 aa, Homo sapiens
VTDGALVVVDCVSGVCVQTETVLR

SEQ ID NO: 33281 - protein, 24 aa, Homo sapiens
WLPAGDALLQMITIHLPSPVTAQK

SEQ ID NO: 33282 - protein, 25 aa, Homo sapiens
YVEPIEDVPCGNIVGLVGVDQFLVK

SEQ ID NO: 33283 - protein, 10 aa, Homo sapiens
KDNISPKLHV

SEQ ID NO: 33284 - protein, 17 aa, Homo sapiens
RDDNSAANNSANEKERH

SEQ ID NO: 33285 - protein, 16 aa, Homo sapiens
ALEIPGEELPGVCSAR

SEQ ID NO: 33286 - protein, 26 aa, Homo sapiens
RGPTGVIATTMTDSFLTGQMLLQDLK

SEQ ID NO: 33287 - protein, 22 aa, Homo sapiens
TPQICVVGSGPAGFYTAQHLLK

SEQ ID NO: 33288 - protein, 29 aa, Homo sapiens
ASHQLTILPTNSSFTSFLTISPKMREKRN

SEQ ID NO: 33289 - protein, 21 aa, Homo sapiens
MDLTLNSSTATPVSPGSVTKE

SEQ ID NO: 33290 - protein, 39 aa, Homo sapiens
RNLLETGLNVSDTVTLPTAPNMNSEPTLQPQTGEITNRM

SEQ ID NO: 33291 - protein, 24 aa, Homo sapiens
EHSITLNLTIMNVSLQDSGTYACR

SEQ ID NO: 33292 - protein, 15 aa, Homo sapiens
ETESAIYIFISDTGR

SEQ ID NO: 33293 - protein, 14 aa, Homo sapiens
IESITQRMAIIEGK

SEQ ID NO: 33294 - protein, 10 aa, Homo sapiens
YLAVPTSKKK

SEQ ID NO: 33295 - protein, 12 aa, Homo sapiens
DLGTESQIFISR

SEQ ID NO: 33296 - protein, 15 aa, Homo sapiens
EIRPALELLEPIEQK

SEQ ID NO: 33297 - protein, 19 aa, Homo sapiens
FDLGQDVIDFTGHALALYR

SEQ ID NO: 33298 - protein, 10 aa, Homo sapiens
FLMANGQLVK

SEQ ID NO: 33299 - protein, 14 aa, Homo sapiens
FLVYVANFDEKDPR

SEQ ID NO: 33300 - protein, 11 aa, Homo sapiens
FVSISDLLVPK

SEQ ID NO: 33301 - protein, 22 aa, Homo sapiens
IYKVPSTEAEALASSLMGLFEK

SEQ ID NO: 33302 - protein, 24 aa, Homo sapiens
LSAIYGGTYMLNKPIEEIIVQNGK

SEQ ID NO: 33303 - protein, 9 aa, Homo sapiens
MLLYTEVTR

SEQ ID NO: 33304 - protein, 19 aa, Homo sapiens
NPYYGGESASITPLEDLYK

SEQ ID NO: 33305 - protein, 20 aa, Homo sapiens
NPYYGGESASITPLEDLYKR

SEQ ID NO: 33306 - protein, 19 aa, Homo sapiens
NTNDANSCQIIIPQNQVNR

SEQ ID NO: 33307 - protein, 10 aa, Homo sapiens
QLICDPSYVK

SEQ ID NO: 33308 - protein, 17 aa, Homo sapiens
SPYLYPLYGLGELPQGF

SEQ ID NO: 33309 - protein, 19 aa, Homo sapiens
SPYLYPLYGLGELPQGFAR

SEQ ID NO: 33310 - protein, 15 aa, Homo sapiens
TDDYLDQPCYETINR

SEQ ID NO: 33311 - protein, 16 aa, Homo sapiens
TYDATTHFETTCDDIK

SEQ ID NO: 33312 - protein, 10 aa, Homo sapiens
VICILSHPIK

SEQ ID NO: 33313 - protein, 19 aa, Homo sapiens
VPSTEAEALASSLMGLFEK

SEQ ID NO: 33314 - protein, 9 aa, Homo sapiens
VTEGSFVYK

SEQ ID NO: 33315 - protein, 19 aa, Homo sapiens
ACADATLSQITNNIDPVGR

SEQ ID NO: 33316 - protein, 10 aa, Homo sapiens
AGVLAGHDNR

SEQ ID NO: 33317 - protein, 13 aa, Homo sapiens
ELAGHTGYLSCCR

SEQ ID NO: 33318 - protein, 11 aa, Homo sapiens
IYAMHWGTDSR

SEQ ID NO: 33319 - protein, 12 aa, Homo sapiens
LFVSGACDASAK

SEQ ID NO: 33320 - protein, 11 aa, Homo sapiens
LIIWDSYTTNK

SEQ ID NO: 33321 - protein, 18 aa, Homo sapiens
LLLAGYDDFNCNVWDALK

SEQ ID NO: 33322 - protein, 10 aa, Homo sapiens
LLVSASQDGK

SEQ ID NO: 33323 - protein, 32 aa, Homo sapiens
QTFTGHESDINAICFFPNGNAFATGSDDATCR

SEQ ID NO: 33324 - protein, 14 aa, Homo sapiens
SELDQLRQEAEQLK

SEQ ID NO: 33325 - protein, 7 aa, Homo sapiens
VHAIPLR

SEQ ID NO: 33326 - protein, 23 aa, Homo sapiens
VSCLGVTDDGMAVATGSWDSFLK

SEQ ID NO: 33327 - protein, 28 aa, Homo sapiens
AEPPQCTSLAWSADGQTLFAGYTDNLVR

SEQ ID NO: 33328 - protein, 10 aa, Homo sapiens
DETNYGIPQR

SEQ ID NO: 33329 - protein, 12 aa, Homo sapiens
DVLSVAFSSDNR

SEQ ID NO: 33330 - protein, 17 aa, Homo sapiens
FSPNSSNPIIVSCGWDK

SEQ ID NO: 33331 - protein, 24 aa, Homo sapiens
GHNGWVTQIATTPQFPDMILSASR

SEQ ID NO: 33332 - protein, 25 aa, Homo sapiens
HIGHTGYLNTVTVSPDGSLCASGGK

SEQ ID NO: 33333 - protein, 20 aa, Homo sapiens
HLYTLDGGDIINALCFSPNR

SEQ ID NO: 33334 - protein, 16 aa, Homo sapiens
IIVDELKQEVISTSSK

SEQ ID NO: 33335 - protein, 9 aa, Homo sapiens
LWNTLGVCK

SEQ ID NO: 33336 - protein, 15 aa, Homo sapiens
PNSSNPIIVSCGWDK

SEQ ID NO: 33337 - protein, 13 aa, Homo sapiens
SSNPIIVSCGWDK

SEQ ID NO: 33338 - protein, 21 aa, Homo sapiens
TGYLNTVTVSPDGSLCASGGK

SEQ ID NO: 33339 - protein, 27 aa, Homo sapiens
TNHIGHTGYLNTVTVSPDGSLCASGGK

SEQ ID NO: 33340 - protein, 15 aa, Homo sapiens
TVQDESHSEWVSCVR

SEQ ID NO: 33341 - protein, 16 aa, Homo sapiens
TVTVSPDGSLCASGGK

SEQ ID NO: 33342 - protein, 8 aa, Homo sapiens
VWNLANCK

SEQ ID NO: 33343 - protein, 16 aa, Homo sapiens
YTVQDESHSEWVSCVR

SEQ ID NO: 33344 - protein, 12 aa, Homo sapiens
YWLCAATGPSIK

SEQ ID NO: 33345 - protein, 12 aa, Homo sapiens
FLVGPDGIPIMR

SEQ ID NO: 33346 - protein, 7 aa, Homo sapiens
LFWEPMK

SEQ ID NO: 33347 - protein, 8 aa, Homo sapiens
MDILSYMR

SEQ ID NO: 33348 - protein, 15 aa, Homo sapiens
NSCPPTSELLGTSDR

SEQ ID NO: 33349 - protein, 12 aa, Homo sapiens
PGENSEILPTLK

SEQ ID NO: 33350 - protein, 14 aa, Homo sapiens
PGGGFVPNFQLFEK

SEQ ID NO: 33351 - protein, 8 aa, Homo sapiens
PNFQLFEK

SEQ ID NO: 33352 - protein, 18 aa, Homo sapiens
PNFQLFEKGDVNGEKEQK

SEQ ID NO: 33353 - protein, 14 aa, Homo sapiens
QEPGENSEILPTLK

SEQ ID NO: 33354 - protein, 11 aa, Homo sapiens
TIDGEEYIPFK

SEQ ID NO: 33355 - protein, 15 aa, Homo sapiens
TTVSNVKMDILSYMR

SEQ ID NO: 33356 - protein, 17 aa, Homo sapiens
WNFEKFLVGPDGIPIMR

SEQ ID NO: 33357 - protein, 15 aa, Homo sapiens
YVRPGGGFVPNFQLF

SEQ ID NO: 33358 - protein, 17 aa, Homo sapiens
YVRPGGGFVPNFQLFEK

SEQ ID NO: 33359 - protein, 27 aa, Homo sapiens
YVRPGGGFVPNFQLFEKGDVNGEKEQK

SEQ ID NO: 33360 - protein, 22 aa, Homo sapiens
SIAVLELICDVHNPGQDLVIHR

SEQ ID NO: 33361 - protein, 19 aa, Homo sapiens
TFEEAAAQLLESSVQNLFK

SEQ ID NO: 33362 - protein, 14 aa, Homo sapiens
KFTPPVVNVTWLRN

SEQ ID NO: 33363 - protein, 26 aa, Homo sapiens
RSNYTPITNVPPEVTVLTNSPVELRE

SEQ ID NO: 33364 - protein, 12 aa, Homo sapiens
CVAVNVAGMTDK

SEQ ID NO: 33365 - protein, 12 aa, Homo sapiens
LWEIGNMLDTGR

SEQ ID NO: 33366 - protein, 28 aa, Homo sapiens
RGSVIGNINDVEFGIAFLNATITDSPNS

SEQ ID NO: 33367 - protein, 24 aa, Homo sapiens
RQLGNGSLAIYGTVNEDAGDYTCV

SEQ ID NO: 33368 - protein, 15 aa, Homo sapiens
RVRASSYSANGTIEY

SEQ ID NO: 33369 - protein, 27 aa, Homo sapiens
RYLQINNADLGDTANYTCVASNIAGKT

SEQ ID NO: 33370 - protein, 35 aa, Homo sapiens
CMTVVQNLMERNNLSYDCIGRLEVGTETIIDKSKS

SEQ ID NO: 33371 - protein, 23 aa, Homo sapiens
EGNDKDFTLNDFGFMIFHSPYCK

SEQ ID NO: 33372 - protein, 30 aa, Homo sapiens
RPTPNDDTLDEGVGLVHSNIATEHIPSPAK

SEQ ID NO: 33373 - protein, 11 aa, Homo sapiens
GFAFVQYVNER

SEQ ID NO: 33374 - protein, 8 aa, Homo sapiens
IVGCSVHK

SEQ ID NO: 33375 - protein, 10 aa, Homo sapiens
KSDVEAIFSK

SEQ ID NO: 33376 - protein, 10 aa, Homo sapiens
LKGDDLQAIK

SEQ ID NO: 33377 - protein, 9 aa, Homo sapiens
SDVEAIFSK

SEQ ID NO: 33378 - protein, 12 aa, Homo sapiens
VFIGNLNTLVVK

SEQ ID NO: 33379 - protein, 12 aa, Homo sapiens
ADLINNLGTIAK

SEQ ID NO: 33380 - protein, 8 aa, Homo sapiens
AKFENLCK

SEQ ID NO: 33381 - protein, 27 aa, Homo sapiens
DLVVLLFETALLSSGFSLEDPQTHSNR

SEQ ID NO: 33382 - protein, 10 aa, Homo sapiens
EDQTEYLEER

SEQ ID NO: 33383 - protein, 12 aa, Homo sapiens
ELISNASDALDK

SEQ ID NO: 33384 - protein, 14 aa, Homo sapiens
ELISNASDALDKIR

SEQ ID NO: 33385 - protein, 7 aa, Homo sapiens
EMLQQSK

SEQ ID NO: 33386 - protein, 11 aa, Homo sapiens
EQVANSAFVER

SEQ ID NO: 33387 - protein, 6 aa, Homo sapiens
FENLCK

SEQ ID NO: 33388 - protein, 7 aa, Homo sapiens
FYEAFSK

SEQ ID NO: 33389 - protein, 20 aa, Homo sapiens
GFEVVYMTEPIDEYCVQQLK

SEQ ID NO: 33390 - protein, 14 aa, Homo sapiens
GVVDSEDLPLNISR

SEQ ID NO: 33391 - protein, 11 aa, Homo sapiens
HFSVEGQLEFR

SEQ ID NO: 33392 - protein, 15 aa, Homo sapiens
HLEINPDHPIVETLR

SEQ ID NO: 33393 - protein, 20 aa, Homo sapiens
HNDDEQYAWESSAGGSFTVR

SEQ ID NO: 33394 - protein, 15 aa, Homo sapiens
HSQFIGYPITLYLEK

SEQ ID NO: 33395 - protein, 17 aa, Homo sapiens
KCLELFSELAEDKENYK

SEQ ID NO: 33396 - protein, 10 aa, Homo sapiens
LGIHEDSTNR

SEQ ID NO: 33397 - protein, 34 aa, Homo sapiens
LGLGIDEDEVAAEEPNAAVPDEIPPLEGDEDASR

SEQ ID NO: 33398 - protein, 21 aa, Homo sapiens
LVSSPCCIVTSTYGWTANMER

SEQ ID NO: 33399 - protein, 15 aa, Homo sapiens
NPDDITQEEYGEFYK

SEQ ID NO: 33400 - protein, 15 aa, Homo sapiens
PDEIPPLEGDEDASR

SEQ ID NO: 33401 - protein, 8 aa, Homo sapiens
PEYLNFIR

SEQ ID NO: 33402 - protein, 11 aa, Homo sapiens
PPLEGDEDASR

SEQ ID NO: 33403 - protein, 10 aa, Homo sapiens
RAPFDLFENK

SEQ ID NO: 33404 - protein, 11 aa, Homo sapiens
RAPFDLFENKK

SEQ ID NO: 33405 - protein, 10 aa, Homo sapiens
SIYYITGESK

SEQ ID NO: 33406 - protein, 13 aa, Homo sapiens
SLTNDWEDHLAVK

SEQ ID NO: 33407 - protein, 13 aa, Homo sapiens
TLTLVDTGIGMTK

SEQ ID NO: 33408 - protein, 19 aa, Homo sapiens
VFIMDSCDELIPEYLNFIR

SEQ ID NO: 33409 - protein, 16 aa, Homo sapiens
VILHLKEDQTEYLEER

SEQ ID NO: 33410 - protein, 14 aa, Homo sapiens
YESLTDPSKLDSGK

SEQ ID NO: 33411 - protein, 19 aa, Homo sapiens
YHTSQSGDEMTSLSEYVSR

SEQ ID NO: 33412 - protein, 9 aa, Homo sapiens
YIDQEELNK

SEQ ID NO: 33413 - protein, 11 aa, Homo sapiens
AHSSAGQQVAR

SEQ ID NO: 33414 - protein, 12 aa, Homo sapiens
AQAGANTRPCPS

SEQ ID NO: 33415 - protein, 11 aa, Homo sapiens
ASYAQQPAESR

SEQ ID NO: 33416 - protein, 15 aa, Homo sapiens
DFISLGLQDGHLVFR

SEQ ID NO: 33417 - protein, 16 aa, Homo sapiens
EHLLMALADLDELLIR

SEQ ID NO: 33418 - protein, 14 aa, Homo sapiens
EQAWQRPDGQPATR

SEQ ID NO: 33419 - protein, 16 aa, Homo sapiens
EVSEAVVDTLESEYLK

SEQ ID NO: 33420 - protein, 13 aa, Homo sapiens
GHTPTQPGALNQR

SEQ ID NO: 33421 - protein, 14 aa, Homo sapiens
GSIQVDGEELVSGR

SEQ ID NO: 33422 - protein, 18 aa, Homo sapiens
GSVYIGGAPDVATLTGGR

SEQ ID NO: 33423 - protein, 38 aa, Homo sapiens
KGVNVTMPAQPGTPPLSSTQLQIDPSLHEFQLVDLSRR

SEQ ID NO: 33424 - protein, 34 aa, Homo sapiens
KSQGLNLHTLLYLGGVEPSVPLSPATNMSAHFRG

SEQ ID NO: 33425 - protein, 9 aa, Homo sapiens
LGTVPQFPR

SEQ ID NO: 33426 - protein, 15 aa, Homo sapiens
LHHVSPADSGEYVCR

SEQ ID NO: 33427 - protein, 15 aa, Homo sapiens
LPAVEPTDQAQYLCR

SEQ ID NO: 33428 - protein, 14 aa, Homo sapiens
LVSEDPINDGEWHR

SEQ ID NO: 33429 - protein, 22 aa, Homo sapiens
NLVLHSARPGAPPPQPLDLQHR

SEQ ID NO: 33430 - protein, 23 aa, Homo sapiens
PGQYGAYFHDDGFLAFPGHVFSR

SEQ ID NO: 33431 - protein, 26 aa, Homo sapiens
RGSIQVDGEELVSGRSPGPNVAVNAK

SEQ ID NO: 33432 - protein, 27 aa, Homo sapiens
RIQGEEIVFHDLNLTAHGISHCPTCRD

SEQ ID NO: 33433 - protein, 11 aa, Homo sapiens
RNLHQSNTSRA

SEQ ID NO: 33434 - protein, 19 aa, Homo sapiens
RNQELEDNVHISPNGSIIT

SEQ ID NO: 33435 - protein, 9 aa, Homo sapiens
RPDGQPATR

SEQ ID NO: 33436 - protein, 24 aa, Homo sapiens
RSLTQGSLIVGDLAPVNGTSQGKF

SEQ ID NO: 33437 - protein, 25 aa, Homo sapiens
RVAQQDSGQYICNATSPAGHAEATI

SEQ ID NO: 33438 - protein, 14 aa, Homo sapiens
SIEYSPQLEDAGSR

SEQ ID NO: 33439 - protein, 11 aa, Homo sapiens
SPGPNVAVNAK

SEQ ID NO: 33440 - protein, 12 aa, Homo sapiens
TPSGLYLGTCER

SEQ ID NO: 33441 - protein, 9 aa, Homo sapiens
VDSYGGSLR

SEQ ID NO: 33442 - protein, 17 aa, Homo sapiens
VGGHLRPGIVQSGGVVR

SEQ ID NO: 33443 - protein, 20 aa, Homo sapiens
VISSGSVASYVTSPQGFQFR

SEQ ID NO: 33444 - protein, 9 aa, Homo sapiens
VTVTSEGGR

SEQ ID NO: 33445 - protein, 11 aa, Homo sapiens
YELGSGLAVLR

SEQ ID NO: 33446 - protein, 9 aa, Homo sapiens
YQLGSGEAR

SEQ ID NO: 33447 - protein, 24 aa, Homo sapiens
ACSPCSSQSSSSGICTDFWDLLVK

SEQ ID NO: 33448 - protein, 19 aa, Homo sapiens
AGSSTPGDAPPAVAEVQGR

SEQ ID NO: 33449 - protein, 20 aa, Homo sapiens
AQCETLSPDGLPEEQPQTTK

SEQ ID NO: 33450 - protein, 33 aa, Homo sapiens
EHAMEALLNTSTMEQATEYLLTHPPPIMGGVVR

SEQ ID NO: 33451 - protein, 30 aa, Homo sapiens
EKEERPPELPLLSEQLSLDELWDMLGECLK

SEQ ID NO: 33452 - protein, 18 aa, Homo sapiens
EVLGSLPNVFSALCLNAR

SEQ ID NO: 33453 - protein, 22 aa, Homo sapiens
FVESILSNNTTDDHCQEFVNQK

SEQ ID NO: 33454 - protein, 17 aa, Homo sapiens
HADHSSLTLGSGSSTTR

SEQ ID NO: 33455 - protein, 20 aa, Homo sapiens
HASGGSTVHIHPQAAPVVCR

SEQ ID NO: 33456 - protein, 10 aa, Homo sapiens
HIIEDPCTLR

SEQ ID NO: 33457 - protein, 8 aa, Homo sapiens
HLGYTLCK

SEQ ID NO: 33458 - protein, 11 aa, Homo sapiens
HVLDTLIQLAK

SEQ ID NO: 33459 - protein, 13 aa, Homo sapiens
KNSKNSNGQELEK

SEQ ID NO: 33460 - protein, 22 aa, Homo sapiens
LSSIIDCTGTASYHGFLPVLVR

SEQ ID NO: 33461 - protein, 14 aa, Homo sapiens
MAESMLAILCHILR

SEQ ID NO: 33462 - protein, 24 aa, Homo sapiens
MILNLTQSSGFNGFTPLVTLLLRH

SEQ ID NO: 33463 - protein, 9 aa, Homo sapiens
NLCYHAQTR

SEQ ID NO: 33464 - protein, 18 aa, Homo sapiens
QLTANTGHTIHVHYPGNR

SEQ ID NO: 33465 - protein, 25 aa, Homo sapiens
RFDGILADAGQTVENMSWMLVCDRP

SEQ ID NO: 33466 - protein, 22 aa, Homo sapiens
SAATSGAGSTTSGVVSGSLGSR

SEQ ID NO: 33467 - protein, 17 aa, Homo sapiens
SCGSSSHENRPLDLLHK

SEQ ID NO: 33468 - protein, 16 aa, Homo sapiens
SHHAASTTTAPTPAAR

SEQ ID NO: 33469 - protein, 34 aa, Homo sapiens
SNDSTEQNLSDGTPMPDSYPTTPSSTDAATSESK

SEQ ID NO: 33470 - protein, 19 aa, Homo sapiens
SSQSSSSGICTDFWDLLVK

SEQ ID NO: 33471 - protein, 35 aa, Homo sapiens
SVPVSAGGEGETSPYSLEASPLGQLMNMLSHPVIR

SEQ ID NO: 33472 - protein, 16 aa, Homo sapiens
TCFNQLDLPAYESFEK

SEQ ID NO: 33473 - protein, 16 aa, Homo sapiens
TTSNTLHYIHIEQLDK

SEQ ID NO: 33474 - protein, 15 aa, Homo sapiens
VCNDEQLLLELQQIK

SEQ ID NO: 33475 - protein, 33 aa, Homo sapiens
VLQEGLLQLDSILSSLEPLHRPIESPGGSVLLR

SEQ ID NO: 33476 - protein, 28 aa, Homo sapiens
VPHSLDLSSPNMANTVNAALKPLETLSR

SEQ ID NO: 33477 - protein, 29 aa, Homo sapiens
VPVSEGLEHSDLPDGTGEFLDAWLMLVEK

SEQ ID NO: 33478 - protein, 20 aa, Homo sapiens
VTYTINPSSHCNPNHLSYFK

SEQ ID NO: 33479 - protein, 13 aa, Homo sapiens
WLSVSMDAALGCR

SEQ ID NO: 33480 - protein, 10 aa, Homo sapiens
YICQKPSIQK

SEQ ID NO: 33481 - protein, 33 aa, Homo sapiens
EGSPLEDLALLEALSEVVQNTENLKDEVYHILK

SEQ ID NO: 33482 - protein, 10 aa, Homo sapiens
EYLPFLNTLK

SEQ ID NO: 33483 - protein, 14 aa, Homo sapiens
NEVSLVAEGFLPED

SEQ ID NO: 33484 - protein, 18 aa, Homo sapiens
TLQAGLSSNHVSHGEVLR

SEQ ID NO: 33485 - protein, 34 aa, Homo sapiens
VVLQLADGQIFKYLWESPSLAIKPWKNSGGFPVR

SEQ ID NO: 33486 - protein, 14 aa, Homo sapiens
LCSTEEETAELLSK

SEQ ID NO: 33487 - protein, 25 aa, Homo sapiens
NPETGLDLPQLVYHVENEGAAGVDR

SEQ ID NO: 33488 - protein, 20 aa, Homo sapiens
RLETFLSLLVQNLAPAETHT

SEQ ID NO: 33489 - protein, 18 aa, Homo sapiens
TLADVLVQEVIKQNMENK

SEQ ID NO: 33490 - protein, 13 aa, Homo sapiens
EILALIGYVDPVK

SEQ ID NO: 33491 - protein, 19 aa, Homo sapiens
NYGHFPGINSHYLGGCQYK

SEQ ID NO: 33492 - protein, 28 aa, Homo sapiens
MEENEEISSDEEETNVTAQAMQSNNGRG

SEQ ID NO: 33493 - protein, 26 aa, Homo sapiens
RNTEASSEEESSASRMQVEQNLSDHI

SEQ ID NO: 33494 - protein, 12 aa, Homo sapiens
RLHNGNASPPRV

SEQ ID NO: 33495 - protein, 20 aa, Homo sapiens
DSSPEHNLTKIANGVPNSKG

SEQ ID NO: 33496 - protein, 28 aa, Homo sapiens
KIEEEEEEENGDSVVQNNNTSQMSHKKV

SEQ ID NO: 33497 - protein, 30 aa, Homo sapiens
RLMAFGCVSGSVQVYTIDNSTGAMLLSHKL

SEQ ID NO: 33498 - protein, 13 aa, Homo sapiens
AHGVSSYDTVISR

SEQ ID NO: 33499 - protein, 13 aa, Homo sapiens
FTCACPDGMLLAR

SEQ ID NO: 33500 - protein, 17 aa, Homo sapiens
IGYECLCPDGFQLVAQR

SEQ ID NO: 33501 - protein, 9 aa, Homo sapiens
IYWSDLSQR

SEQ ID NO: 33502 - protein, 13 aa, Homo sapiens
LAHPFSLAVFEDK

SEQ ID NO: 33503 - protein, 14 aa, Homo sapiens
LHSISSIDVNGGNR

SEQ ID NO: 33504 - protein, 15 aa, Homo sapiens
LHSISSIDVNGGNRK

SEQ ID NO: 33505 - protein, 9 aa, Homo sapiens
MICSTQLDR

SEQ ID NO: 33506 - protein, 19 aa, Homo sapiens
MSDEVGCVNVTLCEGPNKF

SEQ ID NO: 33507 - protein, 13 aa, Homo sapiens
NVVALDTEVASNR

SEQ ID NO: 33508 - protein, 31 aa, Homo sapiens
RLTGSDVNLLAENLLSPEDMVLFHNLTQPRG

SEQ ID NO: 33509 - protein, 11 aa, Homo sapiens
SEYTSLIPNLR

SEQ ID NO: 33510 - protein, 8 aa, Homo sapiens
TILEDEKR

SEQ ID NO: 33511 - protein, 20 aa, Homo sapiens
TTEDEVHICHNQDGYSYPSR

SEQ ID NO: 33512 - protein, 24 aa, Homo sapiens
TTLSNGGCQYLCLPAPQINPHSPK

SEQ ID NO: 33513 - protein, 21 aa, Homo sapiens
KAPLSTVSANTTNMDEVPRPQ

SEQ ID NO: 33514 - protein, 26 aa, Homo sapiens
KVSPRGIILTDNLTNQLIENVSIYRI

SEQ ID NO: 33515 - protein, 34 aa, Homo sapiens
KYTEVTDINSVDANYNSSVLVSGDDFGLVKLFKF

SEQ ID NO: 33516 - protein, 10 aa, Homo sapiens
HTFEPLPFLK

SEQ ID NO: 33517 - protein, 18 aa, Homo sapiens
KIENYINESTEAQSEQKE

SEQ ID NO: 33518 - protein, 38 aa, Homo sapiens
KLHCNSACLTNTTHCPEEASVGNPEGAFMKVLQARKNY

SEQ ID NO: 33519 - protein, 18 aa, Homo sapiens
LILNHNPLTTVEDPYLFK

SEQ ID NO: 33520 - protein, 15 aa, Homo sapiens
YLDMGTTLVPLTTLK

SEQ ID NO: 33521 - protein, 17 aa, Homo sapiens
NHLVHLPEELAELPLIR

SEQ ID NO: 33522 - protein, 16 aa, Homo sapiens
NQLSTLPVHLCNLPLK

SEQ ID NO: 33523 - protein, 30 aa, Homo sapiens
RASSPNSTVSNTSTEGFGGIMSFASSLYRN

SEQ ID NO: 33524 - protein, 14 aa, Homo sapiens
DVPAVEITHTFWER

SEQ ID NO: 33525 - protein, 34 aa, Homo sapiens
DYCGCMIIEDEDAPISITLDDTKPDGSLPAIMGF

SEQ ID NO: 33526 - protein, 18 aa, Homo sapiens
EIPTDAPWEAQHADKWDK

SEQ ID NO: 33527 - protein, 20 aa, Homo sapiens
GAFPPVWNPIAYLDYNNLWR

SEQ ID NO: 33528 - protein, 7 aa, Homo sapiens
ICELYAK

SEQ ID NO: 33529 - protein, 11 aa, Homo sapiens
IHFRPELPAER

SEQ ID NO: 33530 - protein, 10 aa, Homo sapiens
IMDLLGDQVK

SEQ ID NO: 33531 - protein, 28 aa, Homo sapiens
LNHPVTHVDQSSDNIIIETLNHEHYECK

SEQ ID NO: 33532 - protein, 20 aa, Homo sapiens
NEHVDYVDVGGAYVGPTQNR

SEQ ID NO: 33533 - protein, 16 aa, Homo sapiens
VLGSQEALHPVHYEEK

SEQ ID NO: 33534 - protein, 18 aa, Homo sapiens
FQLMNITAGTSHVMISRR

SEQ ID NO: 33535 - protein, 20 aa, Homo sapiens
LHGTYGYVTADFISQSSSAS

SEQ ID NO: 33536 - protein, 20 aa, Homo sapiens
MTSWISPAVNNSDFWTYRKN

SEQ ID NO: 33537 - protein, 26 aa, Homo sapiens
NDQLSEIEEFFYINLTSVEIRGLQKF

SEQ ID NO: 33538 - protein, 28 aa, Homo sapiens
REPAQGLFGTVTVQFIVTEVNSSNESKD

SEQ ID NO: 33539 - protein, 7 aa, Homo sapiens
TVSLTAF

SEQ ID NO: 33540 - protein, 19 aa, Homo sapiens
RGNIYPGNDTFDIDPEIET

SEQ ID NO: 33541 - protein, 38 aa, Homo sapiens
KTNLDDDVPILLFESNGSLIYTPTIEINSSHHSAMEKR

SEQ ID NO: 33542 - protein, 26 aa, Homo sapiens
AAYSFYNVHTQTPLLDLMSDALVLAK

SEQ ID NO: 33543 - protein, 13 aa, Homo sapiens
FDYSPEFLLWALR

SEQ ID NO: 33544 - protein, 16 aa, Homo sapiens
FGIGDGNLQYYLYNWK

SEQ ID NO: 33545 - protein, 14 aa, Homo sapiens
GEVVNTHGPVEPDK

SEQ ID NO: 33546 - protein, 19 aa, Homo sapiens
LGEVVNTHGPVEPDKDNIR

SEQ ID NO: 33547 - protein, 20 aa, Homo sapiens
QEPYTLPQGFTWDALDLGDR

SEQ ID NO: 33548 - protein, 12 aa, Homo sapiens
AFDCPETEYPVK

SEQ ID NO: 33549 - protein, 18 aa, Homo sapiens
IHALTITWALPPQQQHYR

SEQ ID NO: 33550 - protein, 27 aa, Homo sapiens
LNFKPLEQEMPVQFQVVELPSGHHLCK

SEQ ID NO: 33551 - protein, 20 aa, Homo sapiens
STCSCPDLQPNGQDLGENSR

SEQ ID NO: 33552 - protein, 14 aa, Homo sapiens
GCTVWLTGLSGAGK

SEQ ID NO: 33553 - protein, 14 aa, Homo sapiens
HPVLLLHPLGGWTK

SEQ ID NO: 33554 - protein, 24 aa, Homo sapiens
IHESAGLPFFEIFVDAPLNICESR

SEQ ID NO: 33555 - protein, 13 aa, Homo sapiens
STNVVYQAHHVSR

SEQ ID NO: 33556 - protein, 27 aa, Homo sapiens
TTISFALEEYLVSHAIPCYSLDGDNVR

SEQ ID NO: 33557 - protein, 20 aa, Homo sapiens
KDTGNYSVMAYRLIIPPIKE

SEQ ID NO: 33558 - protein, 19 aa, Homo sapiens
RGSSNPLLTTEEANLTEKE

SEQ ID NO: 33559 - protein, 14 aa, Homo sapiens
EELPENVPIGNIPK

SEQ ID NO: 33560 - protein, 20 aa, Homo sapiens
KIVASDSGKPSLNQTALVRV

SEQ ID NO: 33561 - protein, 21 aa, Homo sapiens
KNADIVYQLGPNASFFDLDRK

SEQ ID NO: 33562 - protein, 26 aa, Homo sapiens
KQYGSNEGHFNNGSHMTDIPLANLKS

SEQ ID NO: 33563 - protein, 27 aa, Homo sapiens
KVTINVMDVNDNSPVVISPPSNTSFKL

SEQ ID NO: 33564 - protein, 22 aa, Homo sapiens
RATVTINVTDVNDNPPNIDLRY

SEQ ID NO: 33565 - protein, 25 aa, Homo sapiens
RIDPVTGNITLEEKPAPTDVGLHRL

SEQ ID NO: 33566 - protein, 17 aa, Homo sapiens
RLFALNNTTGLITVQRS

SEQ ID NO: 33567 - protein, 17 aa, Homo sapiens
RYIISPINGTVYLSEKD

SEQ ID NO: 33568 - protein, 12 aa, Homo sapiens
WPQLIVQQNLDR

SEQ ID NO: 33569 - protein, 10 aa, Homo sapiens
PRNYSVNIRE

SEQ ID NO: 33570 - protein, 29 aa, Homo sapiens
EMQEVETNLQEVVFDYLHATAYQNTALGR

SEQ ID NO: 33571 - protein, 11 aa, Homo sapiens
FHFGDSLCTHK

SEQ ID NO: 33572 - protein, 19 aa, Homo sapiens
IVLAAAGGVSHDELLDLAK

SEQ ID NO: 33573 - protein, 14 aa, Homo sapiens
NNGTAHFLEHMAFK

SEQ ID NO: 33574 - protein, 22 aa, Homo sapiens
VASEDSGLSTCTVGLWIDAGSR

SEQ ID NO: 33575 - protein, 17 aa, Homo sapiens
HISPTAPDTLGCYPFYK

SEQ ID NO: 33576 - protein, 16 aa, Homo sapiens
RFLGTSGQNVSDIFRY

SEQ ID NO: 33577 - protein, 14 aa, Homo sapiens
VPVATYTNSSQPFR

SEQ ID NO: 33578 - protein, 14 aa, Homo sapiens
AAAITSDILEALGR

SEQ ID NO: 33579 - protein, 16 aa, Homo sapiens
DGHFTLFAPTNEAFEK

SEQ ID NO: 33580 - protein, 19 aa, Homo sapiens
DGHFTLFAPTNEAFEKLPR

SEQ ID NO: 33581 - protein, 21 aa, Homo sapiens
DKNALQNIILYHLTPGVFIGK

SEQ ID NO: 33582 - protein, 17 aa, Homo sapiens
FIEGGDGHLFEDEEIKR

SEQ ID NO: 33583 - protein, 18 aa, Homo sapiens
GRDQGPNVCALQQILGTK

SEQ ID NO: 33584 - protein, 11 aa, Homo sapiens
IITGPEIKYTR

SEQ ID NO: 33585 - protein, 25 aa, Homo sapiens
ISTGGGETEETLKKLLQEEVTKVTK

SEQ ID NO: 33586 - protein, 14 aa, Homo sapiens
KEVNDTLLVNELKS

SEQ ID NO: 33587 - protein, 18 aa, Homo sapiens
KIFLKEVNDTLLVNELKS

SEQ ID NO: 33588 - protein, 19 aa, Homo sapiens
LIKEGETITEVIHGEPIIK

SEQ ID NO: 33589 - protein, 23 aa, Homo sapiens
LIKEGETITEVIHGEPIIKKYTK

SEQ ID NO: 33590 - protein, 11 aa, Homo sapiens
LLQEEVTKVTK

SEQ ID NO: 33591 - protein, 12 aa, Homo sapiens
NNHYDKILAHSR

SEQ ID NO: 33592 - protein, 21 aa, Homo sapiens
YTKIIDGVPVEITEKETREER

SEQ ID NO: 33593 - protein, 17 aa, Homo sapiens
MSSKHNMSGGEFQGKRE

SEQ ID NO: 33594 - protein, 22 aa, Homo sapiens
SPAYTPQNLDSESESGSSIAEK

SEQ ID NO: 33595 - protein, 19 aa, Homo sapiens
VAHHGENPVSCPELVQQLR

SEQ ID NO: 33596 - protein, 17 aa, Homo sapiens
KKMLYRDFNMTGWAYKT

SEQ ID NO: 33597 - protein, 19 aa, Homo sapiens
LGSGDDISVYVIPLIHGNK

SEQ ID NO: 33598 - protein, 22 aa, Homo sapiens
NSAVLPPTCLGEEPENTPANSR

SEQ ID NO: 33599 - protein, 16 aa, Homo sapiens
EFGGGHIKDEVFGTVK

SEQ ID NO: 33600 - protein, 13 aa, Homo sapiens
HQTLQGVAFPISR

SEQ ID NO: 33601 - protein, 22 aa, Homo sapiens
KIEIDNGDELTADFLYEEVHPK

SEQ ID NO: 33602 - protein, 7 aa, Homo sapiens
YHFFLYK

SEQ ID NO: 33603 - protein, 11 aa, Homo sapiens
HLVLACHYDSK

SEQ ID NO: 33604 - protein, 16 aa, Homo sapiens
KNYHQPAILNSSALRQ

SEQ ID NO: 33605 - protein, 15 aa, Homo sapiens
LQAIEHELHELGLLK

SEQ ID NO: 33606 - protein, 22 aa, Homo sapiens
LQAIEHELHELGLLKDHSLEGR

SEQ ID NO: 33607 - protein, 11 aa, Homo sapiens
MASTPHPPGAR

SEQ ID NO: 33608 - protein, 22 aa, Homo sapiens
RYFQNYSYGGVIQDDHIPFLRR

SEQ ID NO: 33609 - protein, 14 aa, Homo sapiens
SFSNIISTLNPTAK

SEQ ID NO: 33610 - protein, 20 aa, Homo sapiens
VFVGATDSAVPCAMMLELAR

SEQ ID NO: 33611 - protein, 11 aa, Homo sapiens
YPGSPGSYAAR

SEQ ID NO: 33612 - protein, 18 aa, Homo sapiens
ALGFPEGLVIQAYFACEK

SEQ ID NO: 33613 - protein, 35 aa, Homo sapiens
APTPVPALAPTSTPASITPASATASSEPAPASAAK

SEQ ID NO: 33614 - protein, 9 aa, Homo sapiens
DAFPVAGQK

SEQ ID NO: 33615 - protein, 11 aa, Homo sapiens
GKDAFPVAGQK

SEQ ID NO: 33616 - protein, 10 aa, Homo sapiens
IDIDPEETVK

SEQ ID NO: 33617 - protein, 9 aa, Homo sapiens
ILNDDTALK

SEQ ID NO: 33618 - protein, 11 aa, Homo sapiens
NFVVVMVTKPK

SEQ ID NO: 33619 - protein, 36 aa, Homo sapiens
QAPTPVPALAPTSTPASITPASATASSEPAPASAAK

SEQ ID NO: 33620 - protein, 19 aa, Homo sapiens
QIIQQNPSLLPALLQQIGR

SEQ ID NO: 33621 - protein, 31 aa, Homo sapiens
SNLFEDATSALVTGQSYENMVTEIMSMGYER

SEQ ID NO: 33622 - protein, 8 aa, Homo sapiens
TLQQQTFK

SEQ ID NO: 33623 - protein, 8 aa, Homo sapiens
AKSIVFHR

SEQ ID NO: 33624 - protein, 16 aa, Homo sapiens
ATLGVEVHPLVFHTNR

SEQ ID NO: 33625 - protein, 11 aa, Homo sapiens
FNVWDTAGQEK

SEQ ID NO: 33626 - protein, 8 aa, Homo sapiens
HLTGEFEK

SEQ ID NO: 33627 - protein, 12 aa, Homo sapiens
KKNLQYYDISAK

SEQ ID NO: 33628 - protein, 19 aa, Homo sapiens
KYVATLGVEVHPLVFHTNR

SEQ ID NO: 33629 - protein, 14 aa, Homo sapiens
SNYNFEKPFLWLAR

SEQ ID NO: 33630 - protein, 13 aa, Homo sapiens
VCENIPIVLCGNK

SEQ ID NO: 33631 - protein, 18 aa, Homo sapiens
YVATLGVEVHPLVFHTNR

SEQ ID NO: 33632 - protein, 7 aa, Homo sapiens
DYLAQIR

SEQ ID NO: 33633 - protein, 13 aa, Homo sapiens
EVQEAQVNEEEVK

SEQ ID NO: 33634 - protein, 14 aa, Homo sapiens
WGQYASDVQLILRR

SEQ ID NO: 33635 - protein, 24 aa, Homo sapiens
PFMNSLGLVTSNGLPEVENLSKRY

SEQ ID NO: 33636 - protein, 23 aa, Homo sapiens
RVNSTANAETQATSAFQTQKPLK

SEQ ID NO: 33637 - protein, 9 aa, Homo sapiens
FIQVHPITK

SEQ ID NO: 33638 - protein, 12 aa, Homo sapiens
QWVAAGGHITFK

SEQ ID NO: 33639 - protein, 10 aa, Homo sapiens
LQTVKLPVDK

SEQ ID NO: 33640 - protein, 7 aa, Homo sapiens
SVYKLEK

SEQ ID NO: 33641 - protein, 28 aa, Homo sapiens
DDNINALTNCITQLNLLECESESEGQNK

SEQ ID NO: 33642 - protein, 20 aa, Homo sapiens
KTSNSSQVSNEQDKIDAYKL

SEQ ID NO: 33643 - protein, 21 aa, Homo sapiens
NILTTWGDTIFSIVTGGEETR

SEQ ID NO: 33644 - protein, 24 aa, Homo sapiens
RKIQQESLGSAPLMGDDHPNASRD

SEQ ID NO: 33645 - protein, 17 aa, Homo sapiens
YFNVHELEALLQEMSSK

SEQ ID NO: 33646 - protein, 12 aa, Homo sapiens
AIIIFVPVPQLK

SEQ ID NO: 33647 - protein, 8 aa, Homo sapiens
HVVFIAQR

SEQ ID NO: 33648 - protein, 30 aa, Homo sapiens
IVKPNGEKPDEFESGISQALLELEMNSDLK

SEQ ID NO: 33649 - protein, 13 aa, Homo sapiens
LEDLVFPSEIVGK

SEQ ID NO: 33650 - protein, 22 aa, Homo sapiens
TLTAVHDAILEDLVFPSEIVGK

SEQ ID NO: 33651 - protein, 9 aa, Homo sapiens
VETFSGVYK

SEQ ID NO: 33652 - protein, 19 aa, Homo sapiens
KSNITFNNNDTVSFLEYRT

SEQ ID NO: 33653 - protein, 32 aa, Homo sapiens
KTLFANGSIYPPNEGFCPCLESGIQNVSTCRF

SEQ ID NO: 33654 - protein, 29 aa, Homo sapiens
GPEAGYVATPIAMVQAAMTLLSDASHLPK

SEQ ID NO: 33655 - protein, 28 aa, Homo sapiens
KMNGTLTAVESFLTIHSGPEGLSIHDGT

SEQ ID NO: 33656 - protein, 5 aa, Homo sapiens
KPNIK

SEQ ID NO: 33657 - protein, 28 aa, Homo sapiens
LGRPTLSSEVGIIICDIANPASLDEMAK

SEQ ID NO: 33658 - protein, 14 aa, Homo sapiens
NVSNLKPVPLIGPK

SEQ ID NO: 33659 - protein, 17 aa, Homo sapiens
ERPDLPPVQYEPVLCSR

SEQ ID NO: 33660 - protein, 17 aa, Homo sapiens
HLLQAPLDDAQEILQAR

SEQ ID NO: 33661 - protein, 29 aa, Homo sapiens
ICGLDPTSTLGIYFEVVNQHNTPIPQGGR

SEQ ID NO: 33662 - protein, 12 aa, Homo sapiens
YINTEHGGSQAR

SEQ ID NO: 33663 - protein, 36 aa, Homo sapiens
KKVLVAPPPDEEANATSAVVSLLNETVTEVPEETKM

SEQ ID NO: 33664 - protein, 15 aa, Homo sapiens
KNNYSPTAAGTERRK

SEQ ID NO: 33665 - protein, 17 aa, Homo sapiens
RVESNSSAHPWGLVGKS

SEQ ID NO: 33666 - protein, 20 aa, Homo sapiens
MDFNLSGDSDGSAGVSESRI

SEQ ID NO: 33667 - protein, 17 aa, Homo sapiens
LHQLSGSDQLESTAHSR

SEQ ID NO: 33668 - protein, 31 aa, Homo sapiens
NTESLFEELSSAGSGLIGDVDEGADLLGMGR

SEQ ID NO: 33669 - protein, 18 aa, Homo sapiens
SHTSLKDELSDVSQGGSK

SEQ ID NO: 33670 - protein, 15 aa, Homo sapiens
IIQQVLQGLDYLHTK

SEQ ID NO: 33671 - protein, 25 aa, Homo sapiens
YEWSQEEAAGFTDFLLPMLELIPEK

SEQ ID NO: 33672 - protein, 25 aa, Homo sapiens
IDATQVEVNPFGETPEGQVVCFDAK

SEQ ID NO: 33673 - protein, 7 aa, Homo sapiens
LYNLFLK

SEQ ID NO: 33674 - protein, 30 aa, Homo sapiens
SCNGPVLVGSPQGGVDIEEVAASNPELIFK

SEQ ID NO: 33675 - protein, 16 aa, Homo sapiens
SENEPIENEAAKYDLK

SEQ ID NO: 33676 - protein, 17 aa, Homo sapiens
KMSNYSLLSVDYVVDKA

SEQ ID NO: 33677 - protein, 15 aa, Homo sapiens
MSNYSLLSVDYVVDK

SEQ ID NO: 33678 - protein, 6 aa, Homo sapiens
SFFSSK

SEQ ID NO: 33679 - protein, 19 aa, Homo sapiens
DDIAQVDYVEPSQNTISLK

SEQ ID NO: 33680 - protein, 14 aa, Homo sapiens
VELHSTCQTISVDR

SEQ ID NO: 33681 - protein, 25 aa, Homo sapiens
AFDTYKALVVSVNVSSKEFLQTESP

SEQ ID NO: 33682 - protein, 14 aa, Homo sapiens
CLCDEIIKKLNENK

SEQ ID NO: 33683 - protein, 12 aa, Homo sapiens
DAPGTGEEAQGK

SEQ ID NO: 33684 - protein, 9 aa, Homo sapiens
ENRTDTASR

SEQ ID NO: 33685 - protein, 22 aa, Homo sapiens
HLHESLLQQLQDSVQNLDGHVR

SEQ ID NO: 33686 - protein, 7 aa, Homo sapiens
HLLSYNR

SEQ ID NO: 33687 - protein, 23 aa, Homo sapiens
KNLEDGINNLKKQWETLEPLHLE

SEQ ID NO: 33688 - protein, 13 aa, Homo sapiens
KQYESVSDLFNTK

SEQ ID NO: 33689 - protein, 10 aa, Homo sapiens
NLEDGINNLK

SEQ ID NO: 33690 - protein, 20 aa, Homo sapiens
QSYLTLESGAVPLLEDTASR

SEQ ID NO: 33691 - protein, 13 aa, Homo sapiens
RELMQLEKELVER

SEQ ID NO: 33692 - protein, 29 aa, Homo sapiens
RHLQEMANSLPHFKDGREKTVNQQCQNTV

SEQ ID NO: 33693 - protein, 17 aa, Homo sapiens
RTNVLNDAYENLTRYKE

SEQ ID NO: 33694 - protein, 20 aa, Homo sapiens
TAACPNSSEVLYTSAKEELK

SEQ ID NO: 33695 - protein, 9 aa, Homo sapiens
VTHDGILAR

SEQ ID NO: 33696 - protein, 22 aa, Homo sapiens
KRTIYLNITNTLNITNNNYYSV

SEQ ID NO: 33697 - protein, 15 aa, Homo sapiens
AHFQNFPNGVTDFIK

SEQ ID NO: 33698 - protein, 34 aa, Homo sapiens
DEDKDLFPLLECLSSVATALQSGFLPYCEPVYQR

SEQ ID NO: 33699 - protein, 24 aa, Homo sapiens
ICEDSAEILDSDVLDRPLNIMIPK

SEQ ID NO: 33700 - protein, 22 aa, Homo sapiens
LCSLLDSEDYNTCEGAFGALQK

SEQ ID NO: 33701 - protein, 14 aa, Homo sapiens
SHAVACVNQFIISR

SEQ ID NO: 33702 - protein, 26 aa, Homo sapiens
TQDQDENVALEACEFWLTLAEQPICK

SEQ ID NO: 33703 - protein, 23 aa, Homo sapiens
AGDEAVFAQYDSFHVDSAAEYYR

SEQ ID NO: 33704 - protein, 20 aa, Homo sapiens
ELPPHLGELTVAEETSSSLR

SEQ ID NO: 33705 - protein, 10 aa, Homo sapiens
FLLYGLHEGK

SEQ ID NO: 33706 - protein, 9 aa, Homo sapiens
FLLYGLSGR

SEQ ID NO: 33707 - protein, 15 aa, Homo sapiens
GEESEVTVGGLEPGR

SEQ ID NO: 33708 - protein, 23 aa, Homo sapiens
GFEESEPLTGFLTTVPDGPTQLR

SEQ ID NO: 33709 - protein, 9 aa, Homo sapiens
HGPVPVEAR

SEQ ID NO: 33710 - protein, 15 aa, Homo sapiens
LGPISADSTTAPLEK

SEQ ID NO: 33711 - protein, 16 aa, Homo sapiens
LNWEAPPGAFDSFLLR

SEQ ID NO: 33712 - protein, 9 aa, Homo sapiens
LQGLIPGAR

SEQ ID NO: 33713 - protein, 11 aa, Homo sapiens
LQVVPVAANQR

SEQ ID NO: 33714 - protein, 15 aa, Homo sapiens
LSQLSVTDVTTSSLR

SEQ ID NO: 33715 - protein, 22 aa, Homo sapiens
RGPNLTSPASITFTTGLEAPRD

SEQ ID NO: 33716 - protein, 10 aa, Homo sapiens
TLSPVLESPR

SEQ ID NO: 33717 - protein, 11 aa, Homo sapiens
TVTVEDLEPGK

SEQ ID NO: 33718 - protein, 20 aa, Homo sapiens
VGPISVIGVTEEETPAPTEP

SEQ ID NO: 33719 - protein, 18 aa, Homo sapiens
VPGHEDGVTISGLEPDHK

SEQ ID NO: 33720 - protein, 17 aa, Homo sapiens
VRGEESEVTVGGLEPGR

SEQ ID NO: 33721 - protein, 21 aa, Homo sapiens
VSYQLADGGEPQSVQVDGQAR

SEQ ID NO: 33722 - protein, 9 aa, Homo sapiens
YEVTVVSVR

SEQ ID NO: 33723 - protein, 11 aa, Homo sapiens
DGSFGEGLTMK

SEQ ID NO: 33724 - protein, 14 aa, Homo sapiens
KPHLYEGDNLYCPK

SEQ ID NO: 33725 - protein, 16 aa, Homo sapiens
LEEAMSELTMPSSVLK

SEQ ID NO: 33726 - protein, 21 aa, Homo sapiens
MFSLITWNIDGLDLNNLSERA

SEQ ID NO: 33727 - protein, 15 aa, Homo sapiens
AILVDLEPGTMDSVR

SEQ ID NO: 33728 - protein, 15 aa, Homo sapiens
ALTVPELTQQVFDAK

SEQ ID NO: 33729 - protein, 17 aa, Homo sapiens
EIVHIQAGQCGNQIGAK

SEQ ID NO: 33730 - protein, 12 aa, Homo sapiens
EVDEQMLNVQNK

SEQ ID NO: 33731 - protein, 27 aa, Homo sapiens
FWEVISDEHGIDPTGTYHGDSDLQLDR

SEQ ID NO: 33732 - protein, 18 aa, Homo sapiens
GHYTEGAELVDSVLDVVR

SEQ ID NO: 33733 - protein, 12 aa, Homo sapiens
IGNSTAIQELFK

SEQ ID NO: 33734 - protein, 20 aa, Homo sapiens
IREEYPDRIMNTFSVVPSPK

SEQ ID NO: 33735 - protein, 12 aa, Homo sapiens
ISVYYNEATGGK

SEQ ID NO: 33736 - protein, 16 aa, Homo sapiens
KEAESCDCLQGFQLTH

SEQ ID NO: 33737 - protein, 33 aa, Homo sapiens
KEAESCDCLQGFQLTHSLGGGTGSGMGTLLISK

SEQ ID NO: 33738 - protein, 19 aa, Homo sapiens
KGHYTEGAELVDSVLDVVR

SEQ ID NO: 33739 - protein, 19 aa, Homo sapiens
KMAVTFIGNSTAIQELFKR

SEQ ID NO: 33740 - protein, 10 aa, Homo sapiens
LAVNMVPFPR

SEQ ID NO: 33741 - protein, 14 aa, Homo sapiens
LHFFMPGFAPLTSR

SEQ ID NO: 33742 - protein, 25 aa, Homo sapiens
LTTPTYGDLNHLVSATMSGVTTCLR

SEQ ID NO: 33743 - protein, 17 aa, Homo sapiens
MAVTFIGNSTAIQELFK

SEQ ID NO: 33744 - protein, 30 aa, Homo sapiens
NATLSVHQLVENTDETYCIDNEALYDICFR

SEQ ID NO: 33745 - protein, 14 aa, Homo sapiens
NSSYFVEWIPNNVK

SEQ ID NO: 33746 - protein, 22 aa, Homo sapiens
PTYGDLNHLVSATMSGVTTCLR

SEQ ID NO: 33747 - protein, 23 aa, Homo sapiens
QLVENTDETYCIDNEALYDICFR

SEQ ID NO: 33748 - protein, 26 aa, Homo sapiens
SGPFGQIFRPDNFVFGQSGAGNNWAK

SEQ ID NO: 33749 - protein, 9 aa, Homo sapiens
TAVCDIPPR

SEQ ID NO: 33750 - protein, 16 aa, Homo sapiens
VSDTVVEPYNATLSVH

SEQ ID NO: 33751 - protein, 9 aa, Homo sapiens
YLTVAAVFR

SEQ ID NO: 33752 - protein, 25 aa, Homo sapiens
ISNGGLEEGKPVDLVLSCVDNFEAR

SEQ ID NO: 33753 - protein, 16 aa, Homo sapiens
LLLFDYDKVELANMNR

SEQ ID NO: 33754 - protein, 27 aa, Homo sapiens
NINPDVLFEVHNYNITTVENFQHFMDR

SEQ ID NO: 33755 - protein, 11 aa, Homo sapiens
LVICPDEGFYK

SEQ ID NO: 33756 - protein, 21 aa, Homo sapiens
SIIYGLQYLFLEPNPEDPLNK

SEQ ID NO: 33757 - protein, 16 aa, Homo sapiens
TCDISFSDPDDLLNFK

SEQ ID NO: 33758 - protein, 11 aa, Homo sapiens
VGQGYPHDPPK

SEQ ID NO: 33759 - protein, 13 aa, Homo sapiens
DNEAIEFSFDLER

SEQ ID NO: 33760 - protein, 10 aa, Homo sapiens
FIVSPVPESR

SEQ ID NO: 33761 - protein, 11 aa, Homo sapiens
VVECQLETHNR

SEQ ID NO: 33762 - protein, 17 aa, Homo sapiens
KAVTVMMDPNSTQRYRL

SEQ ID NO: 33763 - protein, 24 aa, Homo sapiens
RVGLFCGIFIVLNITLVLAAVFKL

SEQ ID NO: 33764 - protein, 24 aa, Homo sapiens
KSVNVSSNLVTQEPSPEETSTKRS

SEQ ID NO: 33765 - protein, 26 aa, Homo sapiens
MKLEMDVRRFEDVSSEVSTLHKRKGR

SEQ ID NO: 33766 - protein, 6 aa, Homo sapiens
THLAPY

SEQ ID NO: 33767 - protein, 10 aa, Homo sapiens
AGFAGDDAPR

SEQ ID NO: 33768 - protein, 21 aa, Homo sapiens
AGFAGDDAPRAVFPSIVGRPR

SEQ ID NO: 33769 - protein, 9 aa, Homo sapiens
AVFPSIVGR

SEQ ID NO: 33770 - protein, 11 aa, Homo sapiens
AVFPSIVGRPR

SEQ ID NO: 33771 - protein, 8 aa, Homo sapiens
DLTDYLMK

SEQ ID NO: 33772 - protein, 21 aa, Homo sapiens
DLYANNVMSGGTTMYPGIADR

SEQ ID NO: 33773 - protein, 11 aa, Homo sapiens
DSYVGDEAQSK

SEQ ID NO: 33774 - protein, 12 aa, Homo sapiens
DSYVGDEAQSKR

SEQ ID NO: 33775 - protein, 11 aa, Homo sapiens
EITALAPSTMK

SEQ ID NO: 33776 - protein, 22 aa, Homo sapiens
GILTLKYPIEHGIITNWDDMEK

SEQ ID NO: 33777 - protein, 10 aa, Homo sapiens
GYSFVTTAER

SEQ ID NO: 33778 - protein, 9 aa, Homo sapiens
HHTFYNELR

SEQ ID NO: 33779 - protein, 11 aa, Homo sapiens
HQGVMVGMGQK

SEQ ID NO: 33780 - protein, 16 aa, Homo sapiens
HQGVMVGMGQKDSYVG

SEQ ID NO: 33781 - protein, 21 aa, Homo sapiens
HQGVMVGMGQKDSYVGDEAQS

SEQ ID NO: 33782 - protein, 22 aa, Homo sapiens
HQGVMVGMGQKDSYVGDEAQSK

SEQ ID NO: 33783 - protein, 23 aa, Homo sapiens
HQGVMVGMGQKDSYVGDEAQSKR

SEQ ID NO: 33784 - protein, 29 aa, Homo sapiens
HQGVMVGMGQKDSYVGDEAQSKRGILTLK

SEQ ID NO: 33785 - protein, 8 aa, Homo sapiens
IIAPPERK

SEQ ID NO: 33786 - protein, 11 aa, Homo sapiens
IWHHTFYNELR

SEQ ID NO: 33787 - protein, 14 aa, Homo sapiens
MQKEITALAPSTMK

SEQ ID NO: 33788 - protein, 16 aa, Homo sapiens
MQKEITALAPSTMKIK

SEQ ID NO: 33789 - protein, 19 aa, Homo sapiens
MVGMGQKDSYVGDEAQSKR

SEQ ID NO: 33790 - protein, 16 aa, Homo sapiens
SYELPDGQVITIGNER

SEQ ID NO: 33791 - protein, 18 aa, Homo sapiens
VAPEEHPTLLTEAPLNPK

SEQ ID NO: 33792 - protein, 10 aa, Homo sapiens
WHHTFYNELR

SEQ ID NO: 33793 - protein, 16 aa, Homo sapiens
YPIEHGIITNWDDMEK

SEQ ID NO: 33794 - protein, 10 aa, Homo sapiens
MDDVYKEPLK

SEQ ID NO: 33795 - protein, 16 aa, Homo sapiens
NKDLLPEDFVVYTYNK

SEQ ID NO: 33796 - protein, 14 aa, Homo sapiens
ASFGSGPAVEWIPK

SEQ ID NO: 33797 - protein, 13 aa, Homo sapiens
DAEHYDTAILFTR

SEQ ID NO: 33798 - protein, 11 aa, Homo sapiens
GIGYFFVLQPK

SEQ ID NO: 33799 - protein, 13 aa, Homo sapiens
GPEVTSNAALTLR

SEQ ID NO: 33800 - protein, 12 aa, Homo sapiens
HFIDFCTMAECS

SEQ ID NO: 33801 - protein, 12 aa, Homo sapiens
HYLLTLFSVAAR

SEQ ID NO: 33802 - protein, 9 aa, Homo sapiens
ILVIHDEQK

SEQ ID NO: 33803 - protein, 22 aa, Homo sapiens
ILVIHDEQKGPEVTSNAALTLR

SEQ ID NO: 33804 - protein, 8 aa, Homo sapiens
LYKHPSIR

SEQ ID NO: 33805 - protein, 9 aa, Homo sapiens
NNGSFLAIK

SEQ ID NO: 33806 - protein, 9 aa, Homo sapiens
NSVSLVVVK

SEQ ID NO: 33807 - protein, 11 aa, Homo sapiens
QCQFTFGEDSK

SEQ ID NO: 33808 - protein, 21 aa, Homo sapiens
QHNPPSDRDAEHYDTAILFTR

SEQ ID NO: 33809 - protein, 21 aa, Homo sapiens
YVETMLVADQSMAEFHGSGLK

SEQ ID NO: 33810 - protein, 11 aa, Homo sapiens
AEDKFNETTEK

SEQ ID NO: 33811 - protein, 11 aa, Homo sapiens
AESPEVCFNEE

SEQ ID NO: 33812 - protein, 14 aa, Homo sapiens
AESPEVCFNEESPK

SEQ ID NO: 33813 - protein, 7 aa, Homo sapiens
AFSSYQK

SEQ ID NO: 33814 - protein, 9 aa, Homo sapiens
AIPVTQYLK

SEQ ID NO: 33815 - protein, 15 aa, Homo sapiens
APQLSTEELVSLGEK

SEQ ID NO: 33816 - protein, 16 aa, Homo sapiens
APTLLTVAVHFEEVAK

SEQ ID NO: 33817 - protein, 14 aa, Homo sapiens
AQYVQEATFEEMEK

SEQ ID NO: 33818 - protein, 12 aa, Homo sapiens
CCNTENPPGCYR

SEQ ID NO: 33819 - protein, 8 aa, Homo sapiens
CQAYESNR

SEQ ID NO: 33820 - protein, 10 aa, Homo sapiens
DADPDTFFAK

SEQ ID NO: 33821 - protein, 10 aa, Homo sapiens
DGLKYHYLIR

SEQ ID NO: 33822 - protein, 10 aa, Homo sapiens
DIENFNSTQK

SEQ ID NO: 33823 - protein, 17 aa, Homo sapiens
DLLRNCCNTENPPGCYR

SEQ ID NO: 33824 - protein, 8 aa, Homo sapiens
DLSLREGK

SEQ ID NO: 33825 - protein, 19 aa, Homo sapiens
DLSLREGKFTDSENVCQER

SEQ ID NO: 33826 - protein, 6 aa, Homo sapiens
DMVEYK

SEQ ID NO: 33827 - protein, 8 aa, Homo sapiens
DMVEYKDR

SEQ ID NO: 33828 - protein, 10 aa, Homo sapiens
EDKFNETTEK

SEQ ID NO: 33829 - protein, 24 aa, Homo sapiens
EGKFTDSENVCQERDADPDTFFAK

SEQ ID NO: 33830 - protein, 26 aa, Homo sapiens
ELISLVEDVSSNYDGCCEGDVVQCIR

SEQ ID NO: 33831 - protein, 20 aa, Homo sapiens
ELTDEELQSLFTNFANVVDK

SEQ ID NO: 33832 - protein, 13 aa, Homo sapiens
ESLLNHFLYEVAR

SEQ ID NO: 33833 - protein, 20 aa, Homo sapiens
FGTKVVHFIYIAILSQKFPK

SEQ ID NO: 33834 - protein, 14 aa, Homo sapiens
FIEDNIEYITIIAF

SEQ ID NO: 33835 - protein, 28 aa, Homo sapiens
FIEDNIEYITIIAFAQYVQEATFEEMEK

SEQ ID NO: 33836 - protein, 7 aa, Homo sapiens
FLVNLVK

SEQ ID NO: 33837 - protein, 11 aa, Homo sapiens
FTDSENVCQER

SEQ ID NO: 33838 - protein, 21 aa, Homo sapiens
FTDSENVCQERDADPDTFFAK

SEQ ID NO: 33839 - protein, 7 aa, Homo sapiens
FTFEYSR

SEQ ID NO: 33840 - protein, 10 aa, Homo sapiens
FTNFANVVDK

SEQ ID NO: 33841 - protein, 33 aa, Homo sapiens
FTTCCTLSEEFACVDNLADLVFGELCGVNENRT

SEQ ID NO: 33842 - protein, 14 aa, Homo sapiens
GLPQKHNFSHCCSK

SEQ ID NO: 33843 - protein, 9 aa, Homo sapiens
GQCIINSNK

SEQ ID NO: 33844 - protein, 14 aa, Homo sapiens
GQCIINSNKDDRPK

SEQ ID NO: 33845 - protein, 14 aa, Homo sapiens
HELTDEELQSLFTN

SEQ ID NO: 33846 - protein, 15 aa, Homo sapiens
HELTDEELQSLFTNF

SEQ ID NO: 33847 - protein, 17 aa, Homo sapiens
HELTDEELQSLFTNFAN

SEQ ID NO: 33848 - protein, 21 aa, Homo sapiens
HELTDEELQSLFTNFANVVDK

SEQ ID NO: 33849 - protein, 8 aa, Homo sapiens
HFLYEVAR

SEQ ID NO: 33850 - protein, 7 aa, Homo sapiens
HFQNLGK

SEQ ID NO: 33851 - protein, 11 aa, Homo sapiens
HFQNLGKDGLK

SEQ ID NO: 33852 - protein, 11 aa, Homo sapiens
HPDLSIPELLR

SEQ ID NO: 33853 - protein, 8 aa, Homo sapiens
HVCGALLK

SEQ ID NO: 33854 - protein, 16 aa, Homo sapiens
IAPQLSTEELVSLGEK

SEQ ID NO: 33855 - protein, 10 aa, Homo sapiens
ICAMEGLPQK

SEQ ID NO: 33856 - protein, 19 aa, Homo sapiens
ICAMEGLPQKHNFSHCCSK

SEQ ID NO: 33857 - protein, 10 aa, Homo sapiens
IVQIYKDLLR

SEQ ID NO: 33858 - protein, 23 aa, Homo sapiens
IVQIYKDLLRNCCNTENPPGCYR

SEQ ID NO: 33859 - protein, 9 aa, Homo sapiens
IYIAILSQK

SEQ ID NO: 33860 - protein, 9 aa, Homo sapiens
KFNETTEKS

SEQ ID NO: 33861 - protein, 11 aa, Homo sapiens
KHNFSHCCSKV

SEQ ID NO: 33862 - protein, 18 aa, Homo sapiens
KSDVGFLPPFPTLDPEEK

SEQ ID NO: 33863 - protein, 11 aa, Homo sapiens
KTDRFLVNLVK

SEQ ID NO: 33864 - protein, 7 aa, Homo sapiens
LCFFYNK

SEQ ID NO: 33865 - protein, 14 aa, Homo sapiens
LKHELTDEELQSLF

SEQ ID NO: 33866 - protein, 19 aa, Homo sapiens
LKHELTDEELQSLFTNFAN

SEQ ID NO: 33867 - protein, 23 aa, Homo sapiens
LKHELTDEELQSLFTNFANVVDK

SEQ ID NO: 33868 - protein, 11 aa, Homo sapiens
LLNHFLYEVAR

SEQ ID NO: 33869 - protein, 13 aa, Homo sapiens
LLTVAVHFEEVAK

SEQ ID NO: 33870 - protein, 9 aa, Homo sapiens
LPNNVLQEK

SEQ ID NO: 33871 - protein, 12 aa, Homo sapiens
LSTEELVSLGEK

SEQ ID NO: 33872 - protein, 11 aa, Homo sapiens
LVKDMVEYKDR

SEQ ID NO: 33873 - protein, 7 aa, Homo sapiens
MVQQECK

SEQ ID NO: 33874 - protein, 18 aa, Homo sapiens
MVQQECKHFQNLGKDGLK

SEQ ID NO: 33875 - protein, 13 aa, Homo sapiens
NCCNTENPPGCYR

SEQ ID NO: 33876 - protein, 10 aa, Homo sapiens
NPFVFAPTLL

SEQ ID NO: 33877 - protein, 21 aa, Homo sapiens
NPFVFAPTLLTVAVHFEEVAK

SEQ ID NO: 33878 - protein, 7 aa, Homo sapiens
PDTFFAK

SEQ ID NO: 33879 - protein, 8 aa, Homo sapiens
PNNVLQEK

SEQ ID NO: 33880 - protein, 11 aa, Homo sapiens
PPFPTLDPEEK

SEQ ID NO: 33881 - protein, 25 aa, Homo sapiens
PPPFSQDLFTFHADMCQSQNEELQR

SEQ ID NO: 33882 - protein, 12 aa, Homo sapiens
PQKHNFSHCCSK

SEQ ID NO: 33883 - protein, 14 aa, Homo sapiens
PQLSTEELVSLGEK

SEQ ID NO: 33884 - protein, 7 aa, Homo sapiens
QDSISSK

SEQ ID NO: 33885 - protein, 12 aa, Homo sapiens
RDIENFNSTQKF

SEQ ID NO: 33886 - protein, 12 aa, Homo sapiens
RHPDLSIPELLR

SEQ ID NO: 33887 - protein, 8 aa, Homo sapiens
RLCFFYNK

SEQ ID NO: 33888 - protein, 9 aa, Homo sapiens
RLCFFYNKK

SEQ ID NO: 33889 - protein, 22 aa, Homo sapiens
RNPFVFAPTLLTVAVHFEEVAK

SEQ ID NO: 33890 - protein, 8 aa, Homo sapiens
RPCFESLK

SEQ ID NO: 33891 - protein, 11 aa, Homo sapiens
RPCFESLKADK

SEQ ID NO: 33892 - protein, 14 aa, Homo sapiens
RYAEDKFNETTEKS

SEQ ID NO: 33893 - protein, 15 aa, Homo sapiens
SCCEEQNKVNCLQTR

SEQ ID NO: 33894 - protein, 17 aa, Homo sapiens
SDVGFLPPFPTLDPEEK

SEQ ID NO: 33895 - protein, 12 aa, Homo sapiens
SLLNHFLYEVAR

SEQ ID NO: 33896 - protein, 11 aa, Homo sapiens
STEELVSLGEK

SEQ ID NO: 33897 - protein, 10 aa, Homo sapiens
TDRFLVNLVK

SEQ ID NO: 33898 - protein, 11 aa, Homo sapiens
TINPAVDHCCK

SEQ ID NO: 33899 - protein, 16 aa, Homo sapiens
TLPECSKLPNNVLQEK

SEQ ID NO: 33900 - protein, 6 aa, Homo sapiens
TNFAFR

SEQ ID NO: 33901 - protein, 9 aa, Homo sapiens
TNFANVVDK

SEQ ID NO: 33902 - protein, 11 aa, Homo sapiens
TVAVHFEEVAK

SEQ ID NO: 33903 - protein, 12 aa, Homo sapiens
TYVPPPFSQDLF

SEQ ID NO: 33904 - protein, 14 aa, Homo sapiens
TYVPPPFSQDLFTF

SEQ ID NO: 33905 - protein, 15 aa, Homo sapiens
TYVPPPFSQDLFTFH

SEQ ID NO: 33906 - protein, 28 aa, Homo sapiens
TYVPPPFSQDLFTFHADMCQSQNEELQR

SEQ ID NO: 33907 - protein, 18 aa, Homo sapiens
VFAPTLLTVAVHFEEVAK

SEQ ID NO: 33908 - protein, 13 aa, Homo sapiens
VFGELCGVNENRT

SEQ ID NO: 33909 - protein, 8 aa, Homo sapiens
VMNHICSK

SEQ ID NO: 33910 - protein, 15 aa, Homo sapiens
VMNHICSKQDSISSK

SEQ ID NO: 33911 - protein, 7 aa, Homo sapiens
VNCLQTR

SEQ ID NO: 33912 - protein, 13 aa, Homo sapiens
VVHFIYIAILSQK

SEQ ID NO: 33913 - protein, 16 aa, Homo sapiens
VVHFIYIAILSQKFPK

SEQ ID NO: 33914 - protein, 12 aa, Homo sapiens
YAEDKFNETTEK

SEQ ID NO: 33915 - protein, 6 aa, Homo sapiens
YHYLIR

SEQ ID NO: 33916 - protein, 12 aa, Homo sapiens
YVQEATFEEMEK

SEQ ID NO: 33917 - protein, 17 aa, Homo sapiens
KANATGGGGHVQMVQRA

SEQ ID NO: 33918 - protein, 8 aa, Homo sapiens
LANEQIQK

SEQ ID NO: 33919 - protein, 26 aa, Homo sapiens
MAPAMVNSSAASVGLADMMSPGESKL

SEQ ID NO: 33920 - protein, 34 aa, Homo sapiens
PFPGNMSSMTPSSPGMSQQGGPGMGPPMPTVNRK

SEQ ID NO: 33921 - protein, 12 aa, Homo sapiens
LFAECHVINPSK

SEQ ID NO: 33922 - protein, 16 aa, Homo sapiens
MQQHNMSWIEVQFLKK

SEQ ID NO: 33923 - protein, 12 aa, Homo sapiens
VLLQHVHEGYEK

SEQ ID NO: 33924 - protein, 14 aa, Homo sapiens
YQHLITNSFVECNR

SEQ ID NO: 33925 - protein, 20 aa, Homo sapiens
PPNNVSVPLLMPLVTLMERQ

SEQ ID NO: 33926 - protein, 27 aa, Homo sapiens
ILCGPVWLASGLDLSGHAGMLTLTSPK

SEQ ID NO: 33927 - protein, 13 aa, Homo sapiens
KFVLNSNITNIPQ

SEQ ID NO: 33928 - protein, 23 aa, Homo sapiens
LLAGQPLPAEMTLAQLLTLLYDR

SEQ ID NO: 33929 - protein, 19 aa, Homo sapiens
LPCPEGLDPDTDDAPEVCR

SEQ ID NO: 33930 - protein, 16 aa, Homo sapiens
VCLSILNTWHGRPEEK

SEQ ID NO: 33931 - protein, 13 aa, Homo sapiens
EVNEVSQNFQTTK

SEQ ID NO: 33932 - protein, 10 aa, Homo sapiens
FSALLSDCVR

SEQ ID NO: 33933 - protein, 11 aa, Homo sapiens
NDYAVESYENK

SEQ ID NO: 33934 - protein, 10 aa, Homo sapiens
SDMDQIVNSK

SEQ ID NO: 33935 - protein, 14 aa, Homo sapiens
VLTSEDEYNLLSDR

SEQ ID NO: 33936 - protein, 19 aa, Homo sapiens
ALPEICTQCPGSVQNLSKV

SEQ ID NO: 33937 - protein, 16 aa, Homo sapiens
EFDPTITDASLSLPSR

SEQ ID NO: 33938 - protein, 12 aa, Homo sapiens
PSDLRPGDVSSK

SEQ ID NO: 33939 - protein, 20 aa, Homo sapiens
SAKPTKPAASDLPVPAEGVR

SEQ ID NO: 33940 - protein, 11 aa, Homo sapiens
EQGNIYKPNNK

SEQ ID NO: 33941 - protein, 21 aa, Homo sapiens
IDFEDVIAEPEGTHSFDGIWK

SEQ ID NO: 33942 - protein, 19 aa, Homo sapiens
VYSIYVHTVCDPLFEAVGK

SEQ ID NO: 33943 - protein, 14 aa, Homo sapiens
YVDSEGHLYTVPIR

SEQ ID NO: 33944 - protein, 12 aa, Homo sapiens
LQERAEEEEREK

SEQ ID NO: 33945 - protein, 14 aa, Homo sapiens
VEENPDADSDFDAK

SEQ ID NO: 33946 - protein, 20 aa, Homo sapiens
AFKEAEFGQGTGPIWLNEVK

SEQ ID NO: 33947 - protein, 10 aa, Homo sapiens
FGKGNGQIWR

SEQ ID NO: 33948 - protein, 16 aa, Homo sapiens
GPDTLWQCPSSPWEKR

SEQ ID NO: 33949 - protein, 15 aa, Homo sapiens
HNCDHAEDAGVICSK

SEQ ID NO: 33950 - protein, 15 aa, Homo sapiens
KAPGWANSSAGSGRI

SEQ ID NO: 33951 - protein, 16 aa, Homo sapiens
KEDAAVNCTDISVQKT

SEQ ID NO: 33952 - protein, 35 aa, Homo sapiens
RHFVNLSPFTITVVLLLSACFVTSSLGGTDKELRL

SEQ ID NO: 33953 - protein, 18 aa, Homo sapiens
RLASPSEETWITCDNKIR

SEQ ID NO: 33954 - protein, 31 aa, Homo sapiens
GANQHATDEEGKDPLSIAVEAANADIVTLLR

SEQ ID NO: 33955 - protein, 13 aa, Homo sapiens
LSISKFGPGDQVR

SEQ ID NO: 33956 - protein, 19 aa, Homo sapiens
VQCIPGNASCCDCGLADPR

SEQ ID NO: 33957 - protein, 20 aa, Homo sapiens
KTGGDNKTLLHLGSSAPGKE

SEQ ID NO: 33958 - protein, 8 aa, Homo sapiens
AALTTLFK

SEQ ID NO: 33959 - protein, 15 aa, Homo sapiens
DVDYVCISDNYWLGK

SEQ ID NO: 33960 - protein, 12 aa, Homo sapiens
DVGAQILLHSHK

SEQ ID NO: 33961 - protein, 17 aa, Homo sapiens
EGGSIPVTLTFQEATGK

SEQ ID NO: 33962 - protein, 21 aa, Homo sapiens
GNILIPGINEAVAAVTEEEHK

SEQ ID NO: 33963 - protein, 21 aa, Homo sapiens
GSTDDKGPVAGWINALEAYQK

SEQ ID NO: 33964 - protein, 16 aa, Homo sapiens
LPDGSEIPLPPILLGR

SEQ ID NO: 33965 - protein, 20 aa, Homo sapiens
LVPNMTPEVVGEQVTSYLTK

SEQ ID NO: 33966 - protein, 10 aa, Homo sapiens
MMEVAAADVK

SEQ ID NO: 33967 - protein, 20 aa, Homo sapiens
NVMLLPVGSADDGAHSQNEK

SEQ ID NO: 33968 - protein, 15 aa, Homo sapiens
PWVSDFSHPHYLAGR

SEQ ID NO: 33969 - protein, 18 aa, Homo sapiens
QKLPDGSEIPLPPILLGR

SEQ ID NO: 33970 - protein, 13 aa, Homo sapiens
QLGGSVELVDIGK

SEQ ID NO: 33971 - protein, 10 aa, Homo sapiens
TGQEIPVNVR

SEQ ID NO: 33972 - protein, 29 aa, Homo sapiens
TVCIYGHLDVQPAALEDGWDSEPFTLVER

SEQ ID NO: 33973 - protein, 11 aa, Homo sapiens
TVFGVEPDLTR

SEQ ID NO: 33974 - protein, 23 aa, Homo sapiens
VYMGHGGKPWVSDFSHPHYLAGR

SEQ ID NO: 33975 - protein, 13 aa, Homo sapiens
WVAIQSVSAWPEK

SEQ ID NO: 33976 - protein, 14 aa, Homo sapiens
WVAIQSVSAWPEKR

SEQ ID NO: 33977 - protein, 8 aa, Homo sapiens
YIDENQDR

SEQ ID NO: 33978 - protein, 8 aa, Homo sapiens
YNYIEGTK

SEQ ID NO: 33979 - protein, 19 aa, Homo sapiens
YPSLSLHGIEGAFSGSGAK

SEQ ID NO: 33980 - protein, 19 aa, Homo sapiens
AAESLADPTEYENLFPGLK

SEQ ID NO: 33981 - protein, 12 aa, Homo sapiens
DNNQFASASLDR

SEQ ID NO: 33982 - protein, 17 aa, Homo sapiens
GSNNVALGYDEGSIIVK

SEQ ID NO: 33983 - protein, 23 aa, Homo sapiens
GVNCIDYYSGGDKPYLISGADDR

SEQ ID NO: 33984 - protein, 11 aa, Homo sapiens
LESTLNYGMER

SEQ ID NO: 33985 - protein, 20 aa, Homo sapiens
SFGSAQEFAWAHDSSEYAIR

SEQ ID NO: 33986 - protein, 29 aa, Homo sapiens
STAQQELDGKPASPTPVIVASHTANKEEK

SEQ ID NO: 33987 - protein, 32 aa, Homo sapiens
SVDLHPTEPWMLASLYNGSVCVWNHETQTLVK

SEQ ID NO: 33988 - protein, 35 aa, Homo sapiens
TCVQTLEGHAQNVSCASFHPELPIIITGSEDGTVR

SEQ ID NO: 33989 - protein, 9 aa, Homo sapiens
VFNYNTLER

SEQ ID NO: 33990 - protein, 18 aa, Homo sapiens
VWQLGSSSPNFTLEGHEK

SEQ ID NO: 33991 - protein, 11 aa, Homo sapiens
GIDSDASYPYK

SEQ ID NO: 33992 - protein, 10 aa, Homo sapiens
GPVSVGVDAR

SEQ ID NO: 33993 - protein, 14 aa, Homo sapiens
NSWGHNFGEEGYIR

SEQ ID NO: 33994 - protein, 8 aa, Homo sapiens
YTELPYGR

SEQ ID NO: 33995 - protein, 24 aa, Homo sapiens
ASYSGVSLFSNPVQYWEIQPSTFR

SEQ ID NO: 33996 - protein, 25 aa, Homo sapiens
KASYSGVSLFSNPVQYWEIQPSTFR

SEQ ID NO: 33997 - protein, 25 aa, Homo sapiens
KLGLSFNSISAVDNGSLANTPHLRE

SEQ ID NO: 33998 - protein, 28 aa, Homo sapiens
RIADTNITSIPQGLPPSLTELHLDGNKI

SEQ ID NO: 33999 - protein, 14 aa, Homo sapiens
VDAASLKGLNNLAK

SEQ ID NO: 34000 - protein, 14 aa, Homo sapiens
VSPGAFTPLVKLER

SEQ ID NO: 34001 - protein, 24 aa, Homo sapiens
YLHNNNISVVGSSDFCPPGHNTKK

SEQ ID NO: 34002 - protein, 16 aa, Homo sapiens
AEPHFLSILQHLLLVR

SEQ ID NO: 34003 - protein, 15 aa, Homo sapiens
AGCAVTSLLASELTK

SEQ ID NO: 34004 - protein, 14 aa, Homo sapiens
DVQNFPAATDEKDK

SEQ ID NO: 34005 - protein, 30 aa, Homo sapiens
EQLIDMNAEGDETGVMDSLLEALQSGAAFR

SEQ ID NO: 34006 - protein, 18 aa, Homo sapiens
FVEKMTSFVKDAQEQYNK

SEQ ID NO: 34007 - protein, 11 aa, Homo sapiens
LGLHQVLQDLR

SEQ ID NO: 34008 - protein, 13 aa, Homo sapiens
LIEECISQIVLHK

SEQ ID NO: 34009 - protein, 19 aa, Homo sapiens
LLSALCILPQPEDMNERVL

SEQ ID NO: 34010 - protein, 26 aa, Homo sapiens
LQFSEQVENIKPEIVSVTAACEELRK

SEQ ID NO: 34011 - protein, 14 aa, Homo sapiens
LSVEEFFMDLHNFR

SEQ ID NO: 34012 - protein, 18 aa, Homo sapiens
MEMDDFNEVFQILLNTVK

SEQ ID NO: 34013 - protein, 20 aa, Homo sapiens
MTLLHFLAELCENDYPDVLK

SEQ ID NO: 34014 - protein, 20 aa, Homo sapiens
VGCLQLINALITPAEELDFR

SEQ ID NO: 34015 - protein, 27 aa, Homo sapiens
VSLNNNPVSWVQTFGAEGLASLLDILK

SEQ ID NO: 34016 - protein, 25 aa, Homo sapiens
KSIDSKSFISISNSSSAENDNYCKH

SEQ ID NO: 34017 - protein, 35 aa, Homo sapiens
DPATYNIATLKPLGEVFALVCDSENPQLFTIEFIK

SEQ ID NO: 34018 - protein, 36 aa, Homo sapiens
VFSVGTHAITTYNPNTLEVTNQWPYGDICSISPVGK

SEQ ID NO: 34019 - protein, 24 aa, Homo sapiens
KKIQTQISSGMTNNASLLQNYLKT

SEQ ID NO: 34020 - protein, 28 aa, Homo sapiens
KTSIAQSVLQSLPSSQWSVLVVNMSAQT

SEQ ID NO: 34021 - protein, 22 aa, Homo sapiens
LLLLLVLANLTDASDAPNPYRQ

SEQ ID NO: 34022 - protein, 22 aa, Homo sapiens
RDKYLHTNCLAALANMSAQFRS

SEQ ID NO: 34023 - protein, 20 aa, Homo sapiens
TKVAVDENKAKEFLGSLKRQ

SEQ ID NO: 34024 - protein, 16 aa, Homo sapiens
VAVDENKAKEFLGSLK

SEQ ID NO: 34025 - protein, 18 aa, Homo sapiens
VAVDENKAKEFLGSLKRQ

SEQ ID NO: 34026 - protein, 17 aa, Homo sapiens
FAQLALERVLQDWNALK

SEQ ID NO: 34027 - protein, 19 aa, Homo sapiens
SHNDEHSDVLPVLDVCSLK

SEQ ID NO: 34028 - protein, 14 aa, Homo sapiens
IQDHQVVINCAIPK

SEQ ID NO: 34029 - protein, 15 aa, Homo sapiens
KIQDHQVVINCAIPK

SEQ ID NO: 34030 - protein, 14 aa, Homo sapiens
DYFGLTFCDADSQK

SEQ ID NO: 34031 - protein, 23 aa, Homo sapiens
EFIATTPSITTETISTTMENSLK

SEQ ID NO: 34032 - protein, 17 aa, Homo sapiens
GQVLFDLVCEHLNLLEK

SEQ ID NO: 34033 - protein, 10 aa, Homo sapiens
HQASINELKR

SEQ ID NO: 34034 - protein, 16 aa, Homo sapiens
IRPGEYEQFESTIGFK

SEQ ID NO: 34035 - protein, 10 aa, Homo sapiens
VCEHLNLLEK

SEQ ID NO: 34036 - protein, 10 aa, Homo sapiens
VCIEHHTFFR

SEQ ID NO: 34037 - protein, 15 aa, Homo sapiens
VTLLDASEYECEVEK

SEQ ID NO: 34038 - protein, 10 aa, Homo sapiens
YSGRTQAQTR

SEQ ID NO: 34039 - protein, 15 aa, Homo sapiens
KDNFTAAGYNSLESV

SEQ ID NO: 34040 - protein, 12 aa, Homo sapiens
LVMPNYPFINIR

SEQ ID NO: 34041 - protein, 15 aa, Homo sapiens
YYYNKRILHKTKGKR

SEQ ID NO: 34042 - protein, 9 aa, Homo sapiens
HMLSHTEER

SEQ ID NO: 34043 - protein, 20 aa, Homo sapiens
PPVTPATSQDQPLDLSMGSR

SEQ ID NO: 34044 - protein, 13 aa, Homo sapiens
CQYYTASFSDYAK

SEQ ID NO: 34045 - protein, 15 aa, Homo sapiens
DDNLEHYKNSTVMAR

SEQ ID NO: 34046 - protein, 10 aa, Homo sapiens
FIEMGFIDEK

SEQ ID NO: 34047 - protein, 17 aa, Homo sapiens
KDDNLEHYKNSTVMARA

SEQ ID NO: 34048 - protein, 29 aa, Homo sapiens
KFLAYAEFNDTDIPVIAYSYYGDEQYPRT

SEQ ID NO: 34049 - protein, 15 aa, Homo sapiens
KSVNASNYGLSPDRQ

SEQ ID NO: 34050 - protein, 14 aa, Homo sapiens
LGVYEVEDQITAVR

SEQ ID NO: 34051 - protein, 25 aa, Homo sapiens
NVDYLLIHGTADDNVHFQNSAQIAK

SEQ ID NO: 34052 - protein, 13 aa, Homo sapiens
PIQYLCWSPVGSK

SEQ ID NO: 34053 - protein, 19 aa, Homo sapiens
TDQEIKILEENKELENALK

SEQ ID NO: 34054 - protein, 26 aa, Homo sapiens
AASPSELTCPPGWEWEDDAWSYDINR

SEQ ID NO: 34055 - protein, 14 aa, Homo sapiens
DHYIPNTLNPVFGR

SEQ ID NO: 34056 - protein, 11 aa, Homo sapiens
DLTQTASSTAR

SEQ ID NO: 34057 - protein, 14 aa, Homo sapiens
DQLRPTQLLQNVAR

SEQ ID NO: 34058 - protein, 15 aa, Homo sapiens
DSFSDPYAHICFLHR

SEQ ID NO: 34059 - protein, 13 aa, Homo sapiens
ELPDSVPQECTVR

SEQ ID NO: 34060 - protein, 16 aa, Homo sapiens
EYTGFPDPYDELNTGK

SEQ ID NO: 34061 - protein, 16 aa, Homo sapiens
FDTTCKPLASTTQYSR

SEQ ID NO: 34062 - protein, 16 aa, Homo sapiens
FGKPDPIVSVIFKDEK

SEQ ID NO: 34063 - protein, 20 aa, Homo sapiens
FGSHCGIPEEYCVSGVNTWR

SEQ ID NO: 34064 - protein, 18 aa, Homo sapiens
FVFPFDYLPAEQLCIVAK

SEQ ID NO: 34065 - protein, 18 aa, Homo sapiens
GLELQPQDNNGLCDPYIK

SEQ ID NO: 34066 - protein, 13 aa, Homo sapiens
GPVGTVSEAQLAR

SEQ ID NO: 34067 - protein, 15 aa, Homo sapiens
GWEYGITIPPDHKPK

SEQ ID NO: 34068 - protein, 20 aa, Homo sapiens
HSATTVFGANTPIVSCNFDR

SEQ ID NO: 34069 - protein, 7 aa, Homo sapiens
HTIIPAK

SEQ ID NO: 34070 - protein, 12 aa, Homo sapiens
ILHQHLGAPEER

SEQ ID NO: 34071 - protein, 18 aa, Homo sapiens
IPAHQVLYSTSGENASGK

SEQ ID NO: 34072 - protein, 12 aa, Homo sapiens
IPANQLAELWLK

SEQ ID NO: 34073 - protein, 23 aa, Homo sapiens
IYNCELENVAEFEGLTDFSDTFK

SEQ ID NO: 34074 - protein, 13 aa, Homo sapiens
KEHFWSIDQTEFR

SEQ ID NO: 34075 - protein, 11 aa, Homo sapiens
KPVVGQCTIER

SEQ ID NO: 34076 - protein, 19 aa, Homo sapiens
KVDNELNPVWNEILEFDLR

SEQ ID NO: 34077 - protein, 19 aa, Homo sapiens
LDLPNRPETSFLWFTNPCK

SEQ ID NO: 34078 - protein, 10 aa, Homo sapiens
LIDEVIEDTR

SEQ ID NO: 34079 - protein, 8 aa, Homo sapiens
LISLLNEK

SEQ ID NO: 34080 - protein, 15 aa, Homo sapiens
RRDRDNDSDDVESNL

SEQ ID NO: 34081 - protein, 11 aa, Homo sapiens
SLSQIHEAAVR

SEQ ID NO: 34082 - protein, 17 aa, Homo sapiens
TKPVVTLTSYWEDISHR

SEQ ID NO: 34083 - protein, 12 aa, Homo sapiens
TQGLVPEHVETR

SEQ ID NO: 34084 - protein, 11 aa, Homo sapiens
VGETIIDLENR

SEQ ID NO: 34085 - protein, 9 aa, Homo sapiens
VHVCGQTHR

SEQ ID NO: 34086 - protein, 12 aa, Homo sapiens
AIVAGDQNVEYK

SEQ ID NO: 34087 - protein, 7 aa, Homo sapiens
FDCHYCR

SEQ ID NO: 34088 - protein, 15 aa, Homo sapiens
FVFHQEQVYCPDCAK

SEQ ID NO: 34089 - protein, 30 aa, Homo sapiens
AEISCIDNKDGTCTVTYLPTLPGDYSILVK

SEQ ID NO: 34090 - protein, 30 aa, Homo sapiens
AEITFDDHKNGSCGVSYIAQEPGNYEVSIK

SEQ ID NO: 34091 - protein, 15 aa, Homo sapiens
AGPGTLSVTIEGPSK

SEQ ID NO: 34092 - protein, 23 aa, Homo sapiens
AGSNMLLIGVHGPTTPCEEVSMK

SEQ ID NO: 34093 - protein, 14 aa, Homo sapiens
AGVENGKPTHFTVY

SEQ ID NO: 34094 - protein, 16 aa, Homo sapiens
AGVENGKPTHFTVYTK

SEQ ID NO: 34095 - protein, 13 aa, Homo sapiens
AHGPGLEGGLVGK

SEQ ID NO: 34096 - protein, 22 aa, Homo sapiens
AHGPGLEGGLVGKPAEFTIDTK

SEQ ID NO: 34097 - protein, 32 aa, Homo sapiens
AHIANPSGASTECFVTDNADGTYQVEYTPFEK

SEQ ID NO: 34098 - protein, 19 aa, Homo sapiens
AIVHDNKDGTYAVTYIPDK

SEQ ID NO: 34099 - protein, 30 aa, Homo sapiens
ALGALVDSCAPGLCPDWESWDPQKPVDNAR

SEQ ID NO: 34100 - protein, 24 aa, Homo sapiens
ANEPTHFTVDCTEAGEGDVSVGIK

SEQ ID NO: 34101 - protein, 17 aa, Homo sapiens
APLNVQFNSPLPGDAVK

SEQ ID NO: 34102 - protein, 16 aa, Homo sapiens
APSVATVGSICDLNLK

SEQ ID NO: 34103 - protein, 13 aa, Homo sapiens
AWGPGLHGGIVGR

SEQ ID NO: 34104 - protein, 14 aa, Homo sapiens
CVYKPMQPGPHVVK

SEQ ID NO: 34105 - protein, 19 aa, Homo sapiens
DAGEGLLAVQITDQEGKPK

SEQ ID NO: 34106 - protein, 16 aa, Homo sapiens
DAGYGGISLAVEGPSK

SEQ ID NO: 34107 - protein, 18 aa, Homo sapiens
DFLDGVYAFEYYPSTPGR

SEQ ID NO: 34108 - protein, 33 aa, Homo sapiens
DGSCSAEYIPFAPGDYDVNITYGGAHIPGSPFR

SEQ ID NO: 34109 - protein, 21 aa, Homo sapiens
DGTCTVTYLPTLPGDYSILVK

SEQ ID NO: 34110 - protein, 12 aa, Homo sapiens
DGTYAVTYIPDK

SEQ ID NO: 34111 - protein, 21 aa, Homo sapiens
DGTYAVTYVPLTAGMYTLTMK

SEQ ID NO: 34112 - protein, 9 aa, Homo sapiens
DLAEDAPWK

SEQ ID NO: 34113 - protein, 15 aa, Homo sapiens
DLDIIDNYDYSHTVK

SEQ ID NO: 34114 - protein, 15 aa, Homo sapiens
EAFTNKPNVFTVVTR

SEQ ID NO: 34115 - protein, 22 aa, Homo sapiens
EATTDFTVDSRPLTQVGGDHIK

SEQ ID NO: 34116 - protein, 14 aa, Homo sapiens
FADEHVPGSPFTVK

SEQ ID NO: 34117 - protein, 14 aa, Homo sapiens
FIPHENGVHTIDVK

SEQ ID NO: 34118 - protein, 23 aa, Homo sapiens
FNDEHIPESPYLVPVIAPSDDAR

SEQ ID NO: 34119 - protein, 12 aa, Homo sapiens
FNGSHVVGSPFK

SEQ ID NO: 34120 - protein, 14 aa, Homo sapiens
FVPQEMGVHTVSVK

SEQ ID NO: 34121 - protein, 18 aa, Homo sapiens
GAGIGGLGITVEGPSESK

SEQ ID NO: 34122 - protein, 18 aa, Homo sapiens
GAGTGGLGLTVEGPCEAK

SEQ ID NO: 34123 - protein, 20 aa, Homo sapiens
GLHVVEVTYDDVPIPNSPFK

SEQ ID NO: 34124 - protein, 39 aa, Homo sapiens
GPGLEAVGNIANKPTYFDIYTAGAGVGDIGVEVEDPQGK

SEQ ID NO: 34125 - protein, 23 aa, Homo sapiens
GQHVTGSPFQFTVGPLGEGGAHK

SEQ ID NO: 34126 - protein, 18 aa, Homo sapiens
HTIAVVWGGVNIPHSPYR

SEQ ID NO: 34127 - protein, 14 aa, Homo sapiens
HVGNQQYNVTYVVK

SEQ ID NO: 34128 - protein, 30 aa, Homo sapiens
IANPSGASTECFVTDNADGTYQVEYTPFEK

SEQ ID NO: 34129 - protein, 19 aa, Homo sapiens
IECSDNGDGTCSVSYLPTK

SEQ ID NO: 34130 - protein, 26 aa, Homo sapiens
IECSDNGDGTCSVSYLPTKPGEYFVN

SEQ ID NO: 34131 - protein, 14 aa, Homo sapiens
IEYNDQNDGSCDVK

SEQ ID NO: 34132 - protein, 14 aa, Homo sapiens
IHPATGGYNPDLVR

SEQ ID NO: 34133 - protein, 19 aa, Homo sapiens
IPEINSSDMSAHVTSPSGR

SEQ ID NO: 34134 - protein, 17 aa, Homo sapiens
IPYLPITNFNQNWQDGK

SEQ ID NO: 34135 - protein, 14 aa, Homo sapiens
KGEITGEVHMPSGK

SEQ ID NO: 34136 - protein, 18 aa, Homo sapiens
KHVGNQQYNVTYVVKERG

SEQ ID NO: 34137 - protein, 13 aa, Homo sapiens
KVVPCLVTPVTGR

SEQ ID NO: 34138 - protein, 24 aa, Homo sapiens
LGSAADFLLDISETDLSSLTASIK

SEQ ID NO: 34139 - protein, 11 aa, Homo sapiens
LIALLEVLSQK

SEQ ID NO: 34140 - protein, 10 aa, Homo sapiens
LKPGAPLKPK

SEQ ID NO: 34141 - protein, 13 aa, Homo sapiens
LPNNHIGISFIPR

SEQ ID NO: 34142 - protein, 12 aa, Homo sapiens
LTVMSLQESGLK

SEQ ID NO: 34143 - protein, 7 aa, Homo sapiens
LVSIDSK

SEQ ID NO: 34144 - protein, 20 aa, Homo sapiens
LVSPGSANETSSILVESVTR

SEQ ID NO: 34145 - protein, 21 aa, Homo sapiens
LVSPGSANETSSILVESVTRS

SEQ ID NO: 34146 - protein, 13 aa, Homo sapiens
MDGTYACSYTPVK

SEQ ID NO: 34147 - protein, 23 aa, Homo sapiens
NGNHVANSPVSIMVVQSEIGDAR

SEQ ID NO: 34148 - protein, 21 aa, Homo sapiens
NGSCGVSYIAQEPGNYEVSIK

SEQ ID NO: 34149 - protein, 24 aa, Homo sapiens
PFAPGDYDVNITYGGAHIPGSPFR

SEQ ID NO: 34150 - protein, 20 aa, Homo sapiens
PGLCPDWESWDPQKPVDNAR

SEQ ID NO: 34151 - protein, 12 aa, Homo sapiens
PHENGVHTIDVK

SEQ ID NO: 34152 - protein, 11 aa, Homo sapiens
PLTQVGGDHIK

SEQ ID NO: 34153 - protein, 20 aa, Homo sapiens
QKDFLDGVYAFEYYPSTPGR

SEQ ID NO: 34154 - protein, 16 aa, Homo sapiens
QMQLENVSVALEFLDR

SEQ ID NO: 34155 - protein, 14 aa, Homo sapiens
RLPNNHIGISFIPR

SEQ ID NO: 34156 - protein, 27 aa, Homo sapiens
SADFVVESIGSEVGSLGFAIEGPSQAK

SEQ ID NO: 34157 - protein, 16 aa, Homo sapiens
SGCIVNNLAEFTVDPK

SEQ ID NO: 34158 - protein, 15 aa, Homo sapiens
SPFEVQVGPEAGMQK

SEQ ID NO: 34159 - protein, 15 aa, Homo sapiens
SPFTVGVAAPLDLSK

SEQ ID NO: 34160 - protein, 17 aa, Homo sapiens
SPFVVQVGEACNPNACR

SEQ ID NO: 34161 - protein, 9 aa, Homo sapiens
SSFLVDCSK

SEQ ID NO: 34162 - protein, 25 aa, Homo sapiens
TATFTIVTEDAGEGGLDLAIEGPSK

SEQ ID NO: 34163 - protein, 17 aa, Homo sapiens
TATPEIVDNKDGTVTVR

SEQ ID NO: 34164 - protein, 12 aa, Homo sapiens
TGEEVGFVVDAK

SEQ ID NO: 34165 - protein, 11 aa, Homo sapiens
VAVTEGCQPSR

SEQ ID NO: 34166 - protein, 14 aa, Homo sapiens
VDIQTEDLEDGTCK

SEQ ID NO: 34167 - protein, 14 aa, Homo sapiens
VEVGKDQEFTVDTR

SEQ ID NO: 34168 - protein, 30 aa, Homo sapiens
VGEAGLLSVNCSEAGPGALGLEAVSDSGTK

SEQ ID NO: 34169 - protein, 37 aa, Homo sapiens
VGEPGQAGNPALVSAYGTGLEGGTTGIQSEFFINTTR

SEQ ID NO: 34170 - protein, 20 aa, Homo sapiens
VHSPSGAVEECHVSELEPDK

SEQ ID NO: 34171 - protein, 24 aa, Homo sapiens
VHSPSGAVEECHVSELEPDKYAVR

SEQ ID NO: 34172 - protein, 11 aa, Homo sapiens
VKVEPAVDTSR

SEQ ID NO: 34173 - protein, 14 aa, Homo sapiens
VLFASQEIPASPFR

SEQ ID NO: 34174 - protein, 11 aa, Homo sapiens
VLQSFTVDSSK

SEQ ID NO: 34175 - protein, 21 aa, Homo sapiens
VLSEDEEDVDFDIIHNANDTF

SEQ ID NO: 34176 - protein, 24 aa, Homo sapiens
VLSEDEEDVDFDIIHNANDTFTVK

SEQ ID NO: 34177 - protein, 11 aa, Homo sapiens
VNIGQGSHPQK

SEQ ID NO: 34178 - protein, 11 aa, Homo sapiens
VPVKDVVDPSK

SEQ ID NO: 34179 - protein, 16 aa, Homo sapiens
VSYFPTVPGVYIVSTK

SEQ ID NO: 34180 - protein, 26 aa, Homo sapiens
VTASGPGLSSYGVPASLPVDFAIDAR

SEQ ID NO: 34181 - protein, 33 aa, Homo sapiens
VTCTVLTPDGTEAEADVIENEDGTYDIFYTAAK

SEQ ID NO: 34182 - protein, 12 aa, Homo sapiens
VTVLFAGQHISK

SEQ ID NO: 34183 - protein, 12 aa, Homo sapiens
VVASGPGLEHGK

SEQ ID NO: 34184 - protein, 12 aa, Homo sapiens
VVPCLVTPVTGR

SEQ ID NO: 34185 - protein, 14 aa, Homo sapiens
VVQVGEACNPNACR

SEQ ID NO: 34186 - protein, 7 aa, Homo sapiens
WCNEHLK

SEQ ID NO: 34187 - protein, 16 aa, Homo sapiens
WGEEHIPGSPFHVTVP

SEQ ID NO: 34188 - protein, 14 aa, Homo sapiens
YAPTEVGLHEMHIK

SEQ ID NO: 34189 - protein, 12 aa, Homo sapiens
YGGELVPHFPAR

SEQ ID NO: 34190 - protein, 13 aa, Homo sapiens
YGGPNHIVGSPFK

SEQ ID NO: 34191 - protein, 37 aa, Homo sapiens
YMGSHIPESPLQFYVNYPNSGSVSAYGPGLVYGVANK

SEQ ID NO: 34192 - protein, 18 aa, Homo sapiens
YMIGVTYGGDDIPLSPYR

SEQ ID NO: 34193 - protein, 14 aa, Homo sapiens
YSIAITWGGHHIPK

SEQ ID NO: 34194 - protein, 22 aa, Homo sapiens
YTPTQQGNMQVLVTYGGDPIPK

SEQ ID NO: 34195 - protein, 26 aa, Homo sapiens
AEISELPSIVQDLANGNITWADVEAR

SEQ ID NO: 34196 - protein, 20 aa, Homo sapiens
EFTMAEIEHFVDPSEKDHPK

SEQ ID NO: 34197 - protein, 15 aa, Homo sapiens
FQNVADLHLYLYSAK

SEQ ID NO: 34198 - protein, 13 aa, Homo sapiens
IMYTVFEHTFHVR

SEQ ID NO: 34199 - protein, 29 aa, Homo sapiens
KSEMESVLAQLDNYGQQELADLFVNYNVK

SEQ ID NO: 34200 - protein, 10 aa, Homo sapiens
SCYDLSCHAR

SEQ ID NO: 34201 - protein, 28 aa, Homo sapiens
SEMESVLAQLDNYGQQELADLFVNYNVK

SEQ ID NO: 34202 - protein, 26 aa, Homo sapiens
TFIGPGGNMPGYLRPETAQGIFLNFK

SEQ ID NO: 34203 - protein, 14 aa, Homo sapiens
TSYGWIEIVGCADR

SEQ ID NO: 34204 - protein, 13 aa, Homo sapiens
VPLVAEKPLKEPK

SEQ ID NO: 34205 - protein, 10 aa, Homo sapiens
CLQSCVKPLK

SEQ ID NO: 34206 - protein, 10 aa, Homo sapiens
FDYVMQFLNK

SEQ ID NO: 34207 - protein, 17 aa, Homo sapiens
FSPDLWGVSVCTVDGQR

SEQ ID NO: 34208 - protein, 21 aa, Homo sapiens
GIHFCHDLVSLCNFHNYDNLR

SEQ ID NO: 34209 - protein, 21 aa, Homo sapiens
GSTHPQPGVSPPAAPAAPGPK

SEQ ID NO: 34210 - protein, 26 aa, Homo sapiens
LFLNEDDKPHNPMVNAGAIVVTSLIK

SEQ ID NO: 34211 - protein, 18 aa, Homo sapiens
LTLQTTSDGVMLDKDLFK

SEQ ID NO: 34212 - protein, 21 aa, Homo sapiens
QGLLPSLEDLLFYTIAEGQEK

SEQ ID NO: 34213 - protein, 16 aa, Homo sapiens
TALHVAAAEGHVEVVK

SEQ ID NO: 34214 - protein, 12 aa, Homo sapiens
TSHIDELYESAK

SEQ ID NO: 34215 - protein, 13 aa, Homo sapiens
VPFCLQSCVKPLK

SEQ ID NO: 34216 - protein, 19 aa, Homo sapiens
WNNTPMDEALHFGHHDVFK

SEQ ID NO: 34217 - protein, 15 aa, Homo sapiens
YAIAVNDLGTEYVHR

SEQ ID NO: 34218 - protein, 16 aa, Homo sapiens
ACVTGKPISQGGIHGR

SEQ ID NO: 34219 - protein, 23 aa, Homo sapiens
AKPYEGSILEADCDILIPAASEK

SEQ ID NO: 34220 - protein, 20 aa, Homo sapiens
CIAVGESDGSIWNPDGIDPK

SEQ ID NO: 34221 - protein, 12 aa, Homo sapiens
DDGSWEVIEGYR

SEQ ID NO: 34222 - protein, 13 aa, Homo sapiens
DIVHSGLAYTMER

SEQ ID NO: 34223 - protein, 16 aa, Homo sapiens
DSNYHLLMSVQESLER

SEQ ID NO: 34224 - protein, 21 aa, Homo sapiens
EMSWIADTYASTIGHYDINAH

SEQ ID NO: 34225 - protein, 27 aa, Homo sapiens
EMSWIADTYASTIGHYDINAHACVTGK

SEQ ID NO: 34226 - protein, 28 aa, Homo sapiens
GVFHGIENFINEASYMSILGMTPGFGDK

SEQ ID NO: 34227 - protein, 16 aa, Homo sapiens
HGGTIPIVPTAEFQDR

SEQ ID NO: 34228 - protein, 16 aa, Homo sapiens
IIAEGANGPTTPEADK

SEQ ID NO: 34229 - protein, 21 aa, Homo sapiens
IIAEGANGPTTPEADKIFLER

SEQ ID NO: 34230 - protein, 16 aa, Homo sapiens
IIKPCNHVLSLSFPIR

SEQ ID NO: 34231 - protein, 20 aa, Homo sapiens
KGFIGPGIDVPAPDMSTGER

SEQ ID NO: 34232 - protein, 14 aa, Homo sapiens
KPCNHVLSLSFPIR

SEQ ID NO: 34233 - protein, 11 aa, Homo sapiens
LQHGSILGFPK

SEQ ID NO: 34234 - protein, 11 aa, Homo sapiens
NHVLSLSFPIR

SEQ ID NO: 34235 - protein, 9 aa, Homo sapiens
NLNHVSYGR

SEQ ID NO: 34236 - protein, 13 aa, Homo sapiens
PCNHVLSLSFPIR

SEQ ID NO: 34237 - protein, 10 aa, Homo sapiens
PISQGGIHGR

SEQ ID NO: 34238 - protein, 21 aa, Homo sapiens
PYEGSILEADCDILIPAASEK

SEQ ID NO: 34239 - protein, 17 aa, Homo sapiens
RIIKPCNHVLSLSFPIR

SEQ ID NO: 34240 - protein, 16 aa, Homo sapiens
TFVVQGFGNVGLHSMR

SEQ ID NO: 34241 - protein, 21 aa, Homo sapiens
KNDRNSSDETFLKDLPIMFDV

SEQ ID NO: 34242 - protein, 24 aa, Homo sapiens
RVSVNTANVTLGPQLMEVTVYRRH

SEQ ID NO: 34243 - protein, 11 aa, Homo sapiens
LANDIEATAVR

SEQ ID NO: 34244 - protein, 10 aa, Homo sapiens
LLDFEFSSGR

SEQ ID NO: 34245 - protein, 32 aa, Homo sapiens
RDVLQNHLTEVLTLVAMELPHNVSSAEAVLRH

SEQ ID NO: 34246 - protein, 13 aa, Homo sapiens
RFSADLGYNGTRQ

SEQ ID NO: 34247 - protein, 16 aa, Homo sapiens
DGALHMIGSLAEILLK

SEQ ID NO: 34248 - protein, 21 aa, Homo sapiens
DVPNETLQVEEDDRPELPWWK

SEQ ID NO: 34249 - protein, 15 aa, Homo sapiens
ENIVEAIIHSPELIR

SEQ ID NO: 34250 - protein, 24 aa, Homo sapiens
FDVFEDFISPTTAAQTLLFTACSK

SEQ ID NO: 34251 - protein, 29 aa, Homo sapiens
FPNNVEPVTNHFITQWLNDVDCFLGLHDR

SEQ ID NO: 34252 - protein, 16 aa, Homo sapiens
GIDQCIPLFVEAALER

SEQ ID NO: 34253 - protein, 32 aa, Homo sapiens
IQGIIQDVIFPLMCYTDADEELWQEDPYEYIR

SEQ ID NO: 34254 - protein, 13 aa, Homo sapiens
IRPVMQALLHIIR

SEQ ID NO: 34255 - protein, 10 aa, Homo sapiens
LLEVIILQCK

SEQ ID NO: 34256 - protein, 17 aa, Homo sapiens
NPVWYQALTHGLNEEQR

SEQ ID NO: 34257 - protein, 12 aa, Homo sapiens
QLQDIATLADQR

SEQ ID NO: 34258 - protein, 15 aa, Homo sapiens
SPLVAAMQHFLPVLK

SEQ ID NO: 34259 - protein, 18 aa, Homo sapiens
STIIDDEDNPVDEYQIFK

SEQ ID NO: 34260 - protein, 20 aa, Homo sapiens
VLQQTLNYINQGVSHALTWK

SEQ ID NO: 34261 - protein, 16 aa, Homo sapiens
VLTGVAGEDAECHAAK

SEQ ID NO: 34262 - protein, 12 aa, Homo sapiens
VQLTTCIHHIIK

SEQ ID NO: 34263 - protein, 29 aa, Homo sapiens
KENMTFGSTLVTNPNGGFLACGPLYAYRC

SEQ ID NO: 34264 - protein, 18 aa, Homo sapiens
KLDLPVNTSIPNVTEVKE

SEQ ID NO: 34265 - protein, 12 aa, Homo sapiens
KVYVYALNQTRF

SEQ ID NO: 34266 - protein, 34 aa, Homo sapiens
RITLDFNLTDPENGPVLDDSLPNSVHEYIPFAKD

SEQ ID NO: 34267 - protein, 16 aa, Homo sapiens
RSENASLVLSSSNQKR

SEQ ID NO: 34268 - protein, 12 aa, Homo sapiens
FTELQSGQLEVK

SEQ ID NO: 34269 - protein, 7 aa, Homo sapiens
GFTAPSK

SEQ ID NO: 34270 - protein, 12 aa, Homo sapiens
LDESLSAGSVQR

SEQ ID NO: 34271 - protein, 10 aa, Homo sapiens
VAAVNVHGTR

SEQ ID NO: 34272 - protein, 16 aa, Homo sapiens
AEVKGATGECNISERK

SEQ ID NO: 34273 - protein, 12 aa, Homo sapiens
ALEEANADLEVK

SEQ ID NO: 34274 - protein, 11 aa, Homo sapiens
QSVEADINGLR

SEQ ID NO: 34275 - protein, 12 aa, Homo sapiens
QSVEADINGLRR

SEQ ID NO: 34276 - protein, 9 aa, Homo sapiens
DAEEWFHAK

SEQ ID NO: 34277 - protein, 13 aa, Homo sapiens
EVSTNTAMIQTSK

SEQ ID NO: 34278 - protein, 10 aa, Homo sapiens
ILTATIENNR

SEQ ID NO: 34279 - protein, 7 aa, Homo sapiens
LAVDDFR

SEQ ID NO: 34280 - protein, 9 aa, Homo sapiens
LEQEIATYR

SEQ ID NO: 34281 - protein, 10 aa, Homo sapiens
LKYENELALR

SEQ ID NO: 34282 - protein, 14 aa, Homo sapiens
MIGFPSSAGSVSPR

SEQ ID NO: 34283 - protein, 7 aa, Homo sapiens
NHEEEMK

SEQ ID NO: 34284 - protein, 11 aa, Homo sapiens
TRLEQEIATYR

SEQ ID NO: 34285 - protein, 9 aa, Homo sapiens
VILEIDNAR

SEQ ID NO: 34286 - protein, 9 aa, Homo sapiens
VLDELTLSK

SEQ ID NO: 34287 - protein, 23 aa, Homo sapiens
YALQLQQIQGLISSIEAQLSELR

SEQ ID NO: 34288 - protein, 27 aa, Homo sapiens
GGHSGQLGPSSVAPSFRPEDELEHLTK

SEQ ID NO: 34289 - protein, 23 aa, Homo sapiens
SLDGIPFTVDAGGLIHCIEDFHK

SEQ ID NO: 34290 - protein, 18 aa, Homo sapiens
TYITDPVSAPCAPPLQPK

SEQ ID NO: 34291 - protein, 17 aa, Homo sapiens
VANFSQIETLTSVFQKK

SEQ ID NO: 34292 - protein, 9 aa, Homo sapiens
AAIVFTDGR

SEQ ID NO: 34293 - protein, 16 aa, Homo sapiens
AIEEELQEIASEPTNK

SEQ ID NO: 34294 - protein, 11 aa, Homo sapiens
AQDDVSEWASK

SEQ ID NO: 34295 - protein, 9 aa, Homo sapiens
GFTLNPDKK

SEQ ID NO: 34296 - protein, 22 aa, Homo sapiens
GICEALEDSDGRQDSPAGELPK

SEQ ID NO: 34297 - protein, 9 aa, Homo sapiens
GSMTGLALK

SEQ ID NO: 34298 - protein, 9 aa, Homo sapiens
GYTLDPNGK

SEQ ID NO: 34299 - protein, 7 aa, Homo sapiens
LEEMTQR

SEQ ID NO: 34300 - protein, 7 aa, Homo sapiens
MEALENR

SEQ ID NO: 34301 - protein, 13 aa, Homo sapiens
QGYILNSDQTTCR

SEQ ID NO: 34302 - protein, 11 aa, Homo sapiens
SLGEENFEVVK

SEQ ID NO: 34303 - protein, 10 aa, Homo sapiens
TVQQPTVQHR

SEQ ID NO: 34304 - protein, 11 aa, Homo sapiens
VGLLQYGSTVK

SEQ ID NO: 34305 - protein, 20 aa, Homo sapiens
VIMIVTDGRPQDSVAEVAAK

SEQ ID NO: 34306 - protein, 10 aa, Homo sapiens
YLFEEDNLLR

SEQ ID NO: 34307 - protein, 10 aa, Homo sapiens
ADITWELPDK

SEQ ID NO: 34308 - protein, 10 aa, Homo sapiens
HLYLAENMVR

SEQ ID NO: 34309 - protein, 14 aa, Homo sapiens
HSEKEPETNVAEGR

SEQ ID NO: 34310 - protein, 28 aa, Homo sapiens
IHLNQTDPPDIDINATVALDFECPMTRE

SEQ ID NO: 34311 - protein, 11 aa, Homo sapiens
LIAYYSEVPVK

SEQ ID NO: 34312 - protein, 14 aa, Homo sapiens
QDADEEALYYTGVR

SEQ ID NO: 34313 - protein, 18 aa, Homo sapiens
RITVHGNGSLDIRSLRKS

SEQ ID NO: 34314 - protein, 9 aa, Homo sapiens
RTVQLNVQR

SEQ ID NO: 34315 - protein, 7 aa, Homo sapiens
TTYIHVF

SEQ ID NO: 34316 - protein, 8 aa, Homo sapiens
TVQLNVQR

SEQ ID NO: 34317 - protein, 9 aa, Homo sapiens
VDVVMKPAK

SEQ ID NO: 34318 - protein, 9 aa, Homo sapiens
VGLKPEANK

SEQ ID NO: 34319 - protein, 10 aa, Homo sapiens
VQVSDSGYYR

SEQ ID NO: 34320 - protein, 13 aa, Homo sapiens
YQIYQDGTLLIQK

SEQ ID NO: 34321 - protein, 9 aa, Homo sapiens
ALEEALEAK

SEQ ID NO: 34322 - protein, 23 aa, Homo sapiens
DVASLSSQLQDTQELLQEETRQK

SEQ ID NO: 34323 - protein, 14 aa, Homo sapiens
GFMDGKQACILMIK

SEQ ID NO: 34324 - protein, 14 aa, Homo sapiens
KEIENLTQQYEEKA

SEQ ID NO: 34325 - protein, 12 aa, Homo sapiens
KMAEQYKEQAEK

SEQ ID NO: 34326 - protein, 19 aa, Homo sapiens
LEGDLKDLELQADSAIKGR

SEQ ID NO: 34327 - protein, 6 aa, Homo sapiens
QLSILK

SEQ ID NO: 34328 - protein, 8 aa, Homo sapiens
QLVSNLEK

SEQ ID NO: 34329 - protein, 23 aa, Homo sapiens
RHEMPPHIYAIADTAYRSMLQDR

SEQ ID NO: 34330 - protein, 20 aa, Homo sapiens
RVGECSCQVSLMLQNSSARA

SEQ ID NO: 34331 - protein, 17 aa, Homo sapiens
IILSGPSGTGKTYLANK

SEQ ID NO: 34332 - protein, 26 aa, Homo sapiens
KYHFSNLVSPTNLSQFNLPGPSMMRS

SEQ ID NO: 34333 - protein, 20 aa, Homo sapiens
MEGFNSGLNSGGSTNSSPKV

SEQ ID NO: 34334 - protein, 12 aa, Homo sapiens
NLSNKKSLLQPK

SEQ ID NO: 34335 - protein, 20 aa, Homo sapiens
PTKIGSGRSSPVTVNQTDKE

SEQ ID NO: 34336 - protein, 15 aa, Homo sapiens
RSSTSSIDSNVSSKS

SEQ ID NO: 34337 - protein, 16 aa, Homo sapiens
RYATQSNHSGIATSQK

SEQ ID NO: 34338 - protein, 12 aa, Homo sapiens
SAAIGGKSNAGR

SEQ ID NO: 34339 - protein, 16 aa, Homo sapiens
SMNVKHSATSTMLTVK

SEQ ID NO: 34340 - protein, 22 aa, Homo sapiens
SQSFNSIDKNKPPNYANGNEKD

SEQ ID NO: 34341 - protein, 14 aa, Homo sapiens
YATQSNHSGIATSQ

SEQ ID NO: 34342 - protein, 12 aa, Homo sapiens
KGGPRNDTEERV

SEQ ID NO: 34343 - protein, 19 aa, Homo sapiens
RLNSSSQTNSLKDLLQSKI

SEQ ID NO: 34344 - protein, 30 aa, Homo sapiens
DAFEHIVTQFSSVPVSVVSDSYDIYNACEK

SEQ ID NO: 34345 - protein, 8 aa, Homo sapiens
DLLNCSFK

SEQ ID NO: 34346 - protein, 16 aa, Homo sapiens
GDLEEYGQDLLHTVFK

SEQ ID NO: 34347 - protein, 12 aa, Homo sapiens
GTDTVAGLALIK

SEQ ID NO: 34348 - protein, 20 aa, Homo sapiens
GVSSQETAGIGASAHLVNFK

SEQ ID NO: 34349 - protein, 18 aa, Homo sapiens
MWSIENIAFGSGGGLLQK

SEQ ID NO: 34350 - protein, 21 aa, Homo sapiens
STQAPLIIRPDSGNPLDTVLK

SEQ ID NO: 34351 - protein, 29 aa, Homo sapiens
TPAGNFVTLEEGKGDLEEYGQDLLHTVFK

SEQ ID NO: 34352 - protein, 20 aa, Homo sapiens
VIQGDGVDINTLQEIVEGMK

SEQ ID NO: 34353 - protein, 10 aa, Homo sapiens
YDGHLPIEIK

SEQ ID NO: 34354 - protein, 15 aa, Homo sapiens
YEETVFYGLQYILNK

SEQ ID NO: 34355 - protein, 24 aa, Homo sapiens
KRRRDFYAAHPSADAANGSNEDRG

SEQ ID NO: 34356 - protein, 21 aa, Homo sapiens
APSHVPFLLIGGGTAAFAAAR

SEQ ID NO: 34357 - protein, 21 aa, Homo sapiens
KVETDHIVAAVGLEPNVELAK

SEQ ID NO: 34358 - protein, 20 aa, Homo sapiens
SITIIGGGFLGSELACALGR

SEQ ID NO: 34359 - protein, 30 aa, Homo sapiens
SIYFQPPSFYVSAQDLPHIENGGVAVLTGK

SEQ ID NO: 34360 - protein, 16 aa, Homo sapiens
SNIWVAGDAACFYDIK

SEQ ID NO: 34361 - protein, 14 aa, Homo sapiens
AYHPEEFVCSQCGK

SEQ ID NO: 34362 - protein, 9 aa, Homo sapiens
TPVCHQCHK

SEQ ID NO: 34363 - protein, 21 aa, Homo sapiens
YLVALGHAYHPEEFVCSQCGK

SEQ ID NO: 34364 - protein, 28 aa, Homo sapiens
KHSKALNTLSSPGQSSFSHGTRNNSAKE

SEQ ID NO: 34365 - protein, 21 aa, Homo sapiens
KKRNRSSSVSSSAASSPERKK

SEQ ID NO: 34366 - protein, 22 aa, Homo sapiens
AIVDALPPPCESACTVPTDVDK

SEQ ID NO: 34367 - protein, 10 aa, Homo sapiens
DKDFAIDIIK

SEQ ID NO: 34368 - protein, 16 aa, Homo sapiens
GQYISPFHDIPIYADK

SEQ ID NO: 34369 - protein, 27 aa, Homo sapiens
GQYISPFHDIPIYADKDVFHMVVEVPR

SEQ ID NO: 34370 - protein, 19 aa, Homo sapiens
HTGCCGDNDPIDVCEIGSK

SEQ ID NO: 34371 - protein, 14 aa, Homo sapiens
LKPGYLEATVDWFR

SEQ ID NO: 34372 - protein, 16 aa, Homo sapiens
PPPCESACTVPTDVDK

SEQ ID NO: 34373 - protein, 21 aa, Homo sapiens
VIAINVDDPDAANYNDINDVK

SEQ ID NO: 34374 - protein, 22 aa, Homo sapiens
VIAINVDDPDAANYNDINDVKR

SEQ ID NO: 34375 - protein, 16 aa, Homo sapiens
VLGILAMIDEGETDWK

SEQ ID NO: 34376 - protein, 17 aa, Homo sapiens
VPDGKPENEFAFNAEFK

SEQ ID NO: 34377 - protein, 19 aa, Homo sapiens
YKVPDGKPENEFAFNAEFK

SEQ ID NO: 34378 - protein, 20 aa, Homo sapiens
AISHEHSPSDLEAHFVPLVK

SEQ ID NO: 34379 - protein, 16 aa, Homo sapiens
DNTIEHLLPLFLAQLK

SEQ ID NO: 34380 - protein, 23 aa, Homo sapiens
DNTIEHLLPLFLAQLKDECPEVR

SEQ ID NO: 34381 - protein, 20 aa, Homo sapiens
IGPILDNSTLQSEVKPILEK

SEQ ID NO: 34382 - protein, 15 aa, Homo sapiens
KIGPILDNSTLQSEV

SEQ ID NO: 34383 - protein, 22 aa, Homo sapiens
LAIIEYMPLLAGQLGVEFFDEK

SEQ ID NO: 34384 - protein, 17 aa, Homo sapiens
LNIISNLDCVNEVIGIR

SEQ ID NO: 34385 - protein, 18 aa, Homo sapiens
QLSQSLLPAIVELAEDAK

SEQ ID NO: 34386 - protein, 16 aa, Homo sapiens
SALASVIMGLSPILGK

SEQ ID NO: 34387 - protein, 19 aa, Homo sapiens
SEIIPMFSNLASDEQDSVR

SEQ ID NO: 34388 - protein, 29 aa, Homo sapiens
TTLVGGPEYVHCLLPPLESLATVEETVVR

SEQ ID NO: 34389 - protein, 13 aa, Homo sapiens
YFAQEALTVLSLA

SEQ ID NO: 34390 - protein, 19 aa, Homo sapiens
AGTCLGILANDGVLLAAER

SEQ ID NO: 34391 - protein, 16 aa, Homo sapiens
ATCIGNNSAAAVSMLK

SEQ ID NO: 34392 - protein, 19 aa, Homo sapiens
HYGFQLYQSDPSGNYGGWK

SEQ ID NO: 34393 - protein, 10 aa, Homo sapiens
LLDEVFFSEK

SEQ ID NO: 34394 - protein, 24 aa, Homo sapiens
LNEDMACSVAGITSDANVLTNELR

SEQ ID NO: 34395 - protein, 32 aa, Homo sapiens
LYQVEYAMEAIGHAGTCLGILANDGVLLAAER

SEQ ID NO: 34396 - protein, 14 aa, Homo sapiens
RPFGVSLLYIGWDK

SEQ ID NO: 34397 - protein, 9 aa, Homo sapiens
TTIFSPEGR

SEQ ID NO: 34398 - protein, 8 aa, Homo sapiens
VEIATLTR

SEQ ID NO: 34399 - protein, 22 aa, Homo sapiens
YLLQYQEPIPCEQLVTALCDIK

SEQ ID NO: 34400 - protein, 15 aa, Homo sapiens
IPEEFNVFNLIQEMR

SEQ ID NO: 34401 - protein, 31 aa, Homo sapiens
ISKPQELSSDLNVGDTSQNSCVDCSVTQSNK

SEQ ID NO: 34402 - protein, 23 aa, Homo sapiens
RNYSKSTELPGKNESTIEQIDKK

SEQ ID NO: 34403 - protein, 19 aa, Homo sapiens
YQEHEDVPICIHCSAGCGR

SEQ ID NO: 34404 - protein, 18 aa, Homo sapiens
AAGTEGPFQEVDGVATTR

SEQ ID NO: 34405 - protein, 17 aa, Homo sapiens
AHTDVGPGPESSPVLVR

SEQ ID NO: 34406 - protein, 21 aa, Homo sapiens
DEAIYECTATNSLGEINTSAK

SEQ ID NO: 34407 - protein, 12 aa, Homo sapiens
EHSSWDLVGLEK

SEQ ID NO: 34408 - protein, 15 aa, Homo sapiens
FEVIEFDDGAGSVLR

SEQ ID NO: 34409 - protein, 15 aa, Homo sapiens
FTLTGLKPDTTYDIK

SEQ ID NO: 34410 - protein, 8 aa, Homo sapiens
GPPSEAVR

SEQ ID NO: 34411 - protein, 12 aa, Homo sapiens
GSGPLSPSIQSR

SEQ ID NO: 34412 - protein, 8 aa, Homo sapiens
GYQVTYVR

SEQ ID NO: 34413 - protein, 9 aa, Homo sapiens
IISYTVVFR

SEQ ID NO: 34414 - protein, 12 aa, Homo sapiens
IQLSWLLPPQER

SEQ ID NO: 34415 - protein, 17 aa, Homo sapiens
KVEVEPLNSTAVHVYWK

SEQ ID NO: 34416 - protein, 21 aa, Homo sapiens
LKPYVAAQLDVLPETFTLGDK

SEQ ID NO: 34417 - protein, 10 aa, Homo sapiens
NVLELSNVVR

SEQ ID NO: 34418 - protein, 8 aa, Homo sapiens
NYIDGYRK

SEQ ID NO: 34419 - protein, 18 aa, Homo sapiens
RDINSQQELQNITTDTRF

SEQ ID NO: 34420 - protein, 33 aa, Homo sapiens
RFSIPPSSQEVMPGGSVNLTCVAVGAPMPYVKW

SEQ ID NO: 34421 - protein, 19 aa, Homo sapiens
RKVEVEPLNSTAVHVYWKL

SEQ ID NO: 34422 - protein, 17 aa, Homo sapiens
RMLWEHNSTIIVMLTKL

SEQ ID NO: 34423 - protein, 15 aa, Homo sapiens
SDMGVGVFTPTIEAR

SEQ ID NO: 34424 - protein, 16 aa, Homo sapiens
SGALQIESSEESDQGK

SEQ ID NO: 34425 - protein, 12 aa, Homo sapiens
TAQSTPSAPPQK

SEQ ID NO: 34426 - protein, 20 aa, Homo sapiens
TATMLCAAGGNPDPEISWFK

SEQ ID NO: 34427 - protein, 11 aa, Homo sapiens
TDEDVPSGPPR

SEQ ID NO: 34428 - protein, 11 aa, Homo sapiens
TGEQAPSSPPR

SEQ ID NO: 34429 - protein, 21 aa, Homo sapiens
TQQGVPAQPADFQAEVESDTR

SEQ ID NO: 34430 - protein, 19 aa, Homo sapiens
VLAFTAVGDGPPSPTIQVK

SEQ ID NO: 34431 - protein, 9 aa, Homo sapiens
VLAVNSIGR

SEQ ID NO: 34432 - protein, 12 aa, Homo sapiens
VMCVSMGSTTVR

SEQ ID NO: 34433 - protein, 21 aa, Homo sapiens
VTFDPTSSYTLEDLKPDTLYR

SEQ ID NO: 34434 - protein, 10 aa, Homo sapiens
YSAPANLYVR

SEQ ID NO: 34435 - protein, 15 aa, Homo sapiens
YSIGGLSPFSEYAFR

SEQ ID NO: 34436 - protein, 39 aa, Homo sapiens
RSQQVNNFTSNDVDMETDHYSNGVGETSSNGFLNGSSKH

SEQ ID NO: 34437 - protein, 9 aa, Homo sapiens
ILGFSTSAK

SEQ ID NO: 34438 - protein, 24 aa, Homo sapiens
LAADPSVVNLGQGFPDISPPTYVK

SEQ ID NO: 34439 - protein, 15 aa, Homo sapiens
RIEGLDSNVWIEFTK

SEQ ID NO: 34440 - protein, 25 aa, Homo sapiens
RCSGDGLDSDGNQTLHWQAIGNPRC

SEQ ID NO: 34441 - protein, 8 aa, Homo sapiens
IAVHCTVR

SEQ ID NO: 34442 - protein, 14 aa, Homo sapiens
KLCLNICVGESGDR

SEQ ID NO: 34443 - protein, 13 aa, Homo sapiens
LCLNICVGESGDR

SEQ ID NO: 34444 - protein, 13 aa, Homo sapiens
LEQLTGQTPVFSK

SEQ ID NO: 34445 - protein, 22 aa, Homo sapiens
NNFSDTGNFGFGIQEHIDLGIK

SEQ ID NO: 34446 - protein, 14 aa, Homo sapiens
VLEQLTGQTPVFSK

SEQ ID NO: 34447 - protein, 18 aa, Homo sapiens
YDPSIGIYGLDFYVVLGR

SEQ ID NO: 34448 - protein, 15 aa, Homo sapiens
SCSSSCAVHDLIFWR

SEQ ID NO: 34449 - protein, 29 aa, Homo sapiens
SISSSSFGAEPSAPGGGGSPGACPALGTK

SEQ ID NO: 34450 - protein, 11 aa, Homo sapiens
TQIDHYVGIAR

SEQ ID NO: 34451 - protein, 15 aa, Homo sapiens
FDLHSSSHIDTLLER

SEQ ID NO: 34452 - protein, 13 aa, Homo sapiens
HSNASQSLCEIVR

SEQ ID NO: 34453 - protein, 11 aa, Homo sapiens
IANCIVHSTDK

SEQ ID NO: 34454 - protein, 21 aa, Homo sapiens
LYSFLLNDSPLNPLLASFFSK

SEQ ID NO: 34455 - protein, 14 aa, Homo sapiens
QEIIEQLLSNIFHK

SEQ ID NO: 34456 - protein, 15 aa, Homo sapiens
WETFCTSSLGETNKR

SEQ ID NO: 34457 - protein, 16 aa, Homo sapiens
DNSQVNAVTVLTLLDK

SEQ ID NO: 34458 - protein, 10 aa, Homo sapiens
LENNHAQLLR

SEQ ID NO: 34459 - protein, 14 aa, Homo sapiens
LVNMLDAVQENQHK

SEQ ID NO: 34460 - protein, 11 aa, Homo sapiens
RLENNHAQLLR

SEQ ID NO: 34461 - protein, 17 aa, Homo sapiens
SDGDPVQPAVLQVHQTS

SEQ ID NO: 34462 - protein, 10 aa, Homo sapiens
CGNCSLTTLK

SEQ ID NO: 34463 - protein, 16 aa, Homo sapiens
CGNCSLTTLKDEDFCK

SEQ ID NO: 34464 - protein, 17 aa, Homo sapiens
CGNCSLTTLKDEDFCKR

SEQ ID NO: 34465 - protein, 8 aa, Homo sapiens
CINQLLCK

SEQ ID NO: 34466 - protein, 8 aa, Homo sapiens
DDFLIYDR

SEQ ID NO: 34467 - protein, 13 aa, Homo sapiens
DMPASEDLQDLQK

SEQ ID NO: 34468 - protein, 19 aa, Homo sapiens
EGYSNISYIVVNHQGISSR

SEQ ID NO: 34469 - protein, 21 aa, Homo sapiens
EGYSNISYIVVNHQGISSRLK

SEQ ID NO: 34470 - protein, 19 aa, Homo sapiens
HLGLPFSFLTFPYVEEAIK

SEQ ID NO: 34471 - protein, 6 aa, Homo sapiens
HLIFEK

SEQ ID NO: 34472 - protein, 12 aa, Homo sapiens
KCGNCSLTTLKD

SEQ ID NO: 34473 - protein, 17 aa, Homo sapiens
KCGNCSLTTLKDEDFCK

SEQ ID NO: 34474 - protein, 18 aa, Homo sapiens
KCGNCSLTTLKDEDFCKR

SEQ ID NO: 34475 - protein, 20 aa, Homo sapiens
KEGYSNISYIVVNHQGISSR

SEQ ID NO: 34476 - protein, 21 aa, Homo sapiens
KEGYSNISYIVVNHQGISSRL

SEQ ID NO: 34477 - protein, 27 aa, Homo sapiens
KVSEHIPVYQQEENQTDVWTLLNGSKD

SEQ ID NO: 34478 - protein, 13 aa, Homo sapiens
LKKEGYSNISYIV

SEQ ID NO: 34479 - protein, 22 aa, Homo sapiens
LKKEGYSNISYIVVNHQGISSR

SEQ ID NO: 34480 - protein, 10 aa, Homo sapiens
LPTDSELAPR

SEQ ID NO: 34481 - protein, 9 aa, Homo sapiens
LVYHLGLPF

SEQ ID NO: 34482 - protein, 22 aa, Homo sapiens
LVYHLGLPFSFLTFPYVEEAIK

SEQ ID NO: 34483 - protein, 20 aa, Homo sapiens
PGAPNAPTHPAPPGLHHHHK

SEQ ID NO: 34484 - protein, 9 aa, Homo sapiens
PTDSELAPR

SEQ ID NO: 34485 - protein, 20 aa, Homo sapiens
QGHPENRDMPASEDLQDLQK

SEQ ID NO: 34486 - protein, 9 aa, Homo sapiens
RVSLATVDK

SEQ ID NO: 34487 - protein, 13 aa, Homo sapiens
SFLTFPYVEEAIK

SEQ ID NO: 34488 - protein, 16 aa, Homo sapiens
SNISYIVVNHQGISSR

SEQ ID NO: 34489 - protein, 13 aa, Homo sapiens
SYIVVNHQGISSR

SEQ ID NO: 34490 - protein, 9 aa, Homo sapiens
VNHQGISSR

SEQ ID NO: 34491 - protein, 25 aa, Homo sapiens
VSEHIPVYQQEENQTDVWTLLNGSK

SEQ ID NO: 34492 - protein, 33 aa, Homo sapiens
VSEHIPVYQQEENQTDVWTLLNGSKDDFLIYDR

SEQ ID NO: 34493 - protein, 8 aa, Homo sapiens
VSLATVDK

SEQ ID NO: 34494 - protein, 20 aa, Homo sapiens
KATENGLVNGENSIPNGTRS

SEQ ID NO: 34495 - protein, 15 aa, Homo sapiens
EEQGYDSEKEKKEEK

SEQ ID NO: 34496 - protein, 14 aa, Homo sapiens
RLNAINITSALDRG

SEQ ID NO: 34497 - protein, 8 aa, Homo sapiens
ELYPGQFK

SEQ ID NO: 34498 - protein, 11 aa, Homo sapiens
KSPPPAKDEAR

SEQ ID NO: 34499 - protein, 18 aa, Homo sapiens
RMFTNPDNGSPAMTHRNL

SEQ ID NO: 34500 - protein, 18 aa, Homo sapiens
GQNDLMGTAEDFADQFLR

SEQ ID NO: 34501 - protein, 13 aa, Homo sapiens
LCLISTFLEDGIR

SEQ ID NO: 34502 - protein, 19 aa, Homo sapiens
ATYIQTIEEGINTHTHAAK

SEQ ID NO: 34503 - protein, 15 aa, Homo sapiens
DASSLYPGTETMGLR

SEQ ID NO: 34504 - protein, 30 aa, Homo sapiens
KLIPFSPAVNTSVSTVASTVAPMYAGDLRT

SEQ ID NO: 34505 - protein, 21 aa, Homo sapiens
KMSSNSNFSEVTLAGLASKEN

SEQ ID NO: 34506 - protein, 24 aa, Homo sapiens
KTRGRGAANDSTQFTVAGRMVKKG

SEQ ID NO: 34507 - protein, 32 aa, Homo sapiens
LLGGQTSYQSAGDPKEDELYEAAIIETNCIYR

SEQ ID NO: 34508 - protein, 13 aa, Homo sapiens
SFDEQNVPKRRSR

SEQ ID NO: 34509 - protein, 21 aa, Homo sapiens
VTIHECDEGSEPLGFWDALGR

SEQ ID NO: 34510 - protein, 16 aa, Homo sapiens
ALGSGMAVDCSTLTSK

SEQ ID NO: 34511 - protein, 17 aa, Homo sapiens
FVAAVHYEQPTIQIELR

SEQ ID NO: 34512 - protein, 22 aa, Homo sapiens
PSEHALVDNDGLYDPDCDPEGR

SEQ ID NO: 34513 - protein, 20 aa, Homo sapiens
RHRPTAGAFNHSDLDAELRR

SEQ ID NO: 34514 - protein, 19 aa, Homo sapiens
RQCNQTSVCWCVNSVGVRR

SEQ ID NO: 34515 - protein, 9 aa, Homo sapiens
THHILIDLR

SEQ ID NO: 34516 - protein, 26 aa, Homo sapiens
TLVRPSEHALVDNDGLYDPDCDPEGR

SEQ ID NO: 34517 - protein, 35 aa, Homo sapiens
KVAGSEENGTAETEEVEDESASGELDLEAQFHLHF

SEQ ID NO: 34518 - protein, 12 aa, Homo sapiens
KNINGTDPIQKY

SEQ ID NO: 34519 - protein, 16 aa, Homo sapiens
YTMEGYINNTLSIFKV

SEQ ID NO: 34520 - protein, 10 aa, Homo sapiens
IQLVEEELDR

SEQ ID NO: 34521 - protein, 23 aa, Homo sapiens
LATALQKLEEAEKAADESERGMK

SEQ ID NO: 34522 - protein, 15 aa, Homo sapiens
RIQLVEEELDRAQER

SEQ ID NO: 34523 - protein, 17 aa, Homo sapiens
SIDDLEDELYAQKLKYK

SEQ ID NO: 34524 - protein, 21 aa, Homo sapiens
KEENLSMHQMLDQTLLELNNM

SEQ ID NO: 34525 - protein, 11 aa, Homo sapiens
KLVILEGELER

SEQ ID NO: 34526 - protein, 21 aa, Homo sapiens
LEQAEKKATDAEADVASLNRR

SEQ ID NO: 34527 - protein, 10 aa, Homo sapiens
LVILEGELER

SEQ ID NO: 34528 - protein, 18 aa, Homo sapiens
MSATFIGNSTAIQELFKR

SEQ ID NO: 34529 - protein, 17 aa, Homo sapiens
EIVHIQAGQCGNQIGTK

SEQ ID NO: 34530 - protein, 27 aa, Homo sapiens
FWEVISDEHGIDPAGGYVGDSALQLER

SEQ ID NO: 34531 - protein, 18 aa, Homo sapiens
GHYTEGAELVDAVLDVVR

SEQ ID NO: 34532 - protein, 16 aa, Homo sapiens
KECEHCDCLQGFQLTH

SEQ ID NO: 34533 - protein, 33 aa, Homo sapiens
KECEHCDCLQGFQLTHSLGGGTGSGMGTLLISK

SEQ ID NO: 34534 - protein, 25 aa, Homo sapiens
LTTPTYGDLNHLVSATMSGVTTSLR

SEQ ID NO: 34535 - protein, 17 aa, Homo sapiens
MASTFIGNSTAIQELFK

SEQ ID NO: 34536 - protein, 18 aa, Homo sapiens
MASTFIGNSTAIQELFKR

SEQ ID NO: 34537 - protein, 26 aa, Homo sapiens
SGPFGQLFRPDNFIFGQTGAGNNWAK

SEQ ID NO: 34538 - protein, 15 aa, Homo sapiens
GVTECYECHPKPTQR

SEQ ID NO: 34539 - protein, 26 aa, Homo sapiens
LLVPCALDPPNPNCYVCASKPEVTVR

SEQ ID NO: 34540 - protein, 24 aa, Homo sapiens
LQADDFLQDYTLLINILHSEDLGK

SEQ ID NO: 34541 - protein, 14 aa, Homo sapiens
NTPSEPIHCIVWAK

SEQ ID NO: 34542 - protein, 18 aa, Homo sapiens
PPNPNCYVCASKPEVTVR

SEQ ID NO: 34543 - protein, 33 aa, Homo sapiens
RKPPVPLDWAEVQSQGEETNASDQQNEPQLGLK

SEQ ID NO: 34544 - protein, 15 aa, Homo sapiens
VLVVGAGGIGCELLK

SEQ ID NO: 34545 - protein, 17 aa, Homo sapiens
ELYPAFCIHNGGSDLER

SEQ ID NO: 34546 - protein, 14 aa, Homo sapiens
FVTSCSRPPLLGFK

SEQ ID NO: 34547 - protein, 17 aa, Homo sapiens
QLAVLTELPFVVPFEER

SEQ ID NO: 34548 - protein, 21 aa, Homo sapiens
VHLLNAHGLDEAGIDGGGIFR

SEQ ID NO: 34549 - protein, 15 aa, Homo sapiens
DVLTAHPAAPGPVSR

SEQ ID NO: 34550 - protein, 24 aa, Homo sapiens
TISAVGEQLLPTVEHLQLELDQLK

SEQ ID NO: 34551 - protein, 23 aa, Homo sapiens
ASQKPQPNFPSPEYMIFDHEFTK

SEQ ID NO: 34552 - protein, 24 aa, Homo sapiens
DNQHQGSYSEGAQMNGIQPEEIGR

SEQ ID NO: 34553 - protein, 20 aa, Homo sapiens
GVMGGQSAGPQHTEAETIQK

SEQ ID NO: 34554 - protein, 19 aa, Homo sapiens
LEVGIQAMEHLIHVLQTDR

SEQ ID NO: 34555 - protein, 29 aa, Homo sapiens
LLDIISEEGNSDGGIVVEDCLILLQNLLK

SEQ ID NO: 34556 - protein, 37 aa, Homo sapiens
NQKGQGEIVSTLLPSTIDATGNSVSAGQLLCGGLFST

SEQ ID NO: 34557 - protein, 13 aa, Homo sapiens
TLEQHDNIVTHYK

SEQ ID NO: 34558 - protein, 10 aa, Homo sapiens
DSTLIMQLLR

SEQ ID NO: 34559 - protein, 9 aa, Homo sapiens
EMQPTHPIR

SEQ ID NO: 34560 - protein, 19 aa, Homo sapiens
KQTIDNSQGAYQEAFDISK

SEQ ID NO: 34561 - protein, 7 aa, Homo sapiens
LAEQAER

SEQ ID NO: 34562 - protein, 8 aa, Homo sapiens
NLLSVAYK

SEQ ID NO: 34563 - protein, 18 aa, Homo sapiens
QTIDNSQGAYQEAFDISK

SEQ ID NO: 34564 - protein, 12 aa, Homo sapiens
SICTTVLELLDK

SEQ ID NO: 34565 - protein, 19 aa, Homo sapiens
TAFDEAIAELDTLNEDSYK

SEQ ID NO: 34566 - protein, 29 aa, Homo sapiens
TAFDEAIAELDTLNEDSYKDSTLIMQLLR

SEQ ID NO: 34567 - protein, 8 aa, Homo sapiens
VISSIEQK

SEQ ID NO: 34568 - protein, 11 aa, Homo sapiens
YLAEVACGDDR

SEQ ID NO: 34569 - protein, 12 aa, Homo sapiens
YLAEVACGDDRK

SEQ ID NO: 34570 - protein, 12 aa, Homo sapiens
YLIANATNPESK

SEQ ID NO: 34571 - protein, 23 aa, Homo sapiens
KTLDLQSGLKDITGNKSEMIEKP

SEQ ID NO: 34572 - protein, 23 aa, Homo sapiens
RNNQTIFEQTINDLTFDGSFVKE

SEQ ID NO: 34573 - protein, 13 aa, Homo sapiens
CGETGHVAINCSK

SEQ ID NO: 34574 - protein, 12 aa, Homo sapiens
CYSCGEFGHIQK

SEQ ID NO: 34575 - protein, 14 aa, Homo sapiens
DCDLQEDACYNCGR

SEQ ID NO: 34576 - protein, 15 aa, Homo sapiens
EQCCYNCGKPGHLAR

SEQ ID NO: 34577 - protein, 15 aa, Homo sapiens
GFQFVSSSLPDICYR

SEQ ID NO: 34578 - protein, 14 aa, Homo sapiens
IEVNNATARVMTNK

SEQ ID NO: 34579 - protein, 9 aa, Homo sapiens
LHGTVVEGR

SEQ ID NO: 34580 - protein, 23 aa, Homo sapiens
ASLQVLGTVGEPINPEAWLWYHR

SEQ ID NO: 34581 - protein, 19 aa, Homo sapiens
GECLYCFVTLCDGHTFSPK

SEQ ID NO: 34582 - protein, 27 aa, Homo sapiens
IAQNDHDLGDMSTVADPSVISHLFSHR

SEQ ID NO: 34583 - protein, 17 aa, Homo sapiens
ILDSSCSLLITTDAFYR

SEQ ID NO: 34584 - protein, 30 aa, Homo sapiens
LLSTAEVESALVEHEAVAEAAVVGHPHPVK

SEQ ID NO: 34585 - protein, 28 aa, Homo sapiens
CPEALFQPSFLGMESCGIHETTFNSIMK

SEQ ID NO: 34586 - protein, 21 aa, Homo sapiens
DLYANTVLSGGTTMYPGIADR

SEQ ID NO: 34587 - protein, 24 aa, Homo sapiens
DLYANTVLSGGTTMYPGIADRMQK

SEQ ID NO: 34588 - protein, 10 aa, Homo sapiens
GYSFTTTAER

SEQ ID NO: 34589 - protein, 23 aa, Homo sapiens
LCYVALDFEQEMATAASSSSLEK

SEQ ID NO: 34590 - protein, 19 aa, Homo sapiens
MEEEIAALVIDNGSGMCKA

SEQ ID NO: 34591 - protein, 13 aa, Homo sapiens
QEYDESGPSIVHR

SEQ ID NO: 34592 - protein, 18 aa, Homo sapiens
VAPEEHPVLLTEAPLNPK

SEQ ID NO: 34593 - protein, 35 aa, Homo sapiens
RKRFLNKSSEDDAASESFLPSEGASSDPVTLRRRM

SEQ ID NO: 34594 - protein, 16 aa, Homo sapiens
DLEADIIGDTSGHFQK

SEQ ID NO: 34595 - protein, 16 aa, Homo sapiens
GTVRPANDFNPDADAK

SEQ ID NO: 34596 - protein, 10 aa, Homo sapiens
ILISLATGHR

SEQ ID NO: 34597 - protein, 15 aa, Homo sapiens
SLEDALSSDTSGHFR

SEQ ID NO: 34598 - protein, 10 aa, Homo sapiens
AALCAVHVIR

SEQ ID NO: 34599 - protein, 24 aa, Homo sapiens
NLIMSGYSPEHDVSGISDPFLQVR

SEQ ID NO: 34600 - protein, 27 aa, Homo sapiens
TFQLQLLSPSSSIVPAFNTGTITQVIK

SEQ ID NO: 34601 - protein, 15 aa, Homo sapiens
GWFPILFELSCIINR

SEQ ID NO: 34602 - protein, 13 aa, Homo sapiens
LLDCLQESHSFSK

SEQ ID NO: 34603 - protein, 22 aa, Homo sapiens
TLITVAHTDGNYLGNSWHEILK

SEQ ID NO: 34604 - protein, 11 aa, Homo sapiens
GGVEEGPTVLR

SEQ ID NO: 34605 - protein, 12 aa, Homo sapiens
GGVEEGPTVLRK

SEQ ID NO: 34606 - protein, 10 aa, Homo sapiens
HGQPVSFLLK

SEQ ID NO: 34607 - protein, 26 aa, Homo sapiens
RFVNVTVTPEDQCRPNNVCTGVLTRR

SEQ ID NO: 34608 - protein, 19 aa, Homo sapiens
VTILPLPLQNATVEAGTRC

SEQ ID NO: 34609 - protein, 24 aa, Homo sapiens
MKGPIDINMSEIGMDYIHELFSKD

SEQ ID NO: 34610 - protein, 21 aa, Homo sapiens
MLAQEGMLANLVEQNISVRRR

SEQ ID NO: 34611 - protein, 25 aa, Homo sapiens
KRFNGSESIKSSWNISVVKFLLEKL

SEQ ID NO: 34612 - protein, 12 aa, Homo sapiens
ADGLAVIGVLMK

SEQ ID NO: 34613 - protein, 9 aa, Homo sapiens
EIINVGHSF

SEQ ID NO: 34614 - protein, 19 aa, Homo sapiens
EIINVGHSFHVNFEDNDNR

SEQ ID NO: 34615 - protein, 14 aa, Homo sapiens
ESISVSSEQLAQFR

SEQ ID NO: 34616 - protein, 9 aa, Homo sapiens
GGPFSDSYR

SEQ ID NO: 34617 - protein, 18 aa, Homo sapiens
HDTSLKPISVSYNPATAK

SEQ ID NO: 34618 - protein, 16 aa, Homo sapiens
LYPIANGNNQSPVDIK

SEQ ID NO: 34619 - protein, 21 aa, Homo sapiens
LYPIANGNNQSPVDIKTSETK

SEQ ID NO: 34620 - protein, 8 aa, Homo sapiens
NGPEQWSK

SEQ ID NO: 34621 - protein, 12 aa, Homo sapiens
SFHVNFEDNDNR

SEQ ID NO: 34622 - protein, 25 aa, Homo sapiens
SLLSNVEGDNAVPMQHNNRPTQPLK

SEQ ID NO: 34623 - protein, 23 aa, Homo sapiens
TSETKHDTSLKPISVSYNPATAK

SEQ ID NO: 34624 - protein, 10 aa, Homo sapiens
VGEANPKLQK

SEQ ID NO: 34625 - protein, 9 aa, Homo sapiens
VLDALQAIK

SEQ ID NO: 34626 - protein, 11 aa, Homo sapiens
YSAELHVAHWN

SEQ ID NO: 34627 - protein, 14 aa, Homo sapiens
YSAELHVAHWNSAK

SEQ ID NO: 34628 - protein, 10 aa, Homo sapiens
YSSLAEAASK

SEQ ID NO: 34629 - protein, 28 aa, Homo sapiens
AAQKADVLTTGAGNPVGDKLNVITVGPR

SEQ ID NO: 34630 - protein, 15 aa, Homo sapiens
ADVLTTGAGNPVGDK

SEQ ID NO: 34631 - protein, 24 aa, Homo sapiens
ADVLTTGAGNPVGDKLNVITVGPR

SEQ ID NO: 34632 - protein, 12 aa, Homo sapiens
AFYVNVLNEEQR

SEQ ID NO: 34633 - protein, 14 aa, Homo sapiens
AFYVNVLNEEQRKR

SEQ ID NO: 34634 - protein, 10 aa, Homo sapiens
AKVFEHIGKK

SEQ ID NO: 34635 - protein, 16 aa, Homo sapiens
AKVFEHIGKKTPIAVR

SEQ ID NO: 34636 - protein, 15 aa, Homo sapiens
FGYFEVTHDITKYSK

SEQ ID NO: 34637 - protein, 13 aa, Homo sapiens
FNTANDDNVTQVR

SEQ ID NO: 34638 - protein, 15 aa, Homo sapiens
FSTVAGESGSADTVR

SEQ ID NO: 34639 - protein, 16 aa, Homo sapiens
GAGAFGYFEVTHDITK

SEQ ID NO: 34640 - protein, 19 aa, Homo sapiens
GAGAFGYFEVTHDITKYSK

SEQ ID NO: 34641 - protein, 18 aa, Homo sapiens
GAGNPVGDKLNVITVGPR

SEQ ID NO: 34642 - protein, 16 aa, Homo sapiens
GNPVGDKLNVITVGPR

SEQ ID NO: 34643 - protein, 19 aa, Homo sapiens
GPLLVQDVVFTDEMAHFDR

SEQ ID NO: 34644 - protein, 14 aa, Homo sapiens
GYFEVTHDITKYSK

SEQ ID NO: 34645 - protein, 23 aa, Homo sapiens
KFYTEDGNWDLVGNNTPIFFIRD

SEQ ID NO: 34646 - protein, 10 aa, Homo sapiens
LCENIAGHLK

SEQ ID NO: 34647 - protein, 9 aa, Homo sapiens
LFAYPDTHR

SEQ ID NO: 34648 - protein, 15 aa, Homo sapiens
LGPNYLHIPVNCPYR

SEQ ID NO: 34649 - protein, 11 aa, Homo sapiens
LSQEDPDYGIR

SEQ ID NO: 34650 - protein, 19 aa, Homo sapiens
NFTEVHPDYGSHIQALLDK

SEQ ID NO: 34651 - protein, 13 aa, Homo sapiens
PASDQMQHWKEQR

SEQ ID NO: 34652 - protein, 14 aa, Homo sapiens
PVGDKLNVITVGPR

SEQ ID NO: 34653 - protein, 14 aa, Homo sapiens
RFNTANDDNVTQVR

SEQ ID NO: 34654 - protein, 17 aa, Homo sapiens
SLRPESLHQVSFLFSDR

SEQ ID NO: 34655 - protein, 19 aa, Homo sapiens
TGAGNPVGDKLNVITVGPR

SEQ ID NO: 34656 - protein, 20 aa, Homo sapiens
TTGAGNPVGDKLNVITVGPR

SEQ ID NO: 34657 - protein, 14 aa, Homo sapiens
VFEHIGKKTPIAVR

SEQ ID NO: 34658 - protein, 8 aa, Homo sapiens
IDDLFSGK

SEQ ID NO: 34659 - protein, 16 aa, Homo sapiens
NNLCPSGSNIISNLFK

SEQ ID NO: 34660 - protein, 20 aa, Homo sapiens
QFYDQALQQAVVDDDANNAK

SEQ ID NO: 34661 - protein, 23 aa, Homo sapiens
TFHETLDCCGSSTLTALTTSVLK

SEQ ID NO: 34662 - protein, 24 aa, Homo sapiens
RDYNSSREDSLQDAWDYVQAQVKC

SEQ ID NO: 34663 - protein, 30 aa, Homo sapiens
KGTSPFMDALTANGTTNIQTSVTGVTASKR

SEQ ID NO: 34664 - protein, 30 aa, Homo sapiens
RETIYPNASLLIQNVTQNDTGFYTLQVIKS

SEQ ID NO: 34665 - protein, 26 aa, Homo sapiens
KGSVVLTCHTNNTGTSFQWIFNNQRL

SEQ ID NO: 34666 - protein, 21 aa, Homo sapiens
FTTLVQDLANAFQQEAQTSGK

SEQ ID NO: 34667 - protein, 21 aa, Homo sapiens
IAQNLDFVNLMAYDFHGSWEK

SEQ ID NO: 34668 - protein, 16 aa, Homo sapiens
VGAPATGSGTPGPFTK

SEQ ID NO: 34669 - protein, 12 aa, Homo sapiens
DDGSAVIWVTFK

SEQ ID NO: 34670 - protein, 16 aa, Homo sapiens
FALITWIGENVSGLQR

SEQ ID NO: 34671 - protein, 20 aa, Homo sapiens
PGEQGAEYQHFIQQCTDDVR

SEQ ID NO: 34672 - protein, 27 aa, Homo sapiens
YDGSTIVPGEQGAEYQHFIQQCTDDVR

SEQ ID NO: 34673 - protein, 18 aa, Homo sapiens
TPTKPSSLNNQLVSVDCK

SEQ ID NO: 34674 - protein, 22 aa, Homo sapiens
TVECPPVQQTACPPDSYETQVR

SEQ ID NO: 34675 - protein, 10 aa, Homo sapiens
AIRHPQYNQR

SEQ ID NO: 34676 - protein, 18 aa, Homo sapiens
AQEGLRPGTLCTVAGWGR

SEQ ID NO: 34677 - protein, 10 aa, Homo sapiens
ENTQQHITAR

SEQ ID NO: 34678 - protein, 8 aa, Homo sapiens
IFGSYDPR

SEQ ID NO: 34679 - protein, 26 aa, Homo sapiens
KAAFKGDSGGPLLCNNVAHGIVSYGK

SEQ ID NO: 34680 - protein, 11 aa, Homo sapiens
NRNVNPVALPR

SEQ ID NO: 34681 - protein, 13 aa, Homo sapiens
TIQNDIMLLQLSR

SEQ ID NO: 34682 - protein, 8 aa, Homo sapiens
FFESHVAR

SEQ ID NO: 34683 - protein, 14 aa, Homo sapiens
ILNTPNCALQIVAR

SEQ ID NO: 34684 - protein, 28 aa, Homo sapiens
ALCELESGIPAAESQIVYAERPLTDNHR

SEQ ID NO: 34685 - protein, 26 aa, Homo sapiens
LAYGAGREDVRPEEIADQELAEALQK

SEQ ID NO: 34686 - protein, 25 aa, Homo sapiens
NVLVIGTTGSQTTFLPEGELPECAR

SEQ ID NO: 34687 - protein, 31 aa, Homo sapiens
ADEVAAAPEQIAADIPEVVVSLAWDESLAPK

SEQ ID NO: 34688 - protein, 9 aa, Homo sapiens
IPACIAGER

SEQ ID NO: 34689 - protein, 16 aa, Homo sapiens
PEVVVSLAWDESLAPK

SEQ ID NO: 34690 - protein, 10 aa, Homo sapiens
RYGTCIYQGR

SEQ ID NO: 34691 - protein, 9 aa, Homo sapiens
YGTCIYQGR

SEQ ID NO: 34692 - protein, 12 aa, Homo sapiens
HLREYQDLLNVK

SEQ ID NO: 34693 - protein, 10 aa, Homo sapiens
SPLSSPVFPR

SEQ ID NO: 34694 - protein, 12 aa, Homo sapiens
IPINCEQQINLK

SEQ ID NO: 34695 - protein, 11 aa, Homo sapiens
LDFSGIEPDIK

SEQ ID NO: 34696 - protein, 27 aa, Homo sapiens
RVLTNMTHEDDVPINCTMVLLHIVSKC

SEQ ID NO: 34697 - protein, 13 aa, Homo sapiens
EHQISPGDFPSLR

SEQ ID NO: 34698 - protein, 30 aa, Homo sapiens
FHEFHSPALEDADFDNKPMVLLVGQYSTGK

SEQ ID NO: 34699 - protein, 27 aa, Homo sapiens
FMCAQLPNPVLDSISIIDTPGILSGEK

SEQ ID NO: 34700 - protein, 11 aa, Homo sapiens
HLIEQDFPGMR

SEQ ID NO: 34701 - protein, 32 aa, Homo sapiens
IGPEPTTDSFIAVMHGPTEGVVPGNALVVDPR

SEQ ID NO: 34702 - protein, 15 aa, Homo sapiens
KKEPELFQTVAEGLR

SEQ ID NO: 34703 - protein, 23 aa, Homo sapiens
LADVDKDGLLDDEEFALANHLIK

SEQ ID NO: 34704 - protein, 9 aa, Homo sapiens
LLPLEEHYR

SEQ ID NO: 34705 - protein, 10 aa, Homo sapiens
VHAYIISSLK

SEQ ID NO: 34706 - protein, 21 aa, Homo sapiens
VKLEGHELPADLPPHLVPPSK

SEQ ID NO: 34707 - protein, 17 aa, Homo sapiens
VYIGSFWSHPLLIPDNR

SEQ ID NO: 34708 - protein, 10 aa, Homo sapiens
AVQVHQDTLR

SEQ ID NO: 34709 - protein, 12 aa, Homo sapiens
NASYNLDPYIQE

SEQ ID NO: 34710 - protein, 14 aa, Homo sapiens
YPHLPCLQVGQEQK

SEQ ID NO: 34711 - protein, 12 aa, Homo sapiens
REPTRQVFAVQR

SEQ ID NO: 34712 - protein, 16 aa, Homo sapiens
RGIASVLQELNVTVVT

SEQ ID NO: 34713 - protein, 9 aa, Homo sapiens
RSNVCTLVR

SEQ ID NO: 34714 - protein, 10 aa, Homo sapiens
VVLGAHNLSR

SEQ ID NO: 34715 - protein, 13 aa, Homo sapiens
QELNTLANPFLAK

SEQ ID NO: 34716 - protein, 12 aa, Homo sapiens
SHELPSHPPPSS

SEQ ID NO: 34717 - protein, 11 aa, Homo sapiens
RLNGSAAGHVL

SEQ ID NO: 34718 - protein, 32 aa, Homo sapiens
RLLNLSFCGGISDAGLLHLSHMGSLRSLNLRS

SEQ ID NO: 34719 - protein, 27 aa, Homo sapiens
CISEVQANNVVLGQYVGNPDGEGEATK

SEQ ID NO: 34720 - protein, 11 aa, Homo sapiens
DNIACVILTFK

SEQ ID NO: 34721 - protein, 18 aa, Homo sapiens
DVMQNHLLQMLCLVAMEK

SEQ ID NO: 34722 - protein, 28 aa, Homo sapiens
DVMQNHLLQMLCLVAMEKPASTNSDDVR

SEQ ID NO: 34723 - protein, 31 aa, Homo sapiens
DVMQNHLLQMLCLVAMEKPASTNSDDVRDEK

SEQ ID NO: 34724 - protein, 11 aa, Homo sapiens
GGYFDEFGIIR

SEQ ID NO: 34725 - protein, 10 aa, Homo sapiens
GPTEADELMK

SEQ ID NO: 34726 - protein, 7 aa, Homo sapiens
IDHYLGK

SEQ ID NO: 34727 - protein, 15 aa, Homo sapiens
IFTPLLHQIELEKPK

SEQ ID NO: 34728 - protein, 19 aa, Homo sapiens
IFTPLLHQIELEKPKPIPY

SEQ ID NO: 34729 - protein, 20 aa, Homo sapiens
KPGMFFNPEESELDLTYGNR

SEQ ID NO: 34730 - protein, 16 aa, Homo sapiens
LFYLALPPTVYEAVTK

SEQ ID NO: 34731 - protein, 15 aa, Homo sapiens
LILDVFCGSQMHFVR

SEQ ID NO: 34732 - protein, 16 aa, Homo sapiens
LQFHDVAGDIFHQQCK

SEQ ID NO: 34733 - protein, 10 aa, Homo sapiens
LSNHISSLFR

SEQ ID NO: 34734 - protein, 14 aa, Homo sapiens
NIHESCMSQIGWNR

SEQ ID NO: 34735 - protein, 16 aa, Homo sapiens
NSYVAGQYDDAASYQR

SEQ ID NO: 34736 - protein, 7 aa, Homo sapiens
RNELVIR

SEQ ID NO: 34737 - protein, 8 aa, Homo sapiens
TQVCGILR

SEQ ID NO: 34738 - protein, 10 aa, Homo sapiens
VQPNEAVYTK

SEQ ID NO: 34739 - protein, 17 aa, Homo sapiens
AASSSSPGSPVASSPSR

SEQ ID NO: 34740 - protein, 22 aa, Homo sapiens
EEISAQVLLSLRILLLMKPSVL

SEQ ID NO: 34741 - protein, 16 aa, Homo sapiens
SAEHTLVDMVQLLFTR

SEQ ID NO: 34742 - protein, 37 aa, Homo sapiens
TNAANIHSGDDWATLFTLLECIGSGVKPPAALQATAR

SEQ ID NO: 34743 - protein, 14 aa, Homo sapiens
VSHQVAYGLHELLK

SEQ ID NO: 34744 - protein, 14 aa, Homo sapiens
FLVFVANFDENDPK

SEQ ID NO: 34745 - protein, 10 aa, Homo sapiens
IICILSHPIK

SEQ ID NO: 34746 - protein, 13 aa, Homo sapiens
MAGTAFDFENMKR

SEQ ID NO: 34747 - protein, 24 aa, Homo sapiens
MAGTAFDFENMKRKQNDVFGEAEQ

SEQ ID NO: 34748 - protein, 15 aa, Homo sapiens
TDDYLDQPCLETVNR

SEQ ID NO: 34749 - protein, 13 aa, Homo sapiens
EIYTHFTCATDTK

SEQ ID NO: 34750 - protein, 18 aa, Homo sapiens
ITHSPLTICFPEYTGANK

SEQ ID NO: 34751 - protein, 13 aa, Homo sapiens
LWADHGVQACFGR

SEQ ID NO: 34752 - protein, 24 aa, Homo sapiens
QLFALSCTAEEQGVLPDDLSGVIR

SEQ ID NO: 34753 - protein, 12 aa, Homo sapiens
TTGIVETHFTFK

SEQ ID NO: 34754 - protein, 15 aa, Homo sapiens
APAHLSLPDPQALKR

SEQ ID NO: 34755 - protein, 14 aa, Homo sapiens
CPDGSTCCELPSGK

SEQ ID NO: 34756 - protein, 8 aa, Homo sapiens
HCCPAGFR

SEQ ID NO: 34757 - protein, 33 aa, Homo sapiens
KYGCCPMPNATCCSDHLHCCPQDTVCDLIQSKC

SEQ ID NO: 34758 - protein, 13 aa, Homo sapiens
QHCCPAGYTCNVK

SEQ ID NO: 34759 - protein, 7 aa, Homo sapiens
SPHVGVK

SEQ ID NO: 34760 - protein, 16 aa, Homo sapiens
SRCPDGSTCCELPSGK

SEQ ID NO: 34761 - protein, 16 aa, Homo sapiens
VHCCPHGAFCDLVHTR

SEQ ID NO: 34762 - protein, 19 aa, Homo sapiens
AAYQKVVAGVANALAHKYH

SEQ ID NO: 34763 - protein, 13 aa, Homo sapiens
AFSDGLAHLDNLK

SEQ ID NO: 34764 - protein, 10 aa, Homo sapiens
AGVANALAHK

SEQ ID NO: 34765 - protein, 12 aa, Homo sapiens
AGVANALAHKYH

SEQ ID NO: 34766 - protein, 10 aa, Homo sapiens
AHGKKVLGAF

SEQ ID NO: 34767 - protein, 12 aa, Homo sapiens
AHGKKVLGAFSD

SEQ ID NO: 34768 - protein, 18 aa, Homo sapiens
AHGKKVLGAFSDGLAHLD

SEQ ID NO: 34769 - protein, 19 aa, Homo sapiens
AHGKKVLGAFSDGLAHLDN

SEQ ID NO: 34770 - protein, 20 aa, Homo sapiens
AHGKKVLGAFSDGLAHLDNL

SEQ ID NO: 34771 - protein, 21 aa, Homo sapiens
AHGKKVLGAFSDGLAHLDNLK

SEQ ID NO: 34772 - protein, 22 aa, Homo sapiens
AHGKKVLGAFSDGLAHLDNLKG

SEQ ID NO: 34773 - protein, 24 aa, Homo sapiens
AHGKKVLGAFSDGLAHLDNLKGTF

SEQ ID NO: 34774 - protein, 25 aa, Homo sapiens
AHGKKVLGAFSDGLAHLDNLKGTFA

SEQ ID NO: 34775 - protein, 27 aa, Homo sapiens
AHGKKVLGAFSDGLAHLDNLKGTFATL

SEQ ID NO: 34776 - protein, 28 aa, Homo sapiens
AHGKKVLGAFSDGLAHLDNLKGTFATLS

SEQ ID NO: 34777 - protein, 31 aa, Homo sapiens
AHGKKVLGAFSDGLAHLDNLKGTFATLSELH

SEQ ID NO: 34778 - protein, 18 aa, Homo sapiens
AHHFGKEFTPPVQAAYQK

SEQ ID NO: 34779 - protein, 18 aa, Homo sapiens
ALWGKVNVDEVGGEALGR

SEQ ID NO: 34780 - protein, 18 aa, Homo sapiens
AYQKVVAGVANALAHKYH

SEQ ID NO: 34781 - protein, 10 aa, Homo sapiens
DGLAHLDNLK

SEQ ID NO: 34782 - protein, 15 aa, Homo sapiens
DLSTPDAVMGNPKVK

SEQ ID NO: 34783 - protein, 12 aa, Homo sapiens
EFTPPVQAAYQK

SEQ ID NO: 34784 - protein, 17 aa, Homo sapiens
ESFGDLSTPDAVMGNPK

SEQ ID NO: 34785 - protein, 18 aa, Homo sapiens
FESFGDLSTPDAVMGNPK

SEQ ID NO: 34786 - protein, 19 aa, Homo sapiens
FFESFGDLSTPDAVMGNPK

SEQ ID NO: 34787 - protein, 21 aa, Homo sapiens
FFESFGDLSTPDAVMGNPKVK

SEQ ID NO: 34788 - protein, 25 aa, Homo sapiens
FFESFGDLSTPDAVMGNPKVKAHGK

SEQ ID NO: 34789 - protein, 26 aa, Homo sapiens
FFESFGDLSTPDAVMGNPKVKAHGKK

SEQ ID NO: 34790 - protein, 15 aa, Homo sapiens
FGDLSTPDAVMGNPK

SEQ ID NO: 34791 - protein, 17 aa, Homo sapiens
FGDLSTPDAVMGNPKVK

SEQ ID NO: 34792 - protein, 12 aa, Homo sapiens
FSDGLAHLDNLK

SEQ ID NO: 34793 - protein, 14 aa, Homo sapiens
GAFSDGLAHLDNLK

SEQ ID NO: 34794 - protein, 14 aa, Homo sapiens
GDLSTPDAVMGNPK

SEQ ID NO: 34795 - protein, 14 aa, Homo sapiens
GKEFTPPVQAAYQK

SEQ ID NO: 34796 - protein, 15 aa, Homo sapiens
GKVNVDEVGGEALGR

SEQ ID NO: 34797 - protein, 12 aa, Homo sapiens
GRLLVVYPWTQR

SEQ ID NO: 34798 - protein, 13 aa, Homo sapiens
GTFATLSELHCDK

SEQ ID NO: 34799 - protein, 22 aa, Homo sapiens
GTFATLSELHCDKLHVDPENFR

SEQ ID NO: 34800 - protein, 11 aa, Homo sapiens
GVANALAHKYH

SEQ ID NO: 34801 - protein, 16 aa, Homo sapiens
HFGKEFTPPVQAAYQK

SEQ ID NO: 34802 - protein, 7 aa, Homo sapiens
HLTPEEK

SEQ ID NO: 34803 - protein, 8 aa, Homo sapiens
HVDPENFR

SEQ ID NO: 34804 - protein, 10 aa, Homo sapiens
KLHVDPENFR

SEQ ID NO: 34805 - protein, 23 aa, Homo sapiens
KSAVTALWGKVNVDEVGGEALGR

SEQ ID NO: 34806 - protein, 14 aa, Homo sapiens
KVLGAFSDGLAHLD

SEQ ID NO: 34807 - protein, 15 aa, Homo sapiens
KVLGAFSDGLAHLDN

SEQ ID NO: 34808 - protein, 16 aa, Homo sapiens
KVLGAFSDGLAHLDNL

SEQ ID NO: 34809 - protein, 17 aa, Homo sapiens
KVLGAFSDGLAHLDNLK

SEQ ID NO: 34810 - protein, 18 aa, Homo sapiens
KVLGAFSDGLAHLDNLKG

SEQ ID NO: 34811 - protein, 20 aa, Homo sapiens
KVLGAFSDGLAHLDNLKGTF

SEQ ID NO: 34812 - protein, 21 aa, Homo sapiens
KVLGAFSDGLAHLDNLKGTFA

SEQ ID NO: 34813 - protein, 23 aa, Homo sapiens
KVLGAFSDGLAHLDNLKGTFATL

SEQ ID NO: 34814 - protein, 27 aa, Homo sapiens
KVLGAFSDGLAHLDNLKGTFATLSELH

SEQ ID NO: 34815 - protein, 14 aa, Homo sapiens
KVNVDEVGGEALGR

SEQ ID NO: 34816 - protein, 15 aa, Homo sapiens
KVVAGVANALAHKYH

SEQ ID NO: 34817 - protein, 15 aa, Homo sapiens
LGAFSDGLAHLDNLK

SEQ ID NO: 34818 - protein, 9 aa, Homo sapiens
LHVDPENFR

SEQ ID NO: 34819 - protein, 16 aa, Homo sapiens
LLGNVLVCVLAHHFGK

SEQ ID NO: 34820 - protein, 10 aa, Homo sapiens
LLVVYPWTQR

SEQ ID NO: 34821 - protein, 22 aa, Homo sapiens
LLVVYPWTQRFFESFGDLSTPD

SEQ ID NO: 34822 - protein, 27 aa, Homo sapiens
LLVVYPWTQRFFESFGDLSTPDAVMGN

SEQ ID NO: 34823 - protein, 29 aa, Homo sapiens
LLVVYPWTQRFFESFGDLSTPDAVMGNPK

SEQ ID NO: 34824 - protein, 31 aa, Homo sapiens
LLVVYPWTQRFFESFGDLSTPDAVMGNPKVK

SEQ ID NO: 34825 - protein, 35 aa, Homo sapiens
LLVVYPWTQRFFESFGDLSTPDAVMGNPKVKAHGK

SEQ ID NO: 34826 - protein, 12 aa, Homo sapiens
LSTPDAVMGNPK

SEQ ID NO: 34827 - protein, 15 aa, Homo sapiens
LTPEEKSAVTALWGK

SEQ ID NO: 34828 - protein, 28 aa, Homo sapiens
LTPEEKSAVTALWGKVNVDEVGGEALGR

SEQ ID NO: 34829 - protein, 17 aa, Homo sapiens
LWGKVNVDEVGGEALGR

SEQ ID NO: 34830 - protein, 31 aa, Homo sapiens
MVHLTPEEKSAVTALWGKVNVDEVGGEALGR

SEQ ID NO: 34831 - protein, 9 aa, Homo sapiens
PDAVMGNPK

SEQ ID NO: 34832 - protein, 15 aa, Homo sapiens
PDAVMGNPKVKAHGK

SEQ ID NO: 34833 - protein, 13 aa, Homo sapiens
PEEKSAVTALWGK

SEQ ID NO: 34834 - protein, 26 aa, Homo sapiens
PEEKSAVTALWGKVNVDEVGGEALGR

SEQ ID NO: 34835 - protein, 24 aa, Homo sapiens
PWTQRFFESFGDLSTPDAVMGNPK

SEQ ID NO: 34836 - protein, 26 aa, Homo sapiens
PWTQRFFESFGDLSTPDAVMGNPKVK

SEQ ID NO: 34837 - protein, 20 aa, Homo sapiens
RFFESFGDLSTPDAVMGNPK

SEQ ID NO: 34838 - protein, 9 aa, Homo sapiens
SAVTALWGK

SEQ ID NO: 34839 - protein, 22 aa, Homo sapiens
SAVTALWGKVNVDEVGGEALGR

SEQ ID NO: 34840 - protein, 11 aa, Homo sapiens
SDGLAHLDNLK

SEQ ID NO: 34841 - protein, 16 aa, Homo sapiens
SELHCDKLHVDPENFR

SEQ ID NO: 34842 - protein, 16 aa, Homo sapiens
SFGDLSTPDAVMGNPK

SEQ ID NO: 34843 - protein, 18 aa, Homo sapiens
SFGDLSTPDAVMGNPKVK

SEQ ID NO: 34844 - protein, 19 aa, Homo sapiens
TALWGKVNVDEVGGEALGR

SEQ ID NO: 34845 - protein, 14 aa, Homo sapiens
TPEEKSAVTALWGK

SEQ ID NO: 34846 - protein, 27 aa, Homo sapiens
TPEEKSAVTALWGKVNVDEVGGEALGR

SEQ ID NO: 34847 - protein, 11 aa, Homo sapiens
VAGVANALAHK

SEQ ID NO: 34848 - protein, 13 aa, Homo sapiens
VAGVANALAHKYH

SEQ ID NO: 34849 - protein, 11 aa, Homo sapiens
VDEVGGEALGR

SEQ ID NO: 34850 - protein, 8 aa, Homo sapiens
VHLTPEEK

SEQ ID NO: 34851 - protein, 17 aa, Homo sapiens
VHLTPEEKSAVTALWGK

SEQ ID NO: 34852 - protein, 30 aa, Homo sapiens
VHLTPEEKSAVTALWGKVNVDEVGGEALGR

SEQ ID NO: 34853 - protein, 16 aa, Homo sapiens
VKAHGKKVLGAFSDGL

SEQ ID NO: 34854 - protein, 19 aa, Homo sapiens
VKAHGKKVLGAFSDGLAHL

SEQ ID NO: 34855 - protein, 21 aa, Homo sapiens
VKAHGKKVLGAFSDGLAHLDN

SEQ ID NO: 34856 - protein, 22 aa, Homo sapiens
VKAHGKKVLGAFSDGLAHLDNL

SEQ ID NO: 34857 - protein, 23 aa, Homo sapiens
VKAHGKKVLGAFSDGLAHLDNLK

SEQ ID NO: 34858 - protein, 24 aa, Homo sapiens
VKAHGKKVLGAFSDGLAHLDNLKG

SEQ ID NO: 34859 - protein, 26 aa, Homo sapiens
VKAHGKKVLGAFSDGLAHLDNLKGTF

SEQ ID NO: 34860 - protein, 27 aa, Homo sapiens
VKAHGKKVLGAFSDGLAHLDNLKGTFA

SEQ ID NO: 34861 - protein, 33 aa, Homo sapiens
VKAHGKKVLGAFSDGLAHLDNLKGTFATLSELH

SEQ ID NO: 34862 - protein, 20 aa, Homo sapiens
VLAHHFGKEFTPPVQAAYQK

SEQ ID NO: 34863 - protein, 12 aa, Homo sapiens
VLGAFSDGLAHL

SEQ ID NO: 34864 - protein, 13 aa, Homo sapiens
VLGAFSDGLAHLD

SEQ ID NO: 34865 - protein, 14 aa, Homo sapiens
VLGAFSDGLAHLDN

SEQ ID NO: 34866 - protein, 15 aa, Homo sapiens
VLGAFSDGLAHLDNL

SEQ ID NO: 34867 - protein, 16 aa, Homo sapiens
VLGAFSDGLAHLDNLK

SEQ ID NO: 34868 - protein, 26 aa, Homo sapiens
VLGAFSDGLAHLDNLKGTFATLSELH

SEQ ID NO: 34869 - protein, 13 aa, Homo sapiens
VNVDEVGGEALGR

SEQ ID NO: 34870 - protein, 11 aa, Homo sapiens
VVAGVANALAH

SEQ ID NO: 34871 - protein, 12 aa, Homo sapiens
VVAGVANALAHK

SEQ ID NO: 34872 - protein, 13 aa, Homo sapiens
VVAGVANALAHKY

SEQ ID NO: 34873 - protein, 14 aa, Homo sapiens
VVAGVANALAHKYH

SEQ ID NO: 34874 - protein, 29 aa, Homo sapiens
VVYPWTQRFFESFGDLSTPDAVMGNPKVK

SEQ ID NO: 34875 - protein, 26 aa, Homo sapiens
VYPWTQRFFESFGDLSTPDAVMGNPK

SEQ ID NO: 34876 - protein, 28 aa, Homo sapiens
VYPWTQRFFESFGDLSTPDAVMGNPKVK

SEQ ID NO: 34877 - protein, 16 aa, Homo sapiens
WGKVNVDEVGGEALGR

SEQ ID NO: 34878 - protein, 25 aa, Homo sapiens
YPWTQRFFESFGDLSTPDAVMGNPK

SEQ ID NO: 34879 - protein, 27 aa, Homo sapiens
YPWTQRFFESFGDLSTPDAVMGNPKVK

SEQ ID NO: 34880 - protein, 27 aa, Homo sapiens
AHGKKVLGAFSDGLAHLDNLKGTFSQL

SEQ ID NO: 34881 - protein, 13 aa, Homo sapiens
DLSSPDAVMGNPK

SEQ ID NO: 34882 - protein, 19 aa, Homo sapiens
FFESFGDLSSPDAVMGNPK

SEQ ID NO: 34883 - protein, 26 aa, Homo sapiens
FFESFGDLSSPDAVMGNPKVKAHGKK

SEQ ID NO: 34884 - protein, 22 aa, Homo sapiens
GTFSQLSELHCDKLHVDPENFR

SEQ ID NO: 34885 - protein, 31 aa, Homo sapiens
LLVVYPWTQRFFESFGDLSSPDAVMGNPKVK

SEQ ID NO: 34886 - protein, 16 aa, Homo sapiens
NFGKEFTPQMQAAYQK

SEQ ID NO: 34887 - protein, 9 aa, Homo sapiens
TAVNALWGK

SEQ ID NO: 34888 - protein, 22 aa, Homo sapiens
TAVNALWGKVNVDAVGGEALGR

SEQ ID NO: 34889 - protein, 17 aa, Homo sapiens
VHLTPEEKTAVNALWGK

SEQ ID NO: 34890 - protein, 30 aa, Homo sapiens
VHLTPEEKTAVNALWGKVNVDAVGGEALGR

SEQ ID NO: 34891 - protein, 26 aa, Homo sapiens
VLGAFSDGLAHLDNLKGTFSQLSELH

SEQ ID NO: 34892 - protein, 13 aa, Homo sapiens
VNVDAVGGEALGR

SEQ ID NO: 34893 - protein, 24 aa, Homo sapiens
AEEITSDAAYVIQDLATLFEELQR

SEQ ID NO: 34894 - protein, 13 aa, Homo sapiens
ITKPFFAAISDEK

SEQ ID NO: 34895 - protein, 20 aa, Homo sapiens
KPFPHLCNVPDLITILHGIS

SEQ ID NO: 34896 - protein, 13 aa, Homo sapiens
NSHCAQTVSSVFK

SEQ ID NO: 34897 - protein, 12 aa, Homo sapiens
SLSNPLNCSVKT

SEQ ID NO: 34898 - protein, 25 aa, Homo sapiens
VVETLPHFISPYLEGILSQVIHLEK

SEQ ID NO: 34899 - protein, 19 aa, Homo sapiens
DQDILDLVGVLHDPETLLR

SEQ ID NO: 34900 - protein, 12 aa, Homo sapiens
ENPHDAVVFHPK

SEQ ID NO: 34901 - protein, 12 aa, Homo sapiens
FVGKTLETLPEK

SEQ ID NO: 34902 - protein, 20 aa, Homo sapiens
GPQLAAQNLGISLANLLLSK

SEQ ID NO: 34903 - protein, 16 aa, Homo sapiens
IKSEHPGLSIGDTAKK

SEQ ID NO: 34904 - protein, 12 aa, Homo sapiens
KLGEMWSEQSAK

SEQ ID NO: 34905 - protein, 11 aa, Homo sapiens
LGEMWSEQSAK

SEQ ID NO: 34906 - protein, 16 aa, Homo sapiens
RPPSAFFLFCSEHRPK

SEQ ID NO: 34907 - protein, 13 aa, Homo sapiens
SEHPGLSIGDTAK

SEQ ID NO: 34908 - protein, 14 aa, Homo sapiens
ALSRQEMQEVQSSR

SEQ ID NO: 34909 - protein, 9 aa, Homo sapiens
EDTEEHHLR

SEQ ID NO: 34910 - protein, 13 aa, Homo sapiens
EESGKPGAHVTVK

SEQ ID NO: 34911 - protein, 15 aa, Homo sapiens
GFGFVTFDDHDPVDK

SEQ ID NO: 34912 - protein, 15 aa, Homo sapiens
GGGGNFGPGPGSNFR

SEQ ID NO: 34913 - protein, 10 aa, Homo sapiens
GGNFGFGDSR

SEQ ID NO: 34914 - protein, 17 aa, Homo sapiens
KLFIGGLSFETTEESLR

SEQ ID NO: 34915 - protein, 16 aa, Homo sapiens
LFIGGLSFETTEESLR

SEQ ID NO: 34916 - protein, 16 aa, Homo sapiens
LFVGGIKEDTEEHHLR

SEQ ID NO: 34917 - protein, 16 aa, Homo sapiens
RGFGFVTFDDHDPVDK

SEQ ID NO: 34918 - protein, 12 aa, Homo sapiens
YHTINGHNAEVR

SEQ ID NO: 34919 - protein, 6 aa, Homo sapiens
FNEEVK

SEQ ID NO: 34920 - protein, 26 aa, Homo sapiens
RAKWDTANNPLYKEATSTFTNITYRG

SEQ ID NO: 34921 - protein, 18 aa, Homo sapiens
RDLPEELSLSFNATCLNN

SEQ ID NO: 34922 - protein, 16 aa, Homo sapiens
RLRPDDSKNFSIQVRQ

SEQ ID NO: 34923 - protein, 25 aa, Homo sapiens
VLEDRPLSDKGSGDSSQVTQVSPQR

SEQ ID NO: 34924 - protein, 32 aa, Homo sapiens
KLREQVNSMVDISKMHMILYDLQQNLSSSHRA

SEQ ID NO: 34925 - protein, 24 aa, Homo sapiens
AEDSICLADSKPLPHQNVTNHVGK

SEQ ID NO: 34926 - protein, 14 aa, Homo sapiens
ALQHCEELIQQYNR

SEQ ID NO: 34927 - protein, 12 aa, Homo sapiens
RPESPSEISPIK

SEQ ID NO: 34928 - protein, 12 aa, Homo sapiens
ELTSELKENFIR

SEQ ID NO: 34929 - protein, 6 aa, Homo sapiens
ITLYGR

SEQ ID NO: 34930 - protein, 12 aa, Homo sapiens
KSYNVTSVLFRK

SEQ ID NO: 34931 - protein, 9 aa, Homo sapiens
MYATIYELK

SEQ ID NO: 34932 - protein, 21 aa, Homo sapiens
SLGLPENHIVFPVPIDQCIDG

SEQ ID NO: 34933 - protein, 10 aa, Homo sapiens
SYNVTSVLFR

SEQ ID NO: 34934 - protein, 11 aa, Homo sapiens
SYPGLTSYLVR

SEQ ID NO: 34935 - protein, 17 aa, Homo sapiens
TFVPGCQPGEFTLGNIK

SEQ ID NO: 34936 - protein, 9 aa, Homo sapiens
TKELTSELK

SEQ ID NO: 34937 - protein, 15 aa, Homo sapiens
VPLQQNFQDNQFQGK

SEQ ID NO: 34938 - protein, 15 aa, Homo sapiens
VVSTNYNQHAMVFFK

SEQ ID NO: 34939 - protein, 13 aa, Homo sapiens
WYVVGLAGNAILR

SEQ ID NO: 34940 - protein, 10 aa, Homo sapiens
AECMLQQAER

SEQ ID NO: 34941 - protein, 12 aa, Homo sapiens
AYYHLLEQVAPK

SEQ ID NO: 34942 - protein, 10 aa, Homo sapiens
EGESLEDLMK

SEQ ID NO: 34943 - protein, 26 aa, Homo sapiens
EGICAIGGTSEQSSVGTQHSYSEEEK

SEQ ID NO: 34944 - protein, 17 aa, Homo sapiens
EITENLMATGDLDQDGR

SEQ ID NO: 34945 - protein, 16 aa, Homo sapiens
FSLVGIGGQDLNEGNR

SEQ ID NO: 34946 - protein, 17 aa, Homo sapiens
GDEEGVPAVVIDMSGLR

SEQ ID NO: 34947 - protein, 12 aa, Homo sapiens
GSVSDEEMMELR

SEQ ID NO: 34948 - protein, 24 aa, Homo sapiens
HVIPMNPNTNDLFNAVGDGIVLCK

SEQ ID NO: 34949 - protein, 9 aa, Homo sapiens
IGNFSTDIK

SEQ ID NO: 34950 - protein, 12 aa, Homo sapiens
IGNFSTDIKDSK

SEQ ID NO: 34951 - protein, 9 aa, Homo sapiens
IKVPVDWNR

SEQ ID NO: 34952 - protein, 10 aa, Homo sapiens
ILEEIGGGQK

SEQ ID NO: 34953 - protein, 8 aa, Homo sapiens
ISFDEFIK

SEQ ID NO: 34954 - protein, 25 aa, Homo sapiens
ISTSLPVLDLIDAIQPGSINYDLLK

SEQ ID NO: 34955 - protein, 13 aa, Homo sapiens
KLENCNYAVELGK

SEQ ID NO: 34956 - protein, 12 aa, Homo sapiens
LNLAFIANLFNR

SEQ ID NO: 34957 - protein, 9 aa, Homo sapiens
LSPEELLLR

SEQ ID NO: 34958 - protein, 7 aa, Homo sapiens
LVEVNPK

SEQ ID NO: 34959 - protein, 13 aa, Homo sapiens
MINLSVPDTIDER

SEQ ID NO: 34960 - protein, 9 aa, Homo sapiens
NEALIALLR

SEQ ID NO: 34961 - protein, 11 aa, Homo sapiens
NWMNSLGVNPR

SEQ ID NO: 34962 - protein, 10 aa, Homo sapiens
QFVTATDVVR

SEQ ID NO: 34963 - protein, 32 aa, Homo sapiens
RRYTLNILEEIGGGQKVNDDIIVNWVNETLRE

SEQ ID NO: 34964 - protein, 14 aa, Homo sapiens
TENLNDDEKLNNAK

SEQ ID NO: 34965 - protein, 29 aa, Homo sapiens
TIQENLNLALNSASAIGCHVVNIGAEDLK

SEQ ID NO: 34966 - protein, 19 aa, Homo sapiens
VDTDGNGYISFNELNDLFK

SEQ ID NO: 34967 - protein, 15 aa, Homo sapiens
VNDDIIVNWVNETLR

SEQ ID NO: 34968 - protein, 20 aa, Homo sapiens
VNHLYSDLSDALVIFQLYEK

SEQ ID NO: 34969 - protein, 14 aa, Homo sapiens
VYALPEDLVEVNPK

SEQ ID NO: 34970 - protein, 13 aa, Homo sapiens
WANYHLENAGCNK

SEQ ID NO: 34971 - protein, 9 aa, Homo sapiens
YAFVNWINK

SEQ ID NO: 34972 - protein, 7 aa, Homo sapiens
YAISMAR

SEQ ID NO: 34973 - protein, 22 aa, Homo sapiens
YPALHKPENQDIDWGALEGETR

SEQ ID NO: 34974 - protein, 14 aa, Homo sapiens
YTLNILEEIGGGQK

SEQ ID NO: 34975 - protein, 18 aa, Homo sapiens
DIQVTQSPSSLSASVGDR

SEQ ID NO: 34976 - protein, 15 aa, Homo sapiens
LIYAASSLQSGVPSR

SEQ ID NO: 34977 - protein, 16 aa, Homo sapiens
LLIYAASSLQSGVPSR

SEQ ID NO: 34978 - protein, 12 aa, Homo sapiens
SPSSLSASVGDR

SEQ ID NO: 34979 - protein, 7 aa, Homo sapiens
ASGVPDR

SEQ ID NO: 34980 - protein, 20 aa, Homo sapiens
ASGVPDRFSGSGSGTDFTLK

SEQ ID NO: 34981 - protein, 23 aa, Homo sapiens
ASGVPDRFSGSGSGTDFTLKISR

SEQ ID NO: 34982 - protein, 24 aa, Homo sapiens
DIVMTQTPLSLPVTPGEPASISCR

SEQ ID NO: 34983 - protein, 13 aa, Homo sapiens
FSGSGSGTDFTLK

SEQ ID NO: 34984 - protein, 16 aa, Homo sapiens
FSGSGSGTDFTLKISR

SEQ ID NO: 34985 - protein, 16 aa, Homo sapiens
PDRFSGSGSGTDFTLK

SEQ ID NO: 34986 - protein, 19 aa, Homo sapiens
PDRFSGSGSGTDFTLKISR

SEQ ID NO: 34987 - protein, 10 aa, Homo sapiens
PGEPASISCR

SEQ ID NO: 34988 - protein, 13 aa, Homo sapiens
PVTPGEPASISCR

SEQ ID NO: 34989 - protein, 26 aa, Homo sapiens
SGDIVMTQTPLSLPVTPGEPASISCR

SEQ ID NO: 34990 - protein, 15 aa, Homo sapiens
SLPVTPGEPASISCR

SEQ ID NO: 34991 - protein, 18 aa, Homo sapiens
TPLSLPVTPGEPASISCR

SEQ ID NO: 34992 - protein, 17 aa, Homo sapiens
APPVAGPSVFLFPPKPK

SEQ ID NO: 34993 - protein, 15 aa, Homo sapiens
AVEWESNGQPENNYK

SEQ ID NO: 34994 - protein, 19 aa, Homo sapiens
CCVECPPCPAPPVAGPSVF

SEQ ID NO: 34995 - protein, 26 aa, Homo sapiens
CCVECPPCPAPPVAGPSVFLFPPKPK

SEQ ID NO: 34996 - protein, 14 aa, Homo sapiens
CKVSNKGLPAPIEK

SEQ ID NO: 34997 - protein, 22 aa, Homo sapiens
CPPCPAPPVAGPSVFLFPPKPK

SEQ ID NO: 34998 - protein, 15 aa, Homo sapiens
CSVMHEALHNHYTQK

SEQ ID NO: 34999 - protein, 25 aa, Homo sapiens
CVECPPCPAPPVAGPSVFLFPPKPK

SEQ ID NO: 35000 - protein, 28 aa, Homo sapiens
CVVVDVSHEDPEVQFNWYVDGMEVHNAK

SEQ ID NO: 35001 - protein, 17 aa, Homo sapiens
DIAVEWESNGQPENNYK

SEQ ID NO: 35002 - protein, 11 aa, Homo sapiens
DSDGSFFLYSK

SEQ ID NO: 35003 - protein, 7 aa, Homo sapiens
DTLMISR

SEQ ID NO: 35004 - protein, 10 aa, Homo sapiens
DYFPEPVTVS

SEQ ID NO: 35005 - protein, 11 aa, Homo sapiens
DYFPEPVTVSW

SEQ ID NO: 35006 - protein, 12 aa, Homo sapiens
DYFPEPVTVSWN

SEQ ID NO: 35007 - protein, 14 aa, Homo sapiens
DYFPEPVTVSWNSG

SEQ ID NO: 35008 - protein, 16 aa, Homo sapiens
DYFPEPVTVSWNSGAL

SEQ ID NO: 35009 - protein, 18 aa, Homo sapiens
DYFPEPVTVSWNSGALTS

SEQ ID NO: 35010 - protein, 21 aa, Homo sapiens
DYFPEPVTVSWNSGALTSGVH

SEQ ID NO: 35011 - protein, 25 aa, Homo sapiens
DYFPEPVTVSWNSGALTSGVHTFPA

SEQ ID NO: 35012 - protein, 27 aa, Homo sapiens
DYFPEPVTVSWNSGALTSGVHTFPAVL

SEQ ID NO: 35013 - protein, 28 aa, Homo sapiens
DYFPEPVTVSWNSGALTSGVHTFPAVLQ

SEQ ID NO: 35014 - protein, 29 aa, Homo sapiens
DYFPEPVTVSWNSGALTSGVHTFPAVLQS

SEQ ID NO: 35015 - protein, 30 aa, Homo sapiens
DYFPEPVTVSWNSGALTSGVHTFPAVLQSS

SEQ ID NO: 35016 - protein, 32 aa, Homo sapiens
DYFPEPVTVSWNSGALTSGVHTFPAVLQSSGL

SEQ ID NO: 35017 - protein, 33 aa, Homo sapiens
DYFPEPVTVSWNSGALTSGVHTFPAVLQSSGLY

SEQ ID NO: 35018 - protein, 34 aa, Homo sapiens
DYFPEPVTVSWNSGALTSGVHTFPAVLQSSGLYS

SEQ ID NO: 35019 - protein, 35 aa, Homo sapiens
DYFPEPVTVSWNSGALTSGVHTFPAVLQSSGLYSL

SEQ ID NO: 35020 - protein, 36 aa, Homo sapiens
DYFPEPVTVSWNSGALTSGVHTFPAVLQSSGLYSLS

SEQ ID NO: 35021 - protein, 37 aa, Homo sapiens
DYFPEPVTVSWNSGALTSGVHTFPAVLQSSGLYSLSS

SEQ ID NO: 35022 - protein, 10 aa, Homo sapiens
EALHNHYTQK

SEQ ID NO: 35023 - protein, 15 aa, Homo sapiens
EEMTKNQVSLTCLVK

SEQ ID NO: 35024 - protein, 9 aa, Homo sapiens
EEQFNSTFR

SEQ ID NO: 35025 - protein, 25 aa, Homo sapiens
EEQFNSTFRVVSVLTVVHQDWLNGK

SEQ ID NO: 35026 - protein, 11 aa, Homo sapiens
EPQVYTLPPSR

SEQ ID NO: 35027 - protein, 16 aa, Homo sapiens
EPQVYTLPPSREEMTK

SEQ ID NO: 35028 - protein, 26 aa, Homo sapiens
EPQVYTLPPSREEMTKNQVSLTCLVK

SEQ ID NO: 35029 - protein, 8 aa, Homo sapiens
EQFNSTFR

SEQ ID NO: 35030 - protein, 11 aa, Homo sapiens
ESNGQPENNYK

SEQ ID NO: 35031 - protein, 18 aa, Homo sapiens
FGTQTYTCNVDHKPSNTK

SEQ ID NO: 35032 - protein, 25 aa, Homo sapiens
FGTQTYTCNVDHKPSNTKVDKTVER

SEQ ID NO: 35033 - protein, 8 aa, Homo sapiens
FPLAPCSR

SEQ ID NO: 35034 - protein, 17 aa, Homo sapiens
FSCSVMHEALHNHYTQK

SEQ ID NO: 35035 - protein, 21 aa, Homo sapiens
FYPSDIAVEWESNGQPENNYK

SEQ ID NO: 35036 - protein, 13 aa, Homo sapiens
GFYPSDIAVEWES

SEQ ID NO: 35037 - protein, 19 aa, Homo sapiens
GFYPSDIAVEWESNGQPEN

SEQ ID NO: 35038 - protein, 20 aa, Homo sapiens
GFYPSDIAVEWESNGQPENN

SEQ ID NO: 35039 - protein, 22 aa, Homo sapiens
GFYPSDIAVEWESNGQPENNYK

SEQ ID NO: 35040 - protein, 8 aa, Homo sapiens
GLPAPIEK

SEQ ID NO: 35041 - protein, 12 aa, Homo sapiens
GLPAPIEKTISK

SEQ ID NO: 35042 - protein, 14 aa, Homo sapiens
GLPAPIEKTISKTK

SEQ ID NO: 35043 - protein, 18 aa, Homo sapiens
GLPAPIEKTISKTKGQPR

SEQ ID NO: 35044 - protein, 20 aa, Homo sapiens
GNVFSCSVMHEALHNHYTQK

SEQ ID NO: 35045 - protein, 12 aa, Homo sapiens
GPSVFLFPPKPK

SEQ ID NO: 35046 - protein, 12 aa, Homo sapiens
GPSVFPLAPCSR

SEQ ID NO: 35047 - protein, 9 aa, Homo sapiens
GQPREPQVY

SEQ ID NO: 35048 - protein, 15 aa, Homo sapiens
GQPREPQVYTLPPSR

SEQ ID NO: 35049 - protein, 20 aa, Homo sapiens
GQPREPQVYTLPPSREEMTK

SEQ ID NO: 35050 - protein, 30 aa, Homo sapiens
GQPREPQVYTLPPSREEMTKNQVSLTCLVK

SEQ ID NO: 35051 - protein, 8 aa, Homo sapiens
GSFFLYSK

SEQ ID NO: 35052 - protein, 11 aa, Homo sapiens
HEALHNHYTQK

SEQ ID NO: 35053 - protein, 8 aa, Homo sapiens
HQDWLNGK

SEQ ID NO: 35054 - protein, 16 aa, Homo sapiens
IAVEWESNGQPENNYK

SEQ ID NO: 35055 - protein, 15 aa, Homo sapiens
KCCVECPPCPAPPVA

SEQ ID NO: 35056 - protein, 20 aa, Homo sapiens
KCCVECPPCPAPPVAGPSVF

SEQ ID NO: 35057 - protein, 27 aa, Homo sapiens
KCCVECPPCPAPPVAGPSVFLFPPKPK

SEQ ID NO: 35058 - protein, 23 aa, Homo sapiens
KGFYPSDIAVEWESNGQPENNYK

SEQ ID NO: 35059 - protein, 13 aa, Homo sapiens
KGLPAPIEKTISK

SEQ ID NO: 35060 - protein, 12 aa, Homo sapiens
KPREEQFNSTFR

SEQ ID NO: 35061 - protein, 7 aa, Homo sapiens
LTVDKSR

SEQ ID NO: 35062 - protein, 12 aa, Homo sapiens
LTVVHQDWLNGK

SEQ ID NO: 35063 - protein, 15 aa, Homo sapiens
LTVVHQDWLNGKEYK

SEQ ID NO: 35064 - protein, 12 aa, Homo sapiens
MHEALHNHYTQK

SEQ ID NO: 35065 - protein, 19 aa, Homo sapiens
NFGTQTYTCNVDHKPSNTK

SEQ ID NO: 35066 - protein, 10 aa, Homo sapiens
NQVSLTCLVK

SEQ ID NO: 35067 - protein, 11 aa, Homo sapiens
NQVSLTCLVKG

SEQ ID NO: 35068 - protein, 32 aa, Homo sapiens
NQVSLTCLVKGFYPSDIAVEWESNGQPENNYK

SEQ ID NO: 35069 - protein, 10 aa, Homo sapiens
NVDHKPSNTK

SEQ ID NO: 35070 - protein, 19 aa, Homo sapiens
NVFSCSVMHEALHNHYTQK

SEQ ID NO: 35071 - protein, 10 aa, Homo sapiens
PAPIEKTISK

SEQ ID NO: 35072 - protein, 12 aa, Homo sapiens
PAPIEKTISKTK

SEQ ID NO: 35073 - protein, 18 aa, Homo sapiens
PAPPVAGPSVFLFPPKPK

SEQ ID NO: 35074 - protein, 20 aa, Homo sapiens
PCPAPPVAGPSVFLFPPKPK

SEQ ID NO: 35075 - protein, 8 aa, Homo sapiens
PIEKTISK

SEQ ID NO: 35076 - protein, 21 aa, Homo sapiens
PPCPAPPVAGPSVFLFPPKPK

SEQ ID NO: 35077 - protein, 15 aa, Homo sapiens
PPMLDSDGSFFLYSK

SEQ ID NO: 35078 - protein, 16 aa, Homo sapiens
PPVAGPSVFLFPPKPK

SEQ ID NO: 35079 - protein, 10 aa, Homo sapiens
PQVYTLPPSR

SEQ ID NO: 35080 - protein, 11 aa, Homo sapiens
PREEQFNSTFR

SEQ ID NO: 35081 - protein, 18 aa, Homo sapiens
PREPQVYTLPPSREEMTK

SEQ ID NO: 35082 - protein, 19 aa, Homo sapiens
PSDIAVEWESNGQPENNYK

SEQ ID NO: 35083 - protein, 11 aa, Homo sapiens
PSVFLFPPKPK

SEQ ID NO: 35084 - protein, 11 aa, Homo sapiens
PSVFPLAPCSR

SEQ ID NO: 35085 - protein, 15 aa, Homo sapiens
PVAGPSVFLFPPKPK

SEQ ID NO: 35086 - protein, 7 aa, Homo sapiens
QFNSTFR

SEQ ID NO: 35087 - protein, 10 aa, Homo sapiens
QKSLSLSPGK

SEQ ID NO: 35088 - protein, 10 aa, Homo sapiens
REEQFNSTFR

SEQ ID NO: 35089 - protein, 11 aa, Homo sapiens
REEQFNSTFRV

SEQ ID NO: 35090 - protein, 13 aa, Homo sapiens
SCSVMHEALHNHY

SEQ ID NO: 35091 - protein, 16 aa, Homo sapiens
SCSVMHEALHNHYTQK

SEQ ID NO: 35092 - protein, 10 aa, Homo sapiens
SDGSFFLYSK

SEQ ID NO: 35093 - protein, 12 aa, Homo sapiens
SESTAALGCLVK

SEQ ID NO: 35094 - protein, 20 aa, Homo sapiens
SNFGTQTYTCNVDHKPSNTK

SEQ ID NO: 35095 - protein, 25 aa, Homo sapiens
SRWQQGNVFSCSVMHEALHNHYTQK

SEQ ID NO: 35096 - protein, 14 aa, Homo sapiens
STSESTAALGCLVK

SEQ ID NO: 35097 - protein, 10 aa, Homo sapiens
SVFPLAPCSR

SEQ ID NO: 35098 - protein, 14 aa, Homo sapiens
SVLTVVHQDWLNGK

SEQ ID NO: 35099 - protein, 17 aa, Homo sapiens
SVLTVVHQDWLNGKEYK

SEQ ID NO: 35100 - protein, 14 aa, Homo sapiens
SVMHEALHNHYTQK

SEQ ID NO: 35101 - protein, 22 aa, Homo sapiens
TKGQPREPQVYTLPPSREEMTK

SEQ ID NO: 35102 - protein, 13 aa, Homo sapiens
TKPREEQFNSTFR

SEQ ID NO: 35103 - protein, 9 aa, Homo sapiens
TKVDKTVER

SEQ ID NO: 35104 - protein, 13 aa, Homo sapiens
TPEVTCVVVDVSH

SEQ ID NO: 35105 - protein, 14 aa, Homo sapiens
TPEVTCVVVDVSHE

SEQ ID NO: 35106 - protein, 15 aa, Homo sapiens
TPEVTCVVVDVSHED

SEQ ID NO: 35107 - protein, 19 aa, Homo sapiens
TPEVTCVVVDVSHEDPEVQ

SEQ ID NO: 35108 - protein, 33 aa, Homo sapiens
TPEVTCVVVDVSHEDPEVQFNWYVDGMEVHNAK

SEQ ID NO: 35109 - protein, 17 aa, Homo sapiens
TTPPMLDSDGSFFLYSK

SEQ ID NO: 35110 - protein, 11 aa, Homo sapiens
TVVHQDWLNGK

SEQ ID NO: 35111 - protein, 14 aa, Homo sapiens
TVVHQDWLNGKEYK

SEQ ID NO: 35112 - protein, 14 aa, Homo sapiens
TYTCNVDHKPSNTK

SEQ ID NO: 35113 - protein, 17 aa, Homo sapiens
TYTCNVDHKPSNTKVDK

SEQ ID NO: 35114 - protein, 10 aa, Homo sapiens
VDGMEVHNAK

SEQ ID NO: 35115 - protein, 7 aa, Homo sapiens
VDKTVER

SEQ ID NO: 35116 - protein, 8 aa, Homo sapiens
VDKTVERK

SEQ ID NO: 35117 - protein, 14 aa, Homo sapiens
VEWESNGQPENNYK

SEQ ID NO: 35118 - protein, 18 aa, Homo sapiens
VFSCSVMHEALHNHYTQK

SEQ ID NO: 35119 - protein, 13 aa, Homo sapiens
VMHEALHNHYTQK

SEQ ID NO: 35120 - protein, 12 aa, Homo sapiens
VSNKGLPAPIEK

SEQ ID NO: 35121 - protein, 16 aa, Homo sapiens
VSNKGLPAPIEKTISK

SEQ ID NO: 35122 - protein, 18 aa, Homo sapiens
VSNKGLPAPIEKTISKTK

SEQ ID NO: 35123 - protein, 15 aa, Homo sapiens
VSVLTVVHQDWLNGK

SEQ ID NO: 35124 - protein, 11 aa, Homo sapiens
VVSVLTVVHQD

SEQ ID NO: 35125 - protein, 14 aa, Homo sapiens
VVSVLTVVHQDWLN

SEQ ID NO: 35126 - protein, 16 aa, Homo sapiens
VVSVLTVVHQDWLNGK

SEQ ID NO: 35127 - protein, 19 aa, Homo sapiens
VVSVLTVVHQDWLNGKEYK

SEQ ID NO: 35128 - protein, 13 aa, Homo sapiens
VYTLPPSREEMTK

SEQ ID NO: 35129 - protein, 9 aa, Homo sapiens
WQQGNVFSC

SEQ ID NO: 35130 - protein, 13 aa, Homo sapiens
WQQGNVFSCSVMH

SEQ ID NO: 35131 - protein, 14 aa, Homo sapiens
WQQGNVFSCSVMHE

SEQ ID NO: 35132 - protein, 23 aa, Homo sapiens
WQQGNVFSCSVMHEALHNHYTQK

SEQ ID NO: 35133 - protein, 12 aa, Homo sapiens
WYVDGMEVHNAK

SEQ ID NO: 35134 - protein, 20 aa, Homo sapiens
YPSDIAVEWESNGQPENNYK

SEQ ID NO: 35135 - protein, 12 aa, Homo sapiens
YTLPPSREEMTK

SEQ ID NO: 35136 - protein, 18 aa, Homo sapiens
DIQMTQSPSSLSASVGDR

SEQ ID NO: 35137 - protein, 19 aa, Homo sapiens
APKLLIYAASSLQSGVPSR

SEQ ID NO: 35138 - protein, 18 aa, Homo sapiens
ASQSISSYLNWYQQKPGK

SEQ ID NO: 35139 - protein, 13 aa, Homo sapiens
DIQMTQSPSSLSA

SEQ ID NO: 35140 - protein, 25 aa, Homo sapiens
FSGSGSGTDFTLTISSLQPEDFATY

SEQ ID NO: 35141 - protein, 6 aa, Homo sapiens
SGVPSR

SEQ ID NO: 35142 - protein, 6 aa, Homo sapiens
VTITCR

SEQ ID NO: 35143 - protein, 25 aa, Homo sapiens
WLRGARCDIQMTQSPSSLSASVGDR

SEQ ID NO: 35144 - protein, 8 aa, Homo sapiens
YLNWYQQK

SEQ ID NO: 35145 - protein, 11 aa, Homo sapiens
YLNWYQQKPGK

SEQ ID NO: 35146 - protein, 7 aa, Homo sapiens
DSGVPDR

SEQ ID NO: 35147 - protein, 20 aa, Homo sapiens
DSGVPDRFSGSGSGTDFTLK

SEQ ID NO: 35148 - protein, 24 aa, Homo sapiens
DVVMTQSPLSLPVTLGQPASISCR

SEQ ID NO: 35149 - protein, 14 aa, Homo sapiens
LPVTLGQPASISCR

SEQ ID NO: 35150 - protein, 12 aa, Homo sapiens
NWFQQRPGQSPR

SEQ ID NO: 35151 - protein, 20 aa, Homo sapiens
SSQSLVYSDGNTYLNWFQQR

SEQ ID NO: 35152 - protein, 24 aa, Homo sapiens
DIVMTQTPLSSPVTLGQPASISCR

SEQ ID NO: 35153 - protein, 13 aa, Homo sapiens
FSGSGAGTDFTLK

SEQ ID NO: 35154 - protein, 16 aa, Homo sapiens
FSGSGAGTDFTLKISR

SEQ ID NO: 35155 - protein, 7 aa, Homo sapiens
FSGVPDR

SEQ ID NO: 35156 - protein, 12 aa, Homo sapiens
AASTLQSGVPSR

SEQ ID NO: 35157 - protein, 18 aa, Homo sapiens
ASQGISSYLAWYQQKPGK

SEQ ID NO: 35158 - protein, 11 aa, Homo sapiens
ASTLQSGVPSR

SEQ ID NO: 35159 - protein, 18 aa, Homo sapiens
DIQLTQSPSFLSASVGDR

SEQ ID NO: 35160 - protein, 7 aa, Homo sapiens
LAWYQQK

SEQ ID NO: 35161 - protein, 10 aa, Homo sapiens
LAWYQQKPGK

SEQ ID NO: 35162 - protein, 16 aa, Homo sapiens
LLIYAASTLQSGVPSR

SEQ ID NO: 35163 - protein, 8 aa, Homo sapiens
YLAWYQQK

SEQ ID NO: 35164 - protein, 11 aa, Homo sapiens
AEDTAVYYCAR

SEQ ID NO: 35165 - protein, 15 aa, Homo sapiens
DNSKNTLYLQMNSLR

SEQ ID NO: 35166 - protein, 9 aa, Homo sapiens
DTAVYYCAR

SEQ ID NO: 35167 - protein, 7 aa, Homo sapiens
GRFTISR

SEQ ID NO: 35168 - protein, 13 aa, Homo sapiens
LRAEDTAVYYCAR

SEQ ID NO: 35169 - protein, 19 aa, Homo sapiens
LSCAASGFTFSSYGMHWVR

SEQ ID NO: 35170 - protein, 13 aa, Homo sapiens
LVESGGGVVQPGR

SEQ ID NO: 35171 - protein, 9 aa, Homo sapiens
LYLQMNSLR

SEQ ID NO: 35172 - protein, 11 aa, Homo sapiens
NTLYLQMNSLR

SEQ ID NO: 35173 - protein, 16 aa, Homo sapiens
QVQLVESGGGVVQPGR

SEQ ID NO: 35174 - protein, 8 aa, Homo sapiens [sequence omitted]

SEQ ID NO: 35175 - protein, 7 aa, Homo sapiens
YGMHWVR

SEQ ID NO: 35176 - protein, 7 aa, Homo sapiens
YYADSVK

SEQ ID NO: 35177 - protein, 16 aa, Homo sapiens
LLIYDASNLETGVPSR

SEQ ID NO: 35178 - protein, 11 aa, Homo sapiens
ASNLQSGVPSR

SEQ ID NO: 35179 - protein, 11 aa, Homo sapiens
DIQLTQSPSSL

SEQ ID NO: 35180 - protein, 13 aa, Homo sapiens
DIQLTQSPSSLSA

SEQ ID NO: 35181 - protein, 18 aa, Homo sapiens
DIQLTQSPSSLSASVGDR

SEQ ID NO: 35182 - protein, 21 aa, Homo sapiens
ASQSIGSSLHWYQQKPDQSPK

SEQ ID NO: 35183 - protein, 16 aa, Homo sapiens
EIVLTQSPDFQSVTPK

SEQ ID NO: 35184 - protein, 8 aa, Homo sapiens
EKVTITCR

SEQ ID NO: 35185 - protein, 12 aa, Homo sapiens
SPDFQSVTPKEK

SEQ ID NO: 35186 - protein, 12 aa, Homo sapiens
YASQSISGVPSR

SEQ ID NO: 35187 - protein, 20 aa, Homo sapiens
ADAVTLDGGFIYEAGLAPYK

SEQ ID NO: 35188 - protein, 8 aa, Homo sapiens
AGDVAFVK

SEQ ID NO: 35189 - protein, 17 aa, Homo sapiens
CAFSSQEPYFSYSGAFK

SEQ ID NO: 35190 - protein, 12 aa, Homo sapiens
CGLVPVLAENYK

SEQ ID NO: 35191 - protein, 13 aa, Homo sapiens
CLAENAGDVAFVK

SEQ ID NO: 35192 - protein, 31 aa, Homo sapiens
CLAENAGDVAFVKDVTVLQNTDGNNNEAWAK

SEQ ID NO: 35193 - protein, 13 aa, Homo sapiens
CLRDGAGDVAFIR

SEQ ID NO: 35194 - protein, 14 aa, Homo sapiens
CSTSPLLEACEFLR

SEQ ID NO: 35195 - protein, 15 aa, Homo sapiens
CSTSPLLEACEFLRK

SEQ ID NO: 35196 - protein, 10 aa, Homo sapiens
DGAGDVAFIR

SEQ ID NO: 35197 - protein, 13 aa, Homo sapiens
DLLFKDSAIGFSR

SEQ ID NO: 35198 - protein, 8 aa, Homo sapiens
DSAIGFSR

SEQ ID NO: 35199 - protein, 14 aa, Homo sapiens
DSPIQCIQAIAENR

SEQ ID NO: 35200 - protein, 6 aa, Homo sapiens
DVAFVK

SEQ ID NO: 35201 - protein, 18 aa, Homo sapiens
DVTVLQNTDGNNNEAWAK

SEQ ID NO: 35202 - protein, 9 aa, Homo sapiens
EDAIWNLLR

SEQ ID NO: 35203 - protein, 14 aa, Homo sapiens
ESTVFEDLSDEAER

SEQ ID NO: 35204 - protein, 26 aa, Homo sapiens
ESTVFEDLSDEAERDEYELLCPDNTR

SEQ ID NO: 35205 - protein, 9 aa, Homo sapiens
FCLFQSETK

SEQ ID NO: 35206 - protein, 16 aa, Homo sapiens
FDEYFSQSCAPGSDPR

SEQ ID NO: 35207 - protein, 12 aa, Homo sapiens
FFSASCVPGADK

SEQ ID NO: 35208 - protein, 20 aa, Homo sapiens
FFSASCVPGADKGQFPNLCR

SEQ ID NO: 35209 - protein, 8 aa, Homo sapiens
FGKDKSPK

SEQ ID NO: 35210 - protein, 20 aa, Homo sapiens
FGRNGSDCPDKFCLFQSETK

SEQ ID NO: 35211 - protein, 8 aa, Homo sapiens
FKDCHLAR

SEQ ID NO: 35212 - protein, 11 aa, Homo sapiens
FQLFGSPSGQK

SEQ ID NO: 35213 - protein, 16 aa, Homo sapiens
FQLFGSPSGQKDLLFK

SEQ ID NO: 35214 - protein, 24 aa, Homo sapiens
FQLFGSPSGQKDLLFKDSAIGFSR

SEQ ID NO: 35215 - protein, 7 aa, Homo sapiens
GDVAFVK

SEQ ID NO: 35216 - protein, 18 aa, Homo sapiens
GEADAMSLDGGYVYTAGK

SEQ ID NO: 35217 - protein, 13 aa, Homo sapiens
GGSFQLNELQGLK

SEQ ID NO: 35218 - protein, 8 aa, Homo sapiens
GPPVSCIK

SEQ ID NO: 35219 - protein, 9 aa, Homo sapiens
GPPVSCIKR

SEQ ID NO: 35220 - protein, 8 aa, Homo sapiens
GQFPNLCR

SEQ ID NO: 35221 - protein, 19 aa, Homo sapiens
IDSGLYLGSGYFTAIQNLR

SEQ ID NO: 35222 - protein, 20 aa, Homo sapiens
IDSGLYLGSGYFTAIQNLRK

SEQ ID NO: 35223 - protein, 15 aa, Homo sapiens
KCSTSPLLEACEFLR

SEQ ID NO: 35224 - protein, 22 aa, Homo sapiens
KFGRNGSDCPDKFCLFQSETKN

SEQ ID NO: 35225 - protein, 14 aa, Homo sapiens
KGGSFQLNELQGLK

SEQ ID NO: 35226 - protein, 7 aa, Homo sapiens
KPVDKFK

SEQ ID NO: 35227 - protein, 13 aa, Homo sapiens
KPVDKFKDCHLAR

SEQ ID NO: 35228 - protein, 7 aa, Homo sapiens
KPVTEAR

SEQ ID NO: 35229 - protein, 9 aa, Homo sapiens
KSCHTAVDR

SEQ ID NO: 35230 - protein, 9 aa, Homo sapiens
KSEEEVAAR

SEQ ID NO: 35231 - protein, 10 aa, Homo sapiens
KSEEEVAARR

SEQ ID NO: 35232 - protein, 12 aa, Homo sapiens
LADFALLCLDGK

SEQ ID NO: 35233 - protein, 13 aa, Homo sapiens
LADFALLCLDGKR

SEQ ID NO: 35234 - protein, 9 aa, Homo sapiens
LCAGTGENK

SEQ ID NO: 35235 - protein, 24 aa, Homo sapiens
LHGKTTYEKYLGPQYVAGITNLKK

SEQ ID NO: 35236 - protein, 11 aa, Homo sapiens
LKQVLLHQQAK

SEQ ID NO: 35237 - protein, 13 aa, Homo sapiens
LRPVAAEVYGTER

SEQ ID NO: 35238 - protein, 16 aa, Homo sapiens
LRPVAAEVYGTERQPR

SEQ ID NO: 35239 - protein, 17 aa, Homo sapiens
MDKVERLKQVLLHQQAK

SEQ ID NO: 35240 - protein, 21 aa, Homo sapiens
MKLVFLVLLFLGALGLCLAGR

SEQ ID NO: 35241 - protein, 17 aa, Homo sapiens
NGSDCPDKFCLFQSETK

SEQ ID NO: 35242 - protein, 13 aa, Homo sapiens
NLLFNDNTECLAR

SEQ ID NO: 35243 - protein, 9 aa, Homo sapiens
QVLLHQQAK

SEQ ID NO: 35244 - protein, 12 aa, Homo sapiens
QVLLHQQAKFGR

SEQ ID NO: 35245 - protein, 15 aa, Homo sapiens
RDSPIQCIQAIAENR

SEQ ID NO: 35246 - protein, 8 aa, Homo sapiens
RKPVTEAR

SEQ ID NO: 35247 - protein, 12 aa, Homo sapiens
RSDTSLTWNSVK

SEQ ID NO: 35248 - protein, 15 aa, Homo sapiens
RSVQWCAVSQPEATK

SEQ ID NO: 35249 - protein, 21 aa, Homo sapiens
RTAGWNIPMGLLFNQTGSCKF

SEQ ID NO: 35250 - protein, 32 aa, Homo sapiens
RTAGWNVPIGTLRPFLNWTGPPEPIEAAVARF

SEQ ID NO: 35251 - protein, 15 aa, Homo sapiens
SCHLAMAPNHAVVSR

SEQ ID NO: 35252 - protein, 8 aa, Homo sapiens
SCHTAVDR

SEQ ID NO: 35253 - protein, 11 aa, Homo sapiens
SDTSLTWNSVK

SEQ ID NO: 35254 - protein, 13 aa, Homo sapiens
SDTSLTWNSVKGK

SEQ ID NO: 35255 - protein, 8 aa, Homo sapiens
SEEEVAAR

SEQ ID NO: 35256 - protein, 16 aa, Homo sapiens
SNLCALCIGDEQGENK

SEQ ID NO: 35257 - protein, 14 aa, Homo sapiens
SPKFQLFGSPSGQK

SEQ ID NO: 35258 - protein, 14 aa, Homo sapiens
SVNGKEDAIWNLLR

SEQ ID NO: 35259 - protein, 14 aa, Homo sapiens
SVQWCAVSQPEATK

SEQ ID NO: 35260 - protein, 11 aa, Homo sapiens
TAGWNIPMGLL

SEQ ID NO: 35261 - protein, 12 aa, Homo sapiens
TAGWNVPIGTLR

SEQ ID NO: 35262 - protein, 30 aa, Homo sapiens
TAGWNVPIGTLRPFLNWTGPPEPIEAAVAR

SEQ ID NO: 35263 - protein, 10 aa, Homo sapiens
THYYAVAVVK

SEQ ID NO: 35264 - protein, 11 aa, Homo sapiens
THYYAVAVVKK

SEQ ID NO: 35265 - protein, 20 aa, Homo sapiens
TTYEKYLGPQYVAGITNLKK

SEQ ID NO: 35266 - protein, 23 aa, Homo sapiens
VPPRIDSGLYLGSGYFTAIQNLR

SEQ ID NO: 35267 - protein, 9 aa, Homo sapiens
VPSHAVVAR

SEQ ID NO: 35268 - protein, 10 aa, Homo sapiens
VRGPPVSCIK

SEQ ID NO: 35269 - protein, 11 aa, Homo sapiens
VRGPPVSCIKR

SEQ ID NO: 35270 - protein, 12 aa, Homo sapiens
VVWCAVGEQELR

SEQ ID NO: 35271 - protein, 13 aa, Homo sapiens
VVWCAVGEQELRK

SEQ ID NO: 35272 - protein, 14 aa, Homo sapiens
YLGPQYVAGITNLK

SEQ ID NO: 35273 - protein, 15 aa, Homo sapiens
YLGPQYVAGITNLKK

SEQ ID NO: 35274 - protein, 8 aa, Homo sapiens
YYAVAVVK

SEQ ID NO: 35275 - protein, 9 aa, Homo sapiens
YYGYTGAFR

SEQ ID NO: 35276 - protein, 21 aa, Homo sapiens
ATNYNAGDRSTDYGIFQINSR

SEQ ID NO: 35277 - protein, 12 aa, Homo sapiens
GISLANWMCLAK

SEQ ID NO: 35278 - protein, 8 aa, Homo sapiens
QYVQGCGV

SEQ ID NO: 35279 - protein, 12 aa, Homo sapiens
STDYGIFQINSR

SEQ ID NO: 35280 - protein, 9 aa, Homo sapiens
VVRDPQGIR

SEQ ID NO: 35281 - protein, 20 aa, Homo sapiens
AVSNEIVRFPTDQLTPDQER

SEQ ID NO: 35282 - protein, 12 aa, Homo sapiens
IKNQADCIPFFR

SEQ ID NO: 35283 - protein, 20 aa, Homo sapiens
RALLPFDNLHDDPCLLTNRS

SEQ ID NO: 35284 - protein, 19 aa, Homo sapiens
RDFVNCSTLPALNLASWRE

SEQ ID NO: 35285 - protein, 16 aa, Homo sapiens
RNMSNQLGLLAVNQRF

SEQ ID NO: 35286 - protein, 21 aa, Homo sapiens
RRPFNVTDVLTPAQLNVLSKS

SEQ ID NO: 35287 - protein, 15 aa, Homo sapiens
RSCPACPGSNITIRN

SEQ ID NO: 35288 - protein, 10 aa, Homo sapiens
RSPTLGASNR

SEQ ID NO: 35289 - protein, 11 aa, Homo sapiens
RSYNDSVDPRI

SEQ ID NO: 35290 - protein, 14 aa, Homo sapiens
NQYVPYPHAPGSQR

SEQ ID NO: 35291 - protein, 19 aa, Homo sapiens
QVQFHQGFGDLAVLKPSNK

SEQ ID NO: 35292 - protein, 31 aa, Homo sapiens
VNPPGIMSILDDVCATMHAVGEGADQTLLQK

SEQ ID NO: 35293 - protein, 13 aa, Homo sapiens
HCQLLETPESWAK

SEQ ID NO: 35294 - protein, 30 aa, Homo sapiens
HSTVHVDELCPLIVPNLGVAVIHDYADWVK

SEQ ID NO: 35295 - protein, 15 aa, Homo sapiens
ISEACSLAQQSGDHR

SEQ ID NO: 35296 - protein, 34 aa, Homo sapiens
KITNEKGECIVSDFTIGRKGYGSIYFEGDVNLTN

SEQ ID NO: 35297 - protein, 19 aa, Homo sapiens
RALSMYEEAFQNTSDSDRY

SEQ ID NO: 35298 - protein, 9 aa, Homo sapiens
ALILGELEK

SEQ ID NO: 35299 - protein, 31 aa, Homo sapiens
AFAMIIDKLEEDISSSMTNSTAASRPPVTLR

SEQ ID NO: 35300 - protein, 16 aa, Homo sapiens
AITIAGIPQSIIECVK

SEQ ID NO: 35301 - protein, 23 aa, Homo sapiens
ASAQTTSHELTIPNDLIGCIIGR

SEQ ID NO: 35302 - protein, 23 aa, Homo sapiens
GVTIPYRPKPSSSPVIFAGGQDR

SEQ ID NO: 35303 - protein, 30 aa, Homo sapiens
GYWAGLDASAQTTSHELTIPNDLIGCIIGR

SEQ ID NO: 35304 - protein, 13 aa, Homo sapiens
IITLAGPTNAIFK

SEQ ID NO: 35305 - protein, 11 aa, Homo sapiens
INISEGNCPER

SEQ ID NO: 35306 - protein, 14 aa, Homo sapiens
LVVPASQCGSLIGK

SEQ ID NO: 35307 - protein, 22 aa, Homo sapiens
IFNHCFTGNCVIDWLVSNQSVR

SEQ ID NO: 35308 - protein, 26 aa, Homo sapiens
KSEEENLFEIITADEVHYFLQAATPK

SEQ ID NO: 35309 - protein, 15 aa, Homo sapiens
LPETIDLGALYLSMK

SEQ ID NO: 35310 - protein, 25 aa, Homo sapiens
SEEENLFEIITADEVHYFLQAATPK

SEQ ID NO: 35311 - protein, 18 aa, Homo sapiens
RNSTELSEMFPVLPGSHL

SEQ ID NO: 35312 - protein, 9 aa, Homo sapiens
FTVFTNNTH

SEQ ID NO: 35313 - protein, 7 aa, Homo sapiens
ARYQWVR

SEQ ID NO: 35314 - protein, 13 aa, Homo sapiens
GPMFELLPGESNK

SEQ ID NO: 35315 - protein, 8 aa, Homo sapiens
LRTDLFPK

SEQ ID NO: 35316 - protein, 12 aa, Homo sapiens
VDESDAFHDNLR

SEQ ID NO: 35317 - protein, 24 aa, Homo sapiens
AGSPTAPVHDESLVGPVDPSSGQQ

SEQ ID NO: 35318 - protein, 26 aa, Homo sapiens
AGSPTAPVHDESLVGPVDPSSGQQSR

SEQ ID NO: 35319 - protein, 14 aa, Homo sapiens
AVSISPTNVILTWK

SEQ ID NO: 35320 - protein, 14 aa, Homo sapiens
DTEVLLVGLEPGTR

SEQ ID NO: 35321 - protein, 12 aa, Homo sapiens
FSGFEASHGPIK

SEQ ID NO: 35322 - protein, 12 aa, Homo sapiens
GASDTYVTYLIR

SEQ ID NO: 35323 - protein, 17 aa, Homo sapiens
GDPLGTEGGLDASNTER

SEQ ID NO: 35324 - protein, 18 aa, Homo sapiens
IHVAGETDSSNLNVSEPR

SEQ ID NO: 35325 - protein, 20 aa, Homo sapiens
KIHVAGETDSSNLNVSEPRA

SEQ ID NO: 35326 - protein, 12 aa, Homo sapiens
KSNDTAASEYKY

SEQ ID NO: 35327 - protein, 15 aa, Homo sapiens
KVSDNESSSNYTYKI

SEQ ID NO: 35328 - protein, 17 aa, Homo sapiens
RTPEQGSNGTDGASQKT

SEQ ID NO: 35329 - protein, 25 aa, Homo sapiens
RYNATVYSQAANGTEGQPQAIEFRT

SEQ ID NO: 35330 - protein, 17 aa, Homo sapiens
SPDGASEYVYHLVIESK

SEQ ID NO: 35331 - protein, 19 aa, Homo sapiens
TKGDPLGTEGGLDASNTER

SEQ ID NO: 35332 - protein, 14 aa, Homo sapiens
TPSSTGPSPVFDIK

SEQ ID NO: 35333 - protein, 12 aa, Homo sapiens
VITEPIPVSDLR

SEQ ID NO: 35334 - protein, 17 aa, Homo sapiens
VLLESIGSHEELTQDSR

SEQ ID NO: 35335 - protein, 8 aa, Homo sapiens
YCFEIVPK

SEQ ID NO: 35336 - protein, 23 aa, Homo sapiens
YNATVYSQAANGTEGQPQAIEFR

SEQ ID NO: 35337 - protein, 21 aa, Homo sapiens
KVAIQLNDTHPSLAIPELMRI

SEQ ID NO: 35338 - protein, 14 aa, Homo sapiens
RGLAGVENVTELKK

SEQ ID NO: 35339 - protein, 30 aa, Homo sapiens
IYQNIQDGSLDLNAAESGVQHKPSAPQGGR

SEQ ID NO: 35340 - protein, 11 aa, Homo sapiens
LQIWDTAGQER

SEQ ID NO: 35341 - protein, 15 aa, Homo sapiens
NLTNPNTVIILIGNK

SEQ ID NO: 35342 - protein, 10 aa, Homo sapiens
SCLLHQFTEK

SEQ ID NO: 35343 - protein, 14 aa, Homo sapiens
STYNHLSSWLTDAR

SEQ ID NO: 35344 - protein, 14 aa, Homo sapiens
TGENVEDAFLEAAK

SEQ ID NO: 35345 - protein, 10 aa, Homo sapiens
FITTVGIDFR

SEQ ID NO: 35346 - protein, 11 aa, Homo sapiens
FLALGDSGVGK

SEQ ID NO: 35347 - protein, 13 aa, Homo sapiens
IHLQLWDTAGQER

SEQ ID NO: 35348 - protein, 10 aa, Homo sapiens
SDGDYDYLIK

SEQ ID NO: 35349 - protein, 16 aa, Homo sapiens
SNGHASTDQLSEEKEK

SEQ ID NO: 35350 - protein, 9 aa, Homo sapiens
SWIPEGVVR

SEQ ID NO: 35351 - protein, 11 aa, Homo sapiens
TSVLYQYTDGK

SEQ ID NO: 35352 - protein, 13 aa, Homo sapiens
VVKEEEAIALAEK

SEQ ID NO: 35353 - protein, 15 aa, Homo sapiens
AGGAAVVITEPEHTK

SEQ ID NO: 35354 - protein, 16 aa, Homo sapiens
DVACGANHTLVLDSQK

SEQ ID NO: 35355 - protein, 21 aa, Homo sapiens
GNLYSFGCPEYGQLGHNSDGK

SEQ ID NO: 35356 - protein, 10 aa, Homo sapiens
IEYDCELVPR

SEQ ID NO: 35357 - protein, 17 aa, Homo sapiens
LIEGLSHEVIVSAACGR

SEQ ID NO: 35358 - protein, 19 aa, Homo sapiens
NHTLALTETGSVFAFGENK

SEQ ID NO: 35359 - protein, 31 aa, Homo sapiens
NKMGQLGLGNQTDAVPSPAQIMYNGQPITKM

SEQ ID NO: 35360 - protein, 19 aa, Homo sapiens
RDVACGANHTLVLDSQKRV

SEQ ID NO: 35361 - protein, 19 aa, Homo sapiens
TVVSGSCAAHSLLITTEGK

SEQ ID NO: 35362 - protein, 8 aa, Homo sapiens
YGCLAGVR

SEQ ID NO: 35363 - protein, 29 aa, Homo sapiens
HSMDTNSSGMSSLINPLSSPPSCNNNPKI

SEQ ID NO: 35364 - protein, 14 aa, Homo sapiens
DPPQYPVVPVHLDR

SEQ ID NO: 35365 - protein, 32 aa, Homo sapiens
RCKNQNTFLLTTFANVVNVCGNPNMTCPSNKT

SEQ ID NO: 35366 - protein, 15 aa, Homo sapiens
RDPPQYPVVPVHLDR

SEQ ID NO: 35367 - protein, 17 aa, Homo sapiens
RDPPQYPVVPVHLDRII

SEQ ID NO: 35368 - protein, 7 aa, Homo sapiens
FNADEFE

SEQ ID NO: 35369 - protein, 12 aa, Homo sapiens
GAFGKPQGTVAR

SEQ ID NO: 35370 - protein, 9 aa, Homo sapiens
VDEFPLCGH

SEQ ID NO: 35371 - protein, 27 aa, Homo sapiens
VDEFPLCGHMVSDEYEQLSSEALEAAR

SEQ ID NO: 35372 - protein, 11 aa, Homo sapiens
VHIGQVIMSIR

SEQ ID NO: 35373 - protein, 15 aa, Homo sapiens
CTGGEVGATSALAPK

SEQ ID NO: 35374 - protein, 16 aa, Homo sapiens
EILGTAQSVGCNVDGR

SEQ ID NO: 35375 - protein, 19 aa, Homo sapiens
HPHDIIDDINSGAVECPAS

SEQ ID NO: 35376 - protein, 15 aa, Homo sapiens
HSGNITFDEIVNIAR

SEQ ID NO: 35377 - protein, 9 aa, Homo sapiens
IGPLGLSPK

SEQ ID NO: 35378 - protein, 20 aa, Homo sapiens
KNIKHSGNITFDEIVNIARQ

SEQ ID NO: 35379 - protein, 16 aa, Homo sapiens
QAQIEVVPSASALIIK

SEQ ID NO: 35380 - protein, 7 aa, Homo sapiens
DLQNFLK

SEQ ID NO: 35381 - protein, 13 aa, Homo sapiens
ETIINTFHQYSVK

SEQ ID NO: 35382 - protein, 8 aa, Homo sapiens
KDLQNFLK

SEQ ID NO: 35383 - protein, 13 aa, Homo sapiens
LGHPDTLNQGEFK

SEQ ID NO: 35384 - protein, 17 aa, Homo sapiens
LGHPDTLNQGEFKELVR

SEQ ID NO: 35385 - protein, 18 aa, Homo sapiens
LGHPDTLNQGEFKELVRK

SEQ ID NO: 35386 - protein, 8 aa, Homo sapiens
LTWASHEK

SEQ ID NO: 35387 - protein, 13 aa, Homo sapiens
LTWASHEKMHEGD

SEQ ID NO: 35388 - protein, 21 aa, Homo sapiens
MHEGDEGPGHHHKPGLGEGTP

SEQ ID NO: 35389 - protein, 21 aa, Homo sapiens
MSQLERNIETIINTFHQYSVK

SEQ ID NO: 35390 - protein, 11 aa, Homo sapiens
NIETIINTFHQ

SEQ ID NO: 35391 - protein, 12 aa, Homo sapiens
NIETIINTFHQY

SEQ ID NO: 35392 - protein, 14 aa, Homo sapiens
NIETIINTFHQYSV

SEQ ID NO: 35393 - protein, 15 aa, Homo sapiens
NIETIINTFHQYSVK

SEQ ID NO: 35394 - protein, 13 aa, Homo sapiens
QLSFEEFIMLMAR

SEQ ID NO: 35395 - protein, 15 aa, Homo sapiens
VIEHIMEDLDTNADK

SEQ ID NO: 35396 - protein, 28 aa, Homo sapiens
VIEHIMEDLDTNADKQLSFEEFIMLMAR

SEQ ID NO: 35397 - protein, 16 aa, Homo sapiens
AVDPDGDGHVSWDEYK

SEQ ID NO: 35398 - protein, 12 aa, Homo sapiens
DLGGFDEDAEPR

SEQ ID NO: 35399 - protein, 10 aa, Homo sapiens
GFHQEVFLGK

SEQ ID NO: 35400 - protein, 21 aa, Homo sapiens
LNEELKVDEETQEVLENLKDR

SEQ ID NO: 35401 - protein, 28 aa, Homo sapiens
WYQADSPPADLLLTEEEFLSFLHPEHSR

SEQ ID NO: 35402 - protein, 14 aa, Homo sapiens
GGFVLLDGETFEVK

SEQ ID NO: 35403 - protein, 13 aa, Homo sapiens
GGPVQVLEDEELK

SEQ ID NO: 35404 - protein, 10 aa, Homo sapiens
HEIVQTLSLK

SEQ ID NO: 35405 - protein, 19 aa, Homo sapiens
HEIVQTLSLKDGLIPLEIR

SEQ ID NO: 35406 - protein, 11 aa, Homo sapiens
IYVVDVGSEPR

SEQ ID NO: 35407 - protein, 23 aa, Homo sapiens
LNPNFLVDFGKEPLGPALAHELR

SEQ ID NO: 35408 - protein, 10 aa, Homo sapiens
LVLPSLISSR

SEQ ID NO: 35409 - protein, 18 aa, Homo sapiens
NTGTEAPDYLATVDVDPK

SEQ ID NO: 35410 - protein, 11 aa, Homo sapiens
ILDEIEEHNIK

SEQ ID NO: 35411 - protein, 16 aa, Homo sapiens
LTVVDTPGYGDAINCR

SEQ ID NO: 35412 - protein, 19 aa, Homo sapiens
LYPWGVVEVENPEHNDFLK

SEQ ID NO: 35413 - protein, 16 aa, Homo sapiens
STLINSLFLTDLYPER

SEQ ID NO: 35414 - protein, 23 aa, Homo sapiens
TMLITHMQDLQEVTQDLHYENFR

SEQ ID NO: 35415 - protein, 10 aa, Homo sapiens
YLHDESGLNR

SEQ ID NO: 35416 - protein, 16 aa, Homo sapiens
FDQLFDDESDPFEVLK

SEQ ID NO: 35417 - protein, 12 aa, Homo sapiens
GGSGSHNWGTVK

SEQ ID NO: 35418 - protein, 19 aa, Homo sapiens
KPANDITSQLEINFGDLGR

SEQ ID NO: 35419 - protein, 15 aa, Homo sapiens
PGHLQEGFGCVVTNR

SEQ ID NO: 35420 - protein, 9 aa, Homo sapiens
RFEKPLEEK

SEQ ID NO: 35421 - protein, 16 aa, Homo sapiens
SAAQAAAQTNSNAAGK

SEQ ID NO: 35422 - protein, 16 aa, Homo sapiens
SEEAHAEDSVMDHHFR

SEQ ID NO: 35423 - protein, 18 aa, Homo sapiens
SSASAPDVDDPEAFPALA

SEQ ID NO: 35424 - protein, 22 aa, Homo sapiens
KDELTDLDQSNVTEETPEGEEH

SEQ ID NO: 35425 - protein, 10 aa, Homo sapiens
GDYDAFFEAR

SEQ ID NO: 35426 - protein, 12 aa, Homo sapiens
QQDVLGFLEANK

SEQ ID NO: 35427 - protein, 13 aa, Homo sapiens
VYIASSSGSTAIK

SEQ ID NO: 35428 - protein, 13 aa, Homo sapiens
DFLAGGIAAAISK

SEQ ID NO: 35429 - protein, 9 aa, Homo sapiens
EQGVLSFWR

SEQ ID NO: 35430 - protein, 8 aa, Homo sapiens
GNLANVIR

SEQ ID NO: 35431 - protein, 6 aa, Homo sapiens
HTQFWR

SEQ ID NO: 35432 - protein, 22 aa, Homo sapiens
LASGGAAGATSLCFVYPLDFAR

SEQ ID NO: 35433 - protein, 10 aa, Homo sapiens
LLLQVQHASK

SEQ ID NO: 35434 - protein, 27 aa, Homo sapiens
YFAGNLASGGAAGATSLCFVYPLDFAR

SEQ ID NO: 35435 - protein, 12 aa, Homo sapiens
YFPTQALNFAFK

SEQ ID NO: 35436 - protein, 13 aa, Homo sapiens
GTADVTHDLQEMK

SEQ ID NO: 35437 - protein, 17 aa, Homo sapiens
GTADVTHDLQEMKEESR

SEQ ID NO: 35438 - protein, 15 aa, Homo sapiens
KVIEEFYNQTWVHRY

SEQ ID NO: 35439 - protein, 9 aa, Homo sapiens
KVTILELFR

SEQ ID NO: 35440 - protein, 13 aa, Homo sapiens
ADFLEQPVLGFVR

SEQ ID NO: 35441 - protein, 25 aa, Homo sapiens
ALLLKHSHAGELEALGGVKPAVLTR

SEQ ID NO: 35442 - protein, 14 aa, Homo sapiens
ASTPGAAAQIQEVK

SEQ ID NO: 35443 - protein, 20 aa, Homo sapiens
HSHAGELEALGGVKPAVLTR

SEQ ID NO: 35444 - protein, 14 aa, Homo sapiens
YQSSPAKPDSSFYK

SEQ ID NO: 35445 - protein, 28 aa, Homo sapiens
KSPTSPTQNLFPASKTSPVNLPNKSSIP

SEQ ID NO: 35446 - protein, 16 aa, Homo sapiens
RLAVTNTTMTGTVLKM

SEQ ID NO: 35447 - protein, 7 aa, Homo sapiens
AATVTGK

SEQ ID NO: 35448 - protein, 17 aa, Homo sapiens
DFEDLYTPVNGSIVIVR

SEQ ID NO: 35449 - protein, 17 aa, Homo sapiens
HPVTGQFLYQDSNWASK

SEQ ID NO: 35450 - protein, 19 aa, Homo sapiens
HVFWGSGSHTLPALLENLK

SEQ ID NO: 35451 - protein, 9 aa, Homo sapiens
ILNIFGVIK

SEQ ID NO: 35452 - protein, 18 aa, Homo sapiens
KDFEDLYTPVNGSIVIVR

SEQ ID NO: 35453 - protein, 19 aa, Homo sapiens
KDFEDLYTPVNGSIVIVRA

SEQ ID NO: 35454 - protein, 20 aa, Homo sapiens
KKDFEDLYTPVNGSIVIVRA

SEQ ID NO: 35455 - protein, 14 aa, Homo sapiens
KQNNGAFNETLFRN

SEQ ID NO: 35456 - protein, 11 aa, Homo sapiens
LDSTDFTSTIK

SEQ ID NO: 35457 - protein, 10 aa, Homo sapiens
LLNENSYVPR

SEQ ID NO: 35458 - protein, 9 aa, Homo sapiens
LVHANFGTK

SEQ ID NO: 35459 - protein, 16 aa, Homo sapiens
LVYLVENPGGYVAYSK

SEQ ID NO: 35460 - protein, 17 aa, Homo sapiens
MKLAVDEEENADNNTKA

SEQ ID NO: 35461 - protein, 19 aa, Homo sapiens
PYTPGFPSFNHTQFPPSRS

SEQ ID NO: 35462 - protein, 16 aa, Homo sapiens
SAFSNLFGGEPLSYTR

SEQ ID NO: 35463 - protein, 14 aa, Homo sapiens
SSGLPNIPVQTISR

SEQ ID NO: 35464 - protein, 13 aa, Homo sapiens
VEYHFLSPYVSPK

SEQ ID NO: 35465 - protein, 13 aa, Homo sapiens
VSASPLLYTLIEK

SEQ ID NO: 35466 - protein, 33 aa, Homo sapiens
GAAAEGRPGGSLGVHPEGQQLLGMHVVQGPQVR

SEQ ID NO: 35467 - protein, 7 aa, Homo sapiens
IPSYLDK

SEQ ID NO: 35468 - protein, 15 aa, Homo sapiens
FCNPGFPIGCYITDK

SEQ ID NO: 35469 - protein, 16 aa, Homo sapiens
FYLPGLAPVNFCDEEK

SEQ ID NO: 35470 - protein, 24 aa, Homo sapiens
LDSVESVLPYEYTAFDFCQASEGK

SEQ ID NO: 35471 - protein, 14 aa, Homo sapiens
RPSENLGQVLFGER

SEQ ID NO: 35472 - protein, 21 aa, Homo sapiens
ILCQVGLQEGPDGENSSLVDR

SEQ ID NO: 35473 - protein, 13 aa, Homo sapiens
LEQANKPSHLCGR

SEQ ID NO: 35474 - protein, 32 aa, Homo sapiens
LHTSYDVENGEFLCPLCECLSNTVIPLLLPPR

SEQ ID NO: 35475 - protein, 12 aa, Homo sapiens
ADLTEYLSTHYK

SEQ ID NO: 35476 - protein, 28 aa, Homo sapiens
AIIGHYDCTYGGGVHLSSPLASGAVANK

SEQ ID NO: 35477 - protein, 21 aa, Homo sapiens
AVELLGDIVQNCSLEDSQIEK

SEQ ID NO: 35478 - protein, 29 aa, Homo sapiens
DVVFNYLHATAFQGTPLAQAVEGPSENVR

SEQ ID NO: 35479 - protein, 15 aa, Homo sapiens
EVESMGAHLNAYSTR

SEQ ID NO: 35480 - protein, 21 aa, Homo sapiens
HLGGIPWTYAEDAVPTLTPCR

SEQ ID NO: 35481 - protein, 12 aa, Homo sapiens
LCTSATESEVAR

SEQ ID NO: 35482 - protein, 20 aa, Homo sapiens
MVLAAAGGVEHQQLLDLAQK

SEQ ID NO: 35483 - protein, 19 aa, Homo sapiens
NALVSHLDGTTPVCEDIGR

SEQ ID NO: 35484 - protein, 14 aa, Homo sapiens
NNGAGYFLEHLAFK

SEQ ID NO: 35485 - protein, 10 aa, Homo sapiens
RIPLAEWESR

SEQ ID NO: 35486 - protein, 18 aa, Homo sapiens
SICYAETGLLGAHFVCDR

SEQ ID NO: 35487 - protein, 24 aa, Homo sapiens
TATFAQALQFVPETQVSLLDNGLR

SEQ ID NO: 35488 - protein, 22 aa, Homo sapiens
VASEQSSQPTCTVGVWIDVGSR

SEQ ID NO: 35489 - protein, 23 aa, Homo sapiens
YIYDQCPAVAGYGPIEQLPDYNR

SEQ ID NO: 35490 - protein, 9 aa, Homo sapiens
DLCCHLSYK

SEQ ID NO: 35491 - protein, 9 aa, Homo sapiens
EEALALMNR

SEQ ID NO: 35492 - protein, 12 aa, Homo sapiens
GTVFFDEFTFVK

SEQ ID NO: 35493 - protein, 35 aa, Homo sapiens
KLLLSQLDSHPSHSAVVNWTSYASSIEALSSGNKE

SEQ ID NO: 35494 - protein, 15 aa, Homo sapiens
KLTGVAGNYTVCQKD

SEQ ID NO: 35495 - protein, 15 aa, Homo sapiens
KMTGSGIYAPNSSRA

SEQ ID NO: 35496 - protein, 15 aa, Homo sapiens
KNNSIYVVANIGDKK

SEQ ID NO: 35497 - protein, 33 aa, Homo sapiens
LLLSQLDSHPSHSAVVNWTSYASSIEALSSGNK

SEQ ID NO: 35498 - protein, 13 aa, Homo sapiens
LTGVAGNYTVCQK

SEQ ID NO: 35499 - protein, 24 aa, Homo sapiens
MSENIPNEVYALGAFDGLHTVEGR

SEQ ID NO: 35500 - protein, 18 aa, Homo sapiens
NLDILEGAITSAADQGAH

SEQ ID NO: 35501 - protein, 14 aa, Homo sapiens
QNLFMGENQFNVPK

SEQ ID NO: 35502 - protein, 17 aa, Homo sapiens
TTNLNTCGDSAETASTR

SEQ ID NO: 35503 - protein, 13 aa, Homo sapiens
VNFLASNIHYPSK

SEQ ID NO: 35504 - protein, 14 aa, Homo sapiens
YQYNTDVVFDSQGK

SEQ ID NO: 35505 - protein, 18 aa, Homo sapiens
SIAGIDQWLEVFCEQEEK

SEQ ID NO: 35506 - protein, 19 aa, Homo sapiens
WVCVDCVHGVVGQPLTCYK

SEQ ID NO: 35507 - protein, 18 aa, Homo sapiens
AFCEPGNVENNGVLSFIK

SEQ ID NO: 35508 - protein, 11 aa, Homo sapiens
LASAAYPDPSK

SEQ ID NO: 35509 - protein, 11 aa, Homo sapiens
LSSVVTQHDSK

SEQ ID NO: 35510 - protein, 12 aa, Homo sapiens
LVVVLCNLKPQK

SEQ ID NO: 35511 - protein, 12 aa, Homo sapiens
ELSQCNCIDLSK

SEQ ID NO: 35512 - protein, 23 aa, Homo sapiens
FPQNSSQSAAITQPSSQPGSQPK

SEQ ID NO: 35513 - protein, 14 aa, Homo sapiens
KKTETDNQSNAMKE

SEQ ID NO: 35514 - protein, 18 aa, Homo sapiens
AYLLQNFNEEGTTEKPSK

SEQ ID NO: 35515 - protein, 28 aa, Homo sapiens
CALSLFLMAVNIKTPVVVENITLMCLRI

SEQ ID NO: 35516 - protein, 22 aa, Homo sapiens
DGETSGSQEDQLCTALVNQLNK

SEQ ID NO: 35517 - protein, 24 aa, Homo sapiens
EKDGETSGSQEDQLCTALVNQLNK

SEQ ID NO: 35518 - protein, 21 aa, Homo sapiens
ELPQLVASVIESESEILHHEK

SEQ ID NO: 35519 - protein, 18 aa, Homo sapiens
GHQGFGVLSVILANHAIK

SEQ ID NO: 35520 - protein, 23 aa, Homo sapiens
GLAIQHPGTQVLIGTDSIPNLHK

SEQ ID NO: 35521 - protein, 29 aa, Homo sapiens
GLLGDATEEFIESLDSTTDEEEDEEEVYK

SEQ ID NO: 35522 - protein, 21 aa, Homo sapiens
IYDLCVDALSPTFYFLLPSSK

SEQ ID NO: 35523 - protein, 28 aa, Homo sapiens
KAMEEFFSDSGELVQIMMATANENLSAK

SEQ ID NO: 35524 - protein, 21 aa, Homo sapiens
LCSIIYPEENEVTEFFVTLEK

SEQ ID NO: 35525 - protein, 32 aa, Homo sapiens
LCSIIYPEENEVTEFFVTLEKDPQQEDFLQGR

SEQ ID NO: 35526 - protein, 22 aa, Homo sapiens
LEQVSSDEGIGTLAENLLEALR

SEQ ID NO: 35527 - protein, 33 aa, Homo sapiens
LITGCYNILANHADPNSGLDESILEECLQYLEK

SEQ ID NO: 35528 - protein, 24 aa, Homo sapiens
NAAQELATLLLSLPAPASVQQQSK

SEQ ID NO: 35529 - protein, 37 aa, Homo sapiens
NAFANDTIPSESYISAVQAAHLGTLCSQSLPLAASLK

SEQ ID NO: 35530 - protein, 19 aa, Homo sapiens
SINYDEKDPFLCNACGFCK

SEQ ID NO: 35531 - protein, 23 aa, Homo sapiens
SPNPSLLHLCGSLAQLACVEPVR

SEQ ID NO: 35532 - protein, 19 aa, Homo sapiens
STVSHFNIVHYDCHLAAVR

SEQ ID NO: 35533 - protein, 13 aa, Homo sapiens
AVYTQDCPLAAAK

SEQ ID NO: 35534 - protein, 15 aa, Homo sapiens
GGYVLHIGTIYGDLK

SEQ ID NO: 35535 - protein, 14 aa, Homo sapiens
ITCLCQVPQNAANR

SEQ ID NO: 35536 - protein, 18 aa, Homo sapiens
NSSHAGAFVIVTEEAIAK

SEQ ID NO: 35537 - protein, 19 aa, Homo sapiens
NVGCLQEALQLATSFAQLR

SEQ ID NO: 35538 - protein, 28 aa, Homo sapiens
PVSELLDDPSGPAGSLTSVEFCGGTHLR

SEQ ID NO: 35539 - protein, 18 aa, Homo sapiens
RPIMSNHTATHILNFALR

SEQ ID NO: 35540 - protein, 19 aa, Homo sapiens
TCFYAEQGGQIYDEGYLVK

SEQ ID NO: 35541 - protein, 28 aa, Homo sapiens
TIPGDTAWLLYDTYGFPVDLTGLIAEEK

SEQ ID NO: 35542 - protein, 34 aa, Homo sapiens
VVSIGVPVSELLDDPSGPAGSLTSVEFCGGTHLR

SEQ ID NO: 35543 - protein, 28 aa, Homo sapiens
KGVVTDEQGIPIANATISVSGINHGVKT

SEQ ID NO: 35544 - protein, 18 aa, Homo sapiens
ASSISEEVAVGSIAATLK

SEQ ID NO: 35545 - protein, 11 aa, Homo sapiens
DLCQVSHPHTK

SEQ ID NO: 35546 - protein, 13 aa, Homo sapiens
FCGQHNQSVNYFK

SEQ ID NO: 35547 - protein, 18 aa, Homo sapiens
HSSHGSDVSLSQILKPNR

SEQ ID NO: 35548 - protein, 18 aa, Homo sapiens
KSVSIQNITGVGNDENMS

SEQ ID NO: 35549 - protein, 21 aa, Homo sapiens
LDKPLTNMLEVVSHPHPVVPK

SEQ ID NO: 35550 - protein, 31 aa, Homo sapiens
LHQLLTEENAGEPDSWSSLSYEIPYGDCSVR

SEQ ID NO: 35551 - protein, 9 aa, Homo sapiens
GEGGPLGIH

SEQ ID NO: 35552 - protein, 29 aa, Homo sapiens
TQEELVAMLRSTKQGETASLVIARQEGHF

SEQ ID NO: 35553 - protein, 8 aa, Homo sapiens
FCELLIHR

SEQ ID NO: 35554 - protein, 18 aa, Homo sapiens
LTSSVSCALDEAAAALTR

SEQ ID NO: 35555 - protein, 31 aa, Homo sapiens
SSSLQVADQDLLPSFHPYQPLECIVEETEGK

SEQ ID NO: 35556 - protein, 16 aa, Homo sapiens
AAYLQETGKPLDETLK

SEQ ID NO: 35557 - protein, 17 aa, Homo sapiens
AAYLQETGKPLDETLKK

SEQ ID NO: 35558 - protein, 15 aa, Homo sapiens
ALTGHLEEVVLALLK

SEQ ID NO: 35559 - protein, 8 aa, Homo sapiens
ALYEAGER

SEQ ID NO: 35560 - protein, 8 aa, Homo sapiens
AMVSEFLK

SEQ ID NO: 35561 - protein, 12 aa, Homo sapiens
CATSKPAFFAEK

SEQ ID NO: 35562 - protein, 7 aa, Homo sapiens
CLTAIVK

SEQ ID NO: 35563 - protein, 11 aa, Homo sapiens
DITSDTSGDFR

SEQ ID NO: 35564 - protein, 19 aa, Homo sapiens
GDRSEDFGVNEDLADSDAR

SEQ ID NO: 35565 - protein, 24 aa, Homo sapiens
GGPGSAVSPYPTFNPSSDVAALHK

SEQ ID NO: 35566 - protein, 16 aa, Homo sapiens
GLGTDEDTLIEILASR

SEQ ID NO: 35567 - protein, 14 aa, Homo sapiens
GTDVNVFNTILTTR

SEQ ID NO: 35568 - protein, 13 aa, Homo sapiens
GVDEATIIDILTK

SEQ ID NO: 35569 - protein, 14 aa, Homo sapiens
GVDEATIIDILTKR

SEQ ID NO: 35570 - protein, 9 aa, Homo sapiens
ILVALCGGN

SEQ ID NO: 35571 - protein, 15 aa, Homo sapiens
KGTDVNVFNTILTTR

SEQ ID NO: 35572 - protein, 15 aa, Homo sapiens
MYGISLCQAILDETK

SEQ ID NO: 35573 - protein, 20 aa, Homo sapiens
MYGISLCQAILDETKGDYEK

SEQ ID NO: 35574 - protein, 8 aa, Homo sapiens
NALLSLAK

SEQ ID NO: 35575 - protein, 17 aa, Homo sapiens
QAWFIENEEQEYVQTVK

SEQ ID NO: 35576 - protein, 16 aa, Homo sapiens
SEDFGVNEDLADSDAR

SEQ ID NO: 35577 - protein, 9 aa, Homo sapiens
SEIDMNDIK

SEQ ID NO: 35578 - protein, 13 aa, Homo sapiens
TGHLEEVVLALLK

SEQ ID NO: 35579 - protein, 11 aa, Homo sapiens
TPAQFDADELR

SEQ ID NO: 35580 - protein, 7 aa, Homo sapiens
VLDLELK

SEQ ID NO: 35581 - protein, 12 aa, Homo sapiens
VLDLELKGDIEK

SEQ ID NO: 35582 - protein, 8 aa, Homo sapiens
VYREELKR

SEQ ID NO: 35583 - protein, 13 aa, Homo sapiens
ILASTQFEPTAAR

SEQ ID NO: 35584 - protein, 29 aa, Homo sapiens
KCFDAMEVDALNSSHPVSTPVENPAQIRE

SEQ ID NO: 35585 - protein, 13 aa, Homo sapiens
NPVGYPLAWQFLR

SEQ ID NO: 35586 - protein, 18 aa, Homo sapiens
SQHSSSSSHWHQEGVDVK

SEQ ID NO: 35587 - protein, 13 aa, Homo sapiens
TQEFPQILTLIGR

SEQ ID NO: 35588 - protein, 10 aa, Homo sapiens
YQFSLSSTEK

SEQ ID NO: 35589 - protein, 20 aa, Homo sapiens
HVDLLEVAQETDGFSGSDLK

SEQ ID NO: 35590 - protein, 16 aa, Homo sapiens
LQPSIIFIDEIDSFLR

SEQ ID NO: 35591 - protein, 24 aa, Homo sapiens
KQDGAVAMEMQPLKSAEGGEMEER

SEQ ID NO: 35592 - protein, 26 aa, Homo sapiens
STPTHAILSAANPTSAAGNPGGESVP

SEQ ID NO: 35593 - protein, 17 aa, Homo sapiens
DHADVSNQLYACYAIGK

SEQ ID NO: 35594 - protein, 20 aa, Homo sapiens
IPIFSAAGLPHNEIAAQICR

SEQ ID NO: 35595 - protein, 27 aa, Homo sapiens
SDFEENGSMDNVCLFLNLANDPTIERI

SEQ ID NO: 35596 - protein, 17 aa, Homo sapiens
AITLAIGDGANDVNMIK

SEQ ID NO: 35597 - protein, 12 aa, Homo sapiens
MSLEITDQYLQR

SEQ ID NO: 35598 - protein, 20 aa, Homo sapiens
DPSQVENLASSLQLITECFR

SEQ ID NO: 35599 - protein, 14 aa, Homo sapiens
HAELIASTFVDQCK

SEQ ID NO: 35600 - protein, 17 aa, Homo sapiens
HPESEWPFLIITDLFLK

SEQ ID NO: 35601 - protein, 27 aa, Homo sapiens
NEDSQSIVWVHAFPELFLSCLNHPDKK

SEQ ID NO: 35602 - protein, 10 aa, Homo sapiens
SSHAVELACR

SEQ ID NO: 35603 - protein, 11 aa, Homo sapiens
ALHPEEDPEGR

SEQ ID NO: 35604 - protein, 14 aa, Homo sapiens
ALHPEEDPEGRQGR

SEQ ID NO: 35605 - protein, 11 aa, Homo sapiens
DVLEGDSSEDR

SEQ ID NO: 35606 - protein, 14 aa, Homo sapiens
EACYGDMDGFPGVR

SEQ ID NO: 35607 - protein, 8 aa, Homo sapiens
EAEVLVAR

SEQ ID NO: 35608 - protein, 12 aa, Homo sapiens
ELEAPSEDNSGR

SEQ ID NO: 35609 - protein, 10 aa, Homo sapiens
EYQWIGLNDR

SEQ ID NO: 35610 - protein, 27 aa, Homo sapiens
GAIYSIPIMEDGGGGSSTPEDPAEAPR

SEQ ID NO: 35611 - protein, 10 aa, Homo sapiens
GREAEVLVAR

SEQ ID NO: 35612 - protein, 16 aa, Homo sapiens
KTLFLFPNQTGFPNKH

SEQ ID NO: 35613 - protein, 10 aa, Homo sapiens
LRYEVDTVLR

SEQ ID NO: 35614 - protein, 21 aa, Homo sapiens
MYGAHLASISTPEEQDFINNR

SEQ ID NO: 35615 - protein, 31 aa, Homo sapiens
RVALPAYPASLTDVSLALSELRPNDSGIYRC

SEQ ID NO: 35616 - protein, 29 aa, Homo sapiens
SRGAIYSIPIMEDGGGGSSTPEDPAEAPR

SEQ ID NO: 35617 - protein, 9 aa, Homo sapiens
YPIVTPSQR

SEQ ID NO: 35618 - protein, 30 aa, Homo sapiens
AGSRESEQGVYTCTAQGIWKNEQKGEKIPR

SEQ ID NO: 35619 - protein, 17 aa, Homo sapiens
AKMGNFPWQVFTNIHGR

SEQ ID NO: 35620 - protein, 15 aa, Homo sapiens
AVDLLFFTDESGDSR

SEQ ID NO: 35621 - protein, 15 aa, Homo sapiens
CLPVCGKPVNPVEQR

SEQ ID NO: 35622 - protein, 6 aa, Homo sapiens
CNYSIR

SEQ ID NO: 35623 - protein, 14 aa, Homo sapiens
DLEPSEGCFYDYVK

SEQ ID NO: 35624 - protein, 8 aa, Homo sapiens
DYFIATCK

SEQ ID NO: 35625 - protein, 24 aa, Homo sapiens
EHEAQSNASLDVFLGHTNVEELMK

SEQ ID NO: 35626 - protein, 16 aa, Homo sapiens
ESEQGVYTCTAQGIWK

SEQ ID NO: 35627 - protein, 15 aa, Homo sapiens
FCGQLGSPLGNPPGK

SEQ ID NO: 35628 - protein, 16 aa, Homo sapiens
FCGQLGSPLGNPPGKK

SEQ ID NO: 35629 - protein, 27 aa, Homo sapiens
FLEPFDIDDHQQVHCPYDQLQIYANGK

SEQ ID NO: 35630 - protein, 12 aa, Homo sapiens
FPWQVFTNIHGR

SEQ ID NO: 35631 - protein, 17 aa, Homo sapiens
FVRLPVANPQACENWLR

SEQ ID NO: 35632 - protein, 17 aa, Homo sapiens
GFLAYYQAVDLDECASR

SEQ ID NO: 35633 - protein, 9 aa, Homo sapiens
GGGALLGDR

SEQ ID NO: 35634 - protein, 21 aa, Homo sapiens
GGGALLGDRWILTAAHTLYPK

SEQ ID NO: 35635 - protein, 7 aa, Homo sapiens
GLTLHLK

SEQ ID NO: 35636 - protein, 7 aa, Homo sapiens
GYGFYTK

SEQ ID NO: 35637 - protein, 26 aa, Homo sapiens
HSCQAECSSELYTEASGYISSLEYPR

SEQ ID NO: 35638 - protein, 16 aa, Homo sapiens
HTDFSNEENGTIMFYK

SEQ ID NO: 35639 - protein, 11 aa, Homo sapiens
IQYYCHEPYYK

SEQ ID NO: 35640 - protein, 26 aa, Homo sapiens
KEHEAQSNASLDVFLGHTNVEELMKL

SEQ ID NO: 35641 - protein, 23 aa, Homo sapiens
KMLLTFHTDFSNEENGTIMFYKG

SEQ ID NO: 35642 - protein, 12 aa, Homo sapiens
LFGEVTSPLFPK

SEQ ID NO: 35643 - protein, 31 aa, Homo sapiens
LFGEVTSPLFPKPYPNNFETTTVITVPTGYR

SEQ ID NO: 35644 - protein, 11 aa, Homo sapiens
LGHTNVEELMK

SEQ ID NO: 35645 - protein, 7 aa, Homo sapiens
LGNHPIR

SEQ ID NO: 35646 - protein, 11 aa, Homo sapiens
LGSPLGNPPGK

SEQ ID NO: 35647 - protein, 30 aa, Homo sapiens
LLPICLPDNDTFYDLGLMGYVSGFGVMEEK

SEQ ID NO: 35648 - protein, 14 aa, Homo sapiens
LPVANPQACENWLR

SEQ ID NO: 35649 - protein, 15 aa, Homo sapiens
LPVANPQACENWLRG

SEQ ID NO: 35650 - protein, 20 aa, Homo sapiens
LVFQQFDLEPSEGCFYDYVK

SEQ ID NO: 35651 - protein, 9 aa, Homo sapiens
MDVFSQNMF

SEQ ID NO: 35652 - protein, 17 aa, Homo sapiens
MDVFSQNMFCAGHPSLK

SEQ ID NO: 35653 - protein, 15 aa, Homo sapiens
MGNFPWQVFTNIHGR

SEQ ID NO: 35654 - protein, 21 aa, Homo sapiens
MLLTFHTDFSNEENGTIMFYK

SEQ ID NO: 35655 - protein, 15 aa, Homo sapiens
NFETTTVITVPTGYR

SEQ ID NO: 35656 - protein, 8 aa, Homo sapiens
NIGEFCGK

SEQ ID NO: 35657 - protein, 32 aa, Homo sapiens
NLLPICLPDNDTFYDLGLMGYVSGFGVMEEKI

SEQ ID NO: 35658 - protein, 8 aa, Homo sapiens
NLPNGDFR

SEQ ID NO: 35659 - protein, 21 aa, Homo sapiens
NLPNGDFRYTTTMGVNTYKAR

SEQ ID NO: 35660 - protein, 19 aa, Homo sapiens
NRMDVFSQNMFCAGHPSLK

SEQ ID NO: 35661 - protein, 9 aa, Homo sapiens
PGYELQEDR

SEQ ID NO: 35662 - protein, 19 aa, Homo sapiens
PNGDFRYTTTMGVNTYKAR

SEQ ID NO: 35663 - protein, 8 aa, Homo sapiens
PVNPVEQR

SEQ ID NO: 35664 - protein, 11 aa, Homo sapiens
PWQVFTNIHGR

SEQ ID NO: 35665 - protein, 19 aa, Homo sapiens
PYPNNFETTTVITVPTGYR

SEQ ID NO: 35666 - protein, 15 aa, Homo sapiens
QDACQGDSGGVFAVR

SEQ ID NO: 35667 - protein, 25 aa, Homo sapiens
QDESYNFEGDIALLELENSVTLGPN

SEQ ID NO: 35668 - protein, 11 aa, Homo sapiens
QGDSGGVFAVR

SEQ ID NO: 35669 - protein, 13 aa, Homo sapiens
QGYQLIEGNQVLH

SEQ ID NO: 35670 - protein, 15 aa, Homo sapiens
QGYQLIEGNQVLHSF

SEQ ID NO: 35671 - protein, 27 aa, Homo sapiens
QGYQLIEGNQVLHSFTAVCQDDGTWHR

SEQ ID NO: 35672 - protein, 26 aa, Homo sapiens
QRPPDLDTSSNAVDLLFFTDESGDSR

SEQ ID NO: 35673 - protein, 8 aa, Homo sapiens
RCNYSIRV

SEQ ID NO: 35674 - protein, 27 aa, Homo sapiens
RHSCQAECSSELYTEASGYISSLEYPR

SEQ ID NO: 35675 - protein, 19 aa, Homo sapiens
SSELYTEASGYISSLEYPR

SEQ ID NO: 35676 - protein, 13 aa, Homo sapiens
SYPPDLRCNYSIR

SEQ ID NO: 35677 - protein, 13 aa, Homo sapiens
TIIQNLQPQYQFR

SEQ ID NO: 35678 - protein, 14 aa, Homo sapiens
TLDEFTIIQNLQPQ

SEQ ID NO: 35679 - protein, 18 aa, Homo sapiens
TLDEFTIIQNLQPQYQFR

SEQ ID NO: 35680 - protein, 9 aa, Homo sapiens
VLNYVDWIK

SEQ ID NO: 35681 - protein, 16 aa, Homo sapiens
VLNYVDWIKKEMEEED

SEQ ID NO: 35682 - protein, 10 aa, Homo sapiens
VSGFGVMEEK

SEQ ID NO: 35683 - protein, 8 aa, Homo sapiens
VSVHPDYR

SEQ ID NO: 35684 - protein, 12 aa, Homo sapiens
WILTAAHTLYPK

SEQ ID NO: 35685 - protein, 15 aa, Homo sapiens
WVATGIVSWGIGCSR

SEQ ID NO: 35686 - protein, 16 aa, Homo sapiens
WVATGIVSWGIGCSRG

SEQ ID NO: 35687 - protein, 7 aa, Homo sapiens
YTTEIIK

SEQ ID NO: 35688 - protein, 12 aa, Homo sapiens
YTTEIIKCPQPK

SEQ ID NO: 35689 - protein, 11 aa, Homo sapiens
YTTTMGVNTYK

SEQ ID NO: 35690 - protein, 18 aa, Homo sapiens
KEYPNLSTSLDDAFLLRF

SEQ ID NO: 35691 - protein, 15 aa, Homo sapiens
RALNITSLQMHSLRL

SEQ ID NO: 35692 - protein, 26 aa, Homo sapiens
RHVSFLPAPRPVVNVSGGPLLYSHRL

SEQ ID NO: 35693 - protein, 17 aa, Homo sapiens
RPVVNVSGGPLLYSHRL

SEQ ID NO: 35694 - protein, 11 aa, Homo sapiens
DVAQIFNNILR

SEQ ID NO: 35695 - protein, 22 aa, Homo sapiens
EILYGTNEKEPQTEAVAQLAQE

SEQ ID NO: 35696 - protein, 35 aa, Homo sapiens
EPQTEAVAQLAQELYNSGLLSTLVADLQLIDFEGK

SEQ ID NO: 35697 - protein, 36 aa, Homo sapiens
EPQTEAVAQLAQELYNSGLLSTLVADLQLIDFEGKK

SEQ ID NO: 35698 - protein, 10 aa, Homo sapiens
NYVTKRQSLK

SEQ ID NO: 35699 - protein, 9 aa, Homo sapiens
YISKPENLK

SEQ ID NO: 35700 - protein, 11 aa, Homo sapiens
AKLEETITQAR

SEQ ID NO: 35701 - protein, 20 aa, Homo sapiens
EAGENWQENPETYEDSFYKR

SEQ ID NO: 35702 - protein, 17 aa, Homo sapiens
EPVTLDFLDAELENDIK

SEQ ID NO: 35703 - protein, 28 aa, Homo sapiens
FENKTNLKNQLILGVMGVDVSLEDIKRL

SEQ ID NO: 35704 - protein, 11 aa, Homo sapiens
FFGEIDPSLMR

SEQ ID NO: 35705 - protein, 10 aa, Homo sapiens
FVVTDGGITR

SEQ ID NO: 35706 - protein, 12 aa, Homo sapiens
IDVNSWIENFTK

SEQ ID NO: 35707 - protein, 12 aa, Homo sapiens
IIMLFTDGGEER

SEQ ID NO: 35708 - protein, 13 aa, Homo sapiens
IKPVFIEDANFGR

SEQ ID NO: 35709 - protein, 12 aa, Homo sapiens
INTQEYLDVLGR

SEQ ID NO: 35710 - protein, 18 aa, Homo sapiens
ISDNNTEFLLNFNEFIDR

SEQ ID NO: 35711 - protein, 11 aa, Homo sapiens
KDAVNNITAKG

SEQ ID NO: 35712 - protein, 18 aa, Homo sapiens
KDDLDPEKNDSEPGSQRI

SEQ ID NO: 35713 - protein, 18 aa, Homo sapiens
KGFSFAFEQLLNYNVSRA

SEQ ID NO: 35714 - protein, 14 aa, Homo sapiens
KIDVNSWIENFTKT

SEQ ID NO: 35715 - protein, 20 aa, Homo sapiens
KISDNNTEFLLNFNEFIDRK

SEQ ID NO: 35716 - protein, 15 aa, Homo sapiens
KSFSGVLDCGNCSRI

SEQ ID NO: 35717 - protein, 23 aa, Homo sapiens
MKDSETLKPDNFEESGYTFIAPR

SEQ ID NO: 35718 - protein, 14 aa, Homo sapiens
RHLVNISVYAFNKS

SEQ ID NO: 35719 - protein, 18 aa, Homo sapiens
RSLDNDNYVFTAPYFNKS

SEQ ID NO: 35720 - protein, 14 aa, Homo sapiens
SGPGAYESGIMVSK

SEQ ID NO: 35721 - protein, 15 aa, Homo sapiens
SWVDKMQEDLVTLAK

SEQ ID NO: 35722 - protein, 14 aa, Homo sapiens
TASGVNQLVDIYEK

SEQ ID NO: 35723 - protein, 14 aa, Homo sapiens
VEMEDDDFTASLSK

SEQ ID NO: 35724 - protein, 18 aa, Homo sapiens
VLLDAGFTNELVQNYWSK

SEQ ID NO: 35725 - protein, 16 aa, Homo sapiens
NLLYDLGFDSSDDDGF

SEQ ID NO: 35726 - protein, 22 aa, Homo sapiens
YQSPQPAISVPQSPFLGQQEPR

SEQ ID NO: 35727 - protein, 28 aa, Homo sapiens
RSITKNPKIGGLPLIPIQHEGNATLARK

SEQ ID NO: 35728 - protein, 23 aa, Homo sapiens
ACTSQGCGKPITEESSTLGEGSK

SEQ ID NO: 35729 - protein, 27 aa, Homo sapiens
ACTSQGCGKPITEESSTLGEGSKGIGK

SEQ ID NO: 35730 - protein, 10 aa, Homo sapiens
EMIIKWEPLK

SEQ ID NO: 35731 - protein, 22 aa, Homo sapiens
EMIIKWEPLKSMEQNGPGLEYR

SEQ ID NO: 35732 - protein, 25 aa, Homo sapiens
GAGPESEPYIFQTPEGVPEQPTFLK

SEQ ID NO: 35733 - protein, 11 aa, Homo sapiens
GDLYFANVEEK

SEQ ID NO: 35734 - protein, 22 aa, Homo sapiens
GNPEPTFSWTKDGNPFYFTDHR

SEQ ID NO: 35735 - protein, 15 aa, Homo sapiens
IEIPSSVQQVPTIIK

SEQ ID NO: 35736 - protein, 13 aa, Homo sapiens
IENVSYQDKGNYR

SEQ ID NO: 35737 - protein, 16 aa, Homo sapiens
KDGEAFEINGTEDGRI

SEQ ID NO: 35738 - protein, 16 aa, Homo sapiens
KHANDSSSSTEIGSKA

SEQ ID NO: 35739 - protein, 11 aa, Homo sapiens
KISGVNLTQKT

SEQ ID NO: 35740 - protein, 13 aa, Homo sapiens
KTTVILPLAPFVR

SEQ ID NO: 35741 - protein, 45 aa, Homo sapiens
KVQAINQLGSGPDPQSVTLYSGEDYPDTAPVIHGVDVINSTLVKV

SEQ ID NO: 35742 - protein, 11 aa, Homo sapiens
LHMLELHCESK

SEQ ID NO: 35743 - protein, 10 aa, Homo sapiens
LKGYQINWWK

SEQ ID NO: 35744 - protein, 13 aa, Homo sapiens
RIIPSNNSGTFRI

SEQ ID NO: 35745 - protein, 31 aa, Homo sapiens
RLTWEAGADHNSNISEYIVEFEGNKEEPGRW

SEQ ID NO: 35746 - protein, 25 aa, Homo sapiens
RVTWKPQGAPVEWEEETVTNHTLRV

SEQ ID NO: 35747 - protein, 15 aa, Homo sapiens
RYHIYENGTLQINRT

SEQ ID NO: 35748 - protein, 16 aa, Homo sapiens
SLLDGRTHPKEVNILR

SEQ ID NO: 35749 - protein, 25 aa, Homo sapiens
SQPSQPSDHHETPPAAPDRNPQNIR

SEQ ID NO: 35750 - protein, 10 aa, Homo sapiens
TAVTANLDIR

SEQ ID NO: 35751 - protein, 10 aa, Homo sapiens
THPKEVNILR

SEQ ID NO: 35752 - protein, 16 aa, Homo sapiens
TLKIENVSYQDKGNYR

SEQ ID NO: 35753 - protein, 12 aa, Homo sapiens
TTVILPLAPFVR

SEQ ID NO: 35754 - protein, 10 aa, Homo sapiens
VEEVKPLEGR

SEQ ID NO: 35755 - protein, 9 aa, Homo sapiens
VIAVNEVGR

SEQ ID NO: 35756 - protein, 17 aa, Homo sapiens
VIKVDKDTATLSWGLPK

SEQ ID NO: 35757 - protein, 13 aa, Homo sapiens
VMTPAVYAPYDVK

SEQ ID NO: 35758 - protein, 19 aa, Homo sapiens
VNGSPVDNHPFAGDVVFPR

SEQ ID NO: 35759 - protein, 10 aa, Homo sapiens
VSPKNPRIPK

SEQ ID NO: 35760 - protein, 10 aa, Homo sapiens
VTWSTVPKDR

SEQ ID NO: 35761 - protein, 21 aa, Homo sapiens
WRVNGSPVDNHPFAGDVVFPR

SEQ ID NO: 35762 - protein, 21 aa, Homo sapiens
YPDTAPVIHGVDVINSTLVKV

SEQ ID NO: 35763 - protein, 9 aa, Homo sapiens
FGISSVPTK

SEQ ID NO: 35764 - protein, 19 aa, Homo sapiens
FGIVTSSAGTGTTEDTEAK

SEQ ID NO: 35765 - protein, 14 aa, Homo sapiens
KAMENESEVTGYKV

SEQ ID NO: 35766 - protein, 16 aa, Homo sapiens
KANGTTHLVVTEPTRI

SEQ ID NO: 35767 - protein, 11 aa, Homo sapiens
KVAGNETSARL

SEQ ID NO: 35768 - protein, 10 aa, Homo sapiens
LQFAYLENFK

SEQ ID NO: 35769 - protein, 12 aa, Homo sapiens
LSNGHLLGYEVR

SEQ ID NO: 35770 - protein, 11 aa, Homo sapiens
VLGSPTPLVLR

SEQ ID NO: 35771 - protein, 19 aa, Homo sapiens
ATTAGILATLSHCIELMVK

SEQ ID NO: 35772 - protein, 12 aa, Homo sapiens
AVITPHDFDECR

SEQ ID NO: 35773 - protein, 30 aa, Homo sapiens
KIPALTENDPETWIVCNFSVDHDSAPLNNR

SEQ ID NO: 35774 - protein, 20 aa, Homo sapiens
LHWPTSLPSGDAFSSVGTHR

SEQ ID NO: 35775 - protein, 31 aa, Homo sapiens
SHFGGPDYEEGPNSLINEEEFFDAVEAALDR

SEQ ID NO: 35776 - protein, 10 aa, Homo sapiens
DQDGEILLPR

SEQ ID NO: 35777 - protein, 12 aa, Homo sapiens
EVEELMEDTQHK

SEQ ID NO: 35778 - protein, 20 aa, Homo sapiens
FPVCTPLPVEGELCHDPASR

SEQ ID NO: 35779 - protein, 23 aa, Homo sapiens
GLLFPVCTPLPVEGELCHDPASR

SEQ ID NO: 35780 - protein, 27 aa, Homo sapiens
KITNNQTGQMVFSETVITSVGDEEGRR

SEQ ID NO: 35781 - protein, 12 aa, Homo sapiens
KVGNNTIHVHRE

SEQ ID NO: 35782 - protein, 19 aa, Homo sapiens
PVCTPLPVEGELCHDPASR

SEQ ID NO: 35783 - protein, 13 aa, Homo sapiens
PVEGELCHDPASR

SEQ ID NO: 35784 - protein, 13 aa, Homo sapiens
RGSNGTICDNQRD

SEQ ID NO: 35785 - protein, 14 aa, Homo sapiens
SAVEEMEAEEAAAK

SEQ ID NO: 35786 - protein, 15 aa, Homo sapiens
EHEHQLVLLQCEIQK

SEQ ID NO: 35787 - protein, 19 aa, Homo sapiens
GLEPETFQNFDGDHACSVR

SEQ ID NO: 35788 - protein, 16 aa, Homo sapiens
KDKLDETNNTLRCLKL

SEQ ID NO: 35789 - protein, 8 aa, Homo sapiens
QLNQTTGK

SEQ ID NO: 35790 - protein, 11 aa, Homo sapiens
DAYKPITDADK

SEQ ID NO: 35791 - protein, 17 aa, Homo sapiens
DLDFDWHKEKADQLVER

SEQ ID NO: 35792 - protein, 15 aa, Homo sapiens
FILADGASQGMAAFR

SEQ ID NO: 35793 - protein, 10 aa, Homo sapiens
FQVEQIGDNK

SEQ ID NO: 35794 - protein, 9 aa, Homo sapiens
IKCEQLNLK

SEQ ID NO: 35795 - protein, 7 aa, Homo sapiens
KLDKVLK

SEQ ID NO: 35796 - protein, 13 aa, Homo sapiens
KLNDALDRLEELR

SEQ ID NO: 35797 - protein, 28 aa, Homo sapiens
KVNNSGISLCNLISAVTTPAKAIAAVKS

SEQ ID NO: 35798 - protein, 11 aa, Homo sapiens
LDDMLSELRDK

SEQ ID NO: 35799 - protein, 8 aa, Homo sapiens
MNLIDNHK

SEQ ID NO: 35800 - protein, 12 aa, Homo sapiens
QNVNKVQELKDK

SEQ ID NO: 35801 - protein, 23 aa, Homo sapiens
SELNVVLQNMNQVYSMSSTYIDK

SEQ ID NO: 35802 - protein, 6 aa, Homo sapiens
SLEDTK

SEQ ID NO: 35803 - protein, 19 aa, Homo sapiens
VGGGWMALDEFLVKNDPCR

SEQ ID NO: 35804 - protein, 12 aa, Homo sapiens
YVAADTLYSQIK

SEQ ID NO: 35805 - protein, 24 aa, Homo sapiens
SISHDNNNISSTSELGTDLANTKV

SEQ ID NO: 35806 - protein, 33 aa, Homo sapiens
EEIDGLQEELDIVINLGSELIAACGEPDKPIVK

SEQ ID NO: 35807 - protein, 13 aa, Homo sapiens
FWCDHMSLIVTIK

SEQ ID NO: 35808 - protein, 20 aa, Homo sapiens
HHVLQNDVLAHQSTVEAVNK

SEQ ID NO: 35809 - protein, 16 aa, Homo sapiens
VPEGGEGIGANDVEVK

SEQ ID NO: 35810 - protein, 14 aa, Homo sapiens
FHTGLVDAHLYCLK

SEQ ID NO: 35811 - protein, 21 aa, Homo sapiens
LLSALCPEEPPVHSSAQIVSK

SEQ ID NO: 35812 - protein, 20 aa, Homo sapiens
PLLPVGNKPLIWYPLNLLER

SEQ ID NO: 35813 - protein, 31 aa, Homo sapiens
EHGGPEGMDPDGVIESNWNEIVDNFDDMNLK

SEQ ID NO: 35814 - protein, 16 aa, Homo sapiens
GIYAYGFEKPSAIQQR

SEQ ID NO: 35815 - protein, 14 aa, Homo sapiens
KGVAINFVTEEDKR

SEQ ID NO: 35816 - protein, 15 aa, Homo sapiens
LQAEAPHIVVGTPGR

SEQ ID NO: 35817 - protein, 10 aa, Homo sapiens
VLITTDLLAR

SEQ ID NO: 35818 - protein, 17 aa, Homo sapiens
KINSSVTDIEEIIGVRI

SEQ ID NO: 35819 - protein, 15 aa, Homo sapiens
KTGALTVQNTTQLRS

SEQ ID NO: 35820 - protein, 17 aa, Homo sapiens
RFANLTPEEFVGDYWRN

SEQ ID NO: 35821 - protein, 14 aa, Homo sapiens
RNSELIANGSSHRI

SEQ ID NO: 35822 - protein, 26 aa, Homo sapiens
KMSHPPNIPKEQTPAGTSNTTSVSVK

SEQ ID NO: 35823 - protein, 8 aa, Homo sapiens
AFFAGSQR

SEQ ID NO: 35824 - protein, 9 aa, Homo sapiens
AHAHLDTGR

SEQ ID NO: 35825 - protein, 23 aa, Homo sapiens
ALLDSLQLGPDSLTVHLIHEVTK

SEQ ID NO: 35826 - protein, 32 aa, Homo sapiens
DEADVLEVDQGFDDHNLPCDVIWLDIEHADGK

SEQ ID NO: 35827 - protein, 15 aa, Homo sapiens
DENSVELTMAEGPYK

SEQ ID NO: 35828 - protein, 25 aa, Homo sapiens
DGSDYEGWCWPGSAGYPDFTNPTMR

SEQ ID NO: 35829 - protein, 17 aa, Homo sapiens
FGAVWTGDNTAEWDHLK

SEQ ID NO: 35830 - protein, 27 aa, Homo sapiens
FSFSGNTLVSSSADPEGHFETPIWIER

SEQ ID NO: 35831 - protein, 9 aa, Homo sapiens
GLLEFEHQR

SEQ ID NO: 35832 - protein, 21 aa, Homo sapiens
HHGPQTLYLPVTLSSIPVFQR

SEQ ID NO: 35833 - protein, 11 aa, Homo sapiens
KLVAIVDPHIK

SEQ ID NO: 35834 - protein, 15 aa, Homo sapiens
KPGINVASDWSIHLR

SEQ ID NO: 35835 - protein, 15 aa, Homo sapiens
LSFQHDPETSVLVLR

SEQ ID NO: 35836 - protein, 10 aa, Homo sapiens
LVAIVDPHIK

SEQ ID NO: 35837 - protein, 31 aa, Homo sapiens
LYNLDVFQYELYNPMALYGSVPVLLAHNPHR

SEQ ID NO: 35838 - protein, 17 aa, Homo sapiens
MMDYLQGSGETPQTDVR

SEQ ID NO: 35839 - protein, 9 aa, Homo sapiens
NPEPELLVR

SEQ ID NO: 35840 - protein, 23 aa, Homo sapiens
QYASLTGTQALPPLFSLGYHQSR

SEQ ID NO: 35841 - protein, 15 aa, Homo sapiens
REPWLLPSQHNDIIR

SEQ ID NO: 35842 - protein, 10 aa, Homo sapiens
SIRPGLSPYR

SEQ ID NO: 35843 - protein, 9 aa, Homo sapiens
SLLLSVNAR

SEQ ID NO: 35844 - protein, 25 aa, Homo sapiens
SVGLDFSLPGMEHVYGIPEHADNLR

SEQ ID NO: 35845 - protein, 36 aa, Homo sapiens
THSDSKPYGPMSVGLDFSLPGMEHVYGIPEHADNLR

SEQ ID NO: 35846 - protein, 21 aa, Homo sapiens
TLVSSSADPEGHFETPIWIER

SEQ ID NO: 35847 - protein, 17 aa, Homo sapiens
VVIIGAGKPAAVVLQTK

SEQ ID NO: 35848 - protein, 12 aa, Homo sapiens
WYQMGAYQPFFR

SEQ ID NO: 35849 - protein, 16 aa, Homo sapiens
YSLLPFWYTLLYQAHR

SEQ ID NO: 35850 - protein, 21 aa, Homo sapiens
GSQECFQFILPALPHAIDLLR

SEQ ID NO: 35851 - protein, 35 aa, Homo sapiens
GVQCEEEEEEKKDSGVASTEDSSSSHITAAAIAAK

SEQ ID NO: 35852 - protein, 20 aa, Homo sapiens
IVPDEIEEIKETLIDWCDEK

SEQ ID NO: 35853 - protein, 20 aa, Homo sapiens
REAPGMALAMLMGSLNVTPL

SEQ ID NO: 35854 - protein, 37 aa, Homo sapiens
STLLATIQEHGYPTINLGIVGDNPDDLLNALNEGISR

SEQ ID NO: 35855 - protein, 12 aa, Homo sapiens
RGNLTGAPGQRL

SEQ ID NO: 35856 - protein, 14 aa, Homo sapiens
RRVNYTMDVFELKS

SEQ ID NO: 35857 - protein, 28 aa, Homo sapiens
SLERFIHGGANVTGFQLVDFNTPMVTKL

SEQ ID NO: 35858 - protein, 8 aa, Homo sapiens
GYPHWPAR

SEQ ID NO: 35859 - protein, 20 aa, Homo sapiens
KEEENKSSSEGGDAGNDTRN

SEQ ID NO: 35860 - protein, 17 aa, Homo sapiens
YPIFFFGTHETAFLGPK

SEQ ID NO: 35861 - protein, 15 aa, Homo sapiens
KSLNVSSSVNQASRL

SEQ ID NO: 35862 - protein, 14 aa, Homo sapiens
LLQLILGCAINCEK

SEQ ID NO: 35863 - protein, 18 aa, Homo sapiens
LVSGGGACSDTGACTPAR

SEQ ID NO: 35864 - protein, 32 aa, Homo sapiens
KNWSALLTAVVIILTIAGNILVIMAVSLEKKL

SEQ ID NO: 35865 - protein, 12 aa, Homo sapiens
RFINYNQTVSRM

SEQ ID NO: 35866 - protein, 18 aa, Homo sapiens
RPILQSLLLPVMDQDYAK

SEQ ID NO: 35867 - protein, 16 aa, Homo sapiens
TTAHFPHPPQCTLLVK

SEQ ID NO: 35868 - protein, 35 aa, Homo sapiens
LPSNSLGFTATHNTSPAAPPTEVTICQSSEVSKPK

SEQ ID NO: 35869 - protein, 17 aa, Homo sapiens
LSDTTEYQPILSSYSHR

SEQ ID NO: 35870 - protein, 21 aa, Homo sapiens
NGPSLTEALENAGIFYEAQYK

SEQ ID NO: 35871 - protein, 35 aa, Homo sapiens
RSPSPSKNDSFFTPDSNHNSLSQSTTGHLSLPQKQ

SEQ ID NO: 35872 - protein, 27 aa, Homo sapiens
RFVEGTNINRSLLALGNVINALADSKR

SEQ ID NO: 35873 - protein, 15 aa, Homo sapiens
NEHNSILQSLLETLK

SEQ ID NO: 35874 - protein, 21 aa, Homo sapiens
TSGHDHPDVATMLNILALVYR

SEQ ID NO: 35875 - protein, 29 aa, Homo sapiens
AQNVTLEAILQNATSDNPVVQLSAVQAAR

SEQ ID NO: 35876 - protein, 33 aa, Homo sapiens
AVGNIVTGTDEQTQVVLNCDVLSHFPNLLSHPK

SEQ ID NO: 35877 - protein, 25 aa, Homo sapiens
SPHQNVCEQAVWALGNIIGDGPQCR

SEQ ID NO: 35878 - protein, 13 aa, Homo sapiens
ATSYTLVESFSGK

SEQ ID NO: 35879 - protein, 7 aa, Homo sapiens
GSVFPHR

SEQ ID NO: 35880 - protein, 11 aa, Homo sapiens
GTDYEVCIENR

SEQ ID NO: 35881 - protein, 13 aa, Homo sapiens
GVENSSYLVALDK

SEQ ID NO: 35882 - protein, 10 aa, Homo sapiens
INFLCEIEIK

SEQ ID NO: 35883 - protein, 25 aa, Homo sapiens
IPALSHGDYEITINSLHDFGSSTSK

SEQ ID NO: 35884 - protein, 12 aa, Homo sapiens
KQHLTTEASPSK

SEQ ID NO: 35885 - protein, 10 aa, Homo sapiens
LNPYTLYTFR

SEQ ID NO: 35886 - protein, 11 aa, Homo sapiens
LSWHLPGNFAK

SEQ ID NO: 35887 - protein, 11 aa, Homo sapiens
QHLTTEASPSK

SEQ ID NO: 35888 - protein, 8 aa, Homo sapiens
SNVIWEIK

SEQ ID NO: 35889 - protein, 24 aa, Homo sapiens
VLSALIGHTNCPLIHLDGENVAIK

SEQ ID NO: 35890 - protein, 8 aa, Homo sapiens
VTALVGPR

SEQ ID NO: 35891 - protein, 10 aa, Homo sapiens
VYPHTPTSFK

SEQ ID NO: 35892 - protein, 32 aa, Homo sapiens
RSIQKLGELNIGMDGLGNEVSALNQQCNGSKG

SEQ ID NO: 35893 - protein, 19 aa, Homo sapiens
NNPIESIPSYAFNRIPSLR

SEQ ID NO: 35894 - protein, 10 aa, Homo sapiens
YLNLAMCNLR

SEQ ID NO: 35895 - protein, 25 aa, Homo sapiens
MNSTDIQWSAILSWGYADNILRLKS

SEQ ID NO: 35896 - protein, 33 aa, Homo sapiens
MVISPSGFTASPYEGENSSNIIPQQMAAHMLRS

SEQ ID NO: 35897 - protein, 22 aa, Homo sapiens
KEIYHQNVQNLTHLQVVEVLKQ

SEQ ID NO: 35898 - protein, 29 aa, Homo sapiens
KHNSSSSALLNSPTVTTSSCAGASEKKKF

SEQ ID NO: 35899 - protein, 15 aa, Homo sapiens
KSEVNEMENNLTRRR

SEQ ID NO: 35900 - protein, 25 aa, Homo sapiens
RGHNSSNSPSLQAGGAEGAGDRGRD

SEQ ID NO: 35901 - protein, 15 aa, Homo sapiens
SQELNFVMDVNSSKY

SEQ ID NO: 35902 - protein, 17 aa, Homo sapiens
KVDSNDSLYGGDSKFLA

SEQ ID NO: 35903 - protein, 30 aa, Homo sapiens
RLMQGDQILMVNGEDVRNATQEAVAALLKC

SEQ ID NO: 35904 - protein, 13 aa, Homo sapiens
ECEGIVPVPLAEK

SEQ ID NO: 35905 - protein, 24 aa, Homo sapiens
GGYFLVDFYAPTAAVESMVEHLSR

SEQ ID NO: 35906 - protein, 17 aa, Homo sapiens
EEGCTHVIVTTACGSLR

SEQ ID NO: 35907 - protein, 17 aa, Homo sapiens
EEIQPGDIVIIDQFIDR

SEQ ID NO: 35908 - protein, 16 aa, Homo sapiens
PQIGSTEWSETLHNLK

SEQ ID NO: 35909 - protein, 17 aa, Homo sapiens
YVDTPFGKPSDALILGK

SEQ ID NO: 35910 - protein, 30 aa, Homo sapiens
FEIINAIYEPTEEECEWKPDEEDEISEELK

SEQ ID NO: 35911 - protein, 32 aa, Homo sapiens
FEIINAIYEPTEEECEWKPDEEDEISEELKEK

SEQ ID NO: 35912 - protein, 10 aa, Homo sapiens
FYEEVHDLER

SEQ ID NO: 35913 - protein, 11 aa, Homo sapiens
GIPEFWLTVFK

SEQ ID NO: 35914 - protein, 17 aa, Homo sapiens
LDGLVETPTGYIESLPR

SEQ ID NO: 35915 - protein, 18 aa, Homo sapiens
NVDLLSDMVQEHDEPILK

SEQ ID NO: 35916 - protein, 31 aa, Homo sapiens
RFEIINAIYEPTEEECEWKPDEEDEISEELK

SEQ ID NO: 35917 - protein, 27 aa, Homo sapiens
SEPDDSDPFSFDGPEIMGCTGCQIDWK

SEQ ID NO: 35918 - protein, 10 aa, Homo sapiens
VNALKNLQVK

SEQ ID NO: 35919 - protein, 12 aa, Homo sapiens
AARQAASDVQYK

SEQ ID NO: 35920 - protein, 7 aa, Homo sapiens
DAPELVQ

SEQ ID NO: 35921 - protein, 7 aa, Homo sapiens
EDLQVLK

SEQ ID NO: 35922 - protein, 15 aa, Homo sapiens
ENLHYTTVADRPDIK

SEQ ID NO: 35923 - protein, 14 aa, Homo sapiens
FTSIEDAPITVQSK

SEQ ID NO: 35924 - protein, 16 aa, Homo sapiens
GIGCYVWDTPEILHAK

SEQ ID NO: 35925 - protein, 16 aa, Homo sapiens
GIGCYVWDTPQILHAK

SEQ ID NO: 35926 - protein, 14 aa, Homo sapiens
GIGWVSIGSLDVEK

SEQ ID NO: 35927 - protein, 13 aa, Homo sapiens
GLTEMEDTPDMLR

SEQ ID NO: 35928 - protein, 6 aa, Homo sapiens
HAYDLR

SEQ ID NO: 35929 - protein, 26 aa, Homo sapiens
IGSLDVEKCKRATEILSDKIYRQPPD

SEQ ID NO: 35930 - protein, 9 aa, Homo sapiens
KAYEQAKGK

SEQ ID NO: 35931 - protein, 24 aa, Homo sapiens
KESLIMNHVLNTSQLASSYQYKKK

SEQ ID NO: 35932 - protein, 18 aa, Homo sapiens
KGRGLNAMANETPDFMRA

SEQ ID NO: 35933 - protein, 10 aa, Homo sapiens
KVKDEVSDLK

SEQ ID NO: 35934 - protein, 10 aa, Homo sapiens
KYRQHPDTVK

SEQ ID NO: 35935 - protein, 25 aa, Homo sapiens
KYRTKIETLNFTPVDDRVDYVTAKQ

SEQ ID NO: 35936 - protein, 9 aa, Homo sapiens
LEYNKAKPR

SEQ ID NO: 35937 - protein, 11 aa, Homo sapiens
LYKLSLEESKK

SEQ ID NO: 35938 - protein, 16 aa, Homo sapiens
MKIHIVPDMVEMVTAK

SEQ ID NO: 35939 - protein, 25 aa, Homo sapiens
MPDTPDILLAKSNSANISQKLYTKG

SEQ ID NO: 35940 - protein, 17 aa, Homo sapiens
QNAHTMNKHLYTIDWNK

SEQ ID NO: 35941 - protein, 21 aa, Homo sapiens
QRPETLKFTSITDTPEQVLAK

SEQ ID NO: 35942 - protein, 8 aa, Homo sapiens
RDLELEVK

SEQ ID NO: 35943 - protein, 16 aa, Homo sapiens
RVKRNQENFSSVLYKE

SEQ ID NO: 35944 - protein, 11 aa, Homo sapiens
SQAIASDVDYK

SEQ ID NO: 35945 - protein, 7 aa, Homo sapiens
SVYEKNK

SEQ ID NO: 35946 - protein, 8 aa, Homo sapiens
YEEEVLSR

SEQ ID NO: 35947 - protein, 12 aa, Homo sapiens
YLKEYQDLLNVK

SEQ ID NO: 35948 - protein, 21 aa, Homo sapiens
KEISVGELNPNETVQANLEAQ

SEQ ID NO: 35949 - protein, 11 aa, Homo sapiens
FACHSASLTVR

SEQ ID NO: 35950 - protein, 22 aa, Homo sapiens
FGQAATMEGIGAIGGTPPAFNR

SEQ ID NO: 35951 - protein, 23 aa, Homo sapiens
NLPQYVSNELLEEAFSVFGQVER

SEQ ID NO: 35952 - protein, 20 aa, Homo sapiens
AAICAGPTALLAHEIGFGSK

SEQ ID NO: 35953 - protein, 7 aa, Homo sapiens
ALVILAK

SEQ ID NO: 35954 - protein, 7 aa, Homo sapiens
APLVLKD

SEQ ID NO: 35955 - protein, 8 aa, Homo sapiens
DGLILTSR

SEQ ID NO: 35956 - protein, 14 aa, Homo sapiens
DVVICPDASLEDAK

SEQ ID NO: 35957 - protein, 15 aa, Homo sapiens
DVVICPDASLEDAKK

SEQ ID NO: 35958 - protein, 26 aa, Homo sapiens
EGPYDVVVLPGGNLGAQNLSESAAVK

SEQ ID NO: 35959 - protein, 9 aa, Homo sapiens
EILKEQENR

SEQ ID NO: 35960 - protein, 10 aa, Homo sapiens
EILKEQENRK

SEQ ID NO: 35961 - protein, 15 aa, Homo sapiens
GAEEMETVIPVDVMR

SEQ ID NO: 35962 - protein, 23 aa, Homo sapiens
GLIAAICAGPTALLAHEIGFGSK

SEQ ID NO: 35963 - protein, 19 aa, Homo sapiens
GPGTSFEFALAIVEALNGK

SEQ ID NO: 35964 - protein, 32 aa, Homo sapiens
ILKEQENRKGLIAAICAGPTALLAHEIGFGSK

SEQ ID NO: 35965 - protein, 27 aa, Homo sapiens
KEGPYDVVVLPGGNLGAQNLSESAAVK

SEQ ID NO: 35966 - protein, 13 aa, Homo sapiens
MMNGGHYTYSENR

SEQ ID NO: 35967 - protein, 16 aa, Homo sapiens
MMNGGHYTYSENRVEK

SEQ ID NO: 35968 - protein, 11 aa, Homo sapiens
VEKDGLILTSR

SEQ ID NO: 35969 - protein, 8 aa, Homo sapiens
VTTHPLAK

SEQ ID NO: 35970 - protein, 9 aa, Homo sapiens
VTVAGLAGK

SEQ ID NO: 35971 - protein, 16 aa, Homo sapiens
VTVAGLAGKDPVQCSR

SEQ ID NO: 35972 - protein, 16 aa, Homo sapiens
AVGDGILCNTYIDSYK

SEQ ID NO: 35973 - protein, 11 aa, Homo sapiens
DLPELALDTPR

SEQ ID NO: 35974 - protein, 23 aa, Homo sapiens
DPNYDDDQENCVYETVVLPLDER

SEQ ID NO: 35975 - protein, 18 aa, Homo sapiens
DSVWGSGGGQQSVNHLVK

SEQ ID NO: 35976 - protein, 16 aa, Homo sapiens
EYLLSGDISEAEHCLK

SEQ ID NO: 35977 - protein, 13 aa, Homo sapiens
FVEECFQAGIISK

SEQ ID NO: 35978 - protein, 9 aa, Homo sapiens
GTVDCVQAR

SEQ ID NO: 35979 - protein, 21 aa, Homo sapiens
IYNEIPDINLDVPHSYSVLER

SEQ ID NO: 35980 - protein, 23 aa, Homo sapiens
TLTPIIQEYFEHGDTNEVAEMLR

SEQ ID NO: 35981 - protein, 15 aa, Homo sapiens
DREGFFTNGLTLGAK

SEQ ID NO: 35982 - protein, 14 aa, Homo sapiens
SQGGEPTYNVAVGR

SEQ ID NO: 35983 - protein, 19 aa, Homo sapiens
KLRPVTLTEMNYSKYGAKE

SEQ ID NO: 35984 - protein, 16 aa, Homo sapiens
LCESLEELQNLNGKLR

SEQ ID NO: 35985 - protein, 14 aa, Homo sapiens
LHYHLGCLDPPLTR

SEQ ID NO: 35986 - protein, 14 aa, Homo sapiens
NHDQHLLLLCDTCK

SEQ ID NO: 35987 - protein, 13 aa, Homo sapiens
AAMADTFLEHMCR

SEQ ID NO: 35988 - protein, 25 aa, Homo sapiens
AEGSDVANAVLDGADCIMLSGETAK

SEQ ID NO: 35989 - protein, 17 aa, Homo sapiens
AGKPVICATQMLESMIK

SEQ ID NO: 35990 - protein, 8 aa, Homo sapiens
APIIAVTR

SEQ ID NO: 35991 - protein, 11 aa, Homo sapiens
CCSGAIIVLTK

SEQ ID NO: 35992 - protein, 11 aa, Homo sapiens
CDENILWLDYK

SEQ ID NO: 35993 - protein, 14 aa, Homo sapiens
DPVQEAWAEDVDLR

SEQ ID NO: 35994 - protein, 15 aa, Homo sapiens
FDEILEASDGIMVAR

SEQ ID NO: 35995 - protein, 16 aa, Homo sapiens
FGVEQDVDMVFASFIR

SEQ ID NO: 35996 - protein, 18 aa, Homo sapiens
GADFLVTEVENGGSLGSK

SEQ ID NO: 35997 - protein, 11 aa, Homo sapiens
GDLGIEIPAEK

SEQ ID NO: 35998 - protein, 21 aa, Homo sapiens
GDVVIVLTGWRPGSGFTNTMR

SEQ ID NO: 35999 - protein, 9 aa, Homo sapiens
GDYPLEAVR

SEQ ID NO: 36000 - protein, 8 aa, Homo sapiens
GIFPVLCK

SEQ ID NO: 36001 - protein, 22 aa, Homo sapiens
GIFPVLCKDPVQEAWAEDVDLR

SEQ ID NO: 36002 - protein, 11 aa, Homo sapiens
GSGTAEVELKK

SEQ ID NO: 36003 - protein, 15 aa, Homo sapiens
GVEQDVDMVFASFIR

SEQ ID NO: 36004 - protein, 17 aa, Homo sapiens
GVNLPGAAVDLPAVSEK

SEQ ID NO: 36005 - protein, 14 aa, Homo sapiens
HAAMADTFLEHMCR

SEQ ID NO: 36006 - protein, 8 aa, Homo sapiens
IENHEGVR

SEQ ID NO: 36007 - protein, 12 aa, Homo sapiens
IISKIENHEGVR

SEQ ID NO: 36008 - protein, 20 aa, Homo sapiens
IQTQQLHAAMADTFLEHMCR

SEQ ID NO: 36009 - protein, 10 aa, Homo sapiens
ITLDNAYMEK

SEQ ID NO: 36010 - protein, 13 aa, Homo sapiens
IYVDDGLISLQVK

SEQ ID NO: 36011 - protein, 15 aa, Homo sapiens
KASDVHEVRKVLGEK

SEQ ID NO: 36012 - protein, 19 aa, Homo sapiens
KGADFLVTEVENGGSLGSK

SEQ ID NO: 36013 - protein, 12 aa, Homo sapiens
KGDVVIVLTGWR

SEQ ID NO: 36014 - protein, 17 aa, Homo sapiens
KGDVVIVLTGWRPGSGF

SEQ ID NO: 36015 - protein, 19 aa, Homo sapiens
KGDVVIVLTGWRPGSGFTN

SEQ ID NO: 36016 - protein, 22 aa, Homo sapiens
KGDVVIVLTGWRPGSGFTNTMR

SEQ ID NO: 36017 - protein, 18 aa, Homo sapiens
KGVNLPGAAVDLPAVSEK

SEQ ID NO: 36018 - protein, 22 aa, Homo sapiens
LAPITSDPTEATAVGAVEASFK

SEQ ID NO: 36019 - protein, 11 aa, Homo sapiens
LDIDSPPITAR

SEQ ID NO: 36020 - protein, 16 aa, Homo sapiens
LNFSHGTHEYHAETIK

SEQ ID NO: 36021 - protein, 19 aa, Homo sapiens
LNFSHGTHEYHAETIKNVR

SEQ ID NO: 36022 - protein, 7 aa, Homo sapiens
MQHLIAR

SEQ ID NO: 36023 - protein, 15 aa, Homo sapiens
NFSHGTHEYHAETIK

SEQ ID NO: 36024 - protein, 18 aa, Homo sapiens
NFSHGTHEYHAETIKNVR

SEQ ID NO: 36025 - protein, 13 aa, Homo sapiens
NTGIICTIGPASR

SEQ ID NO: 36026 - protein, 29 aa, Homo sapiens
PHSEAGTAFIQTQQLHAAMADTFLEHMCR

SEQ ID NO: 36027 - protein, 20 aa, Homo sapiens
PITSDPTEATAVGAVEASFK

SEQ ID NO: 36028 - protein, 9 aa, Homo sapiens
PVAVALDTK

SEQ ID NO: 36029 - protein, 14 aa, Homo sapiens
PVICATQMLESMIK

SEQ ID NO: 36030 - protein, 16 aa, Homo sapiens
RFDEILEASDGIMVAR

SEQ ID NO: 36031 - protein, 27 aa, Homo sapiens
SEAGTAFIQTQQLHAAMADTFLEHMCR

SEQ ID NO: 36032 - protein, 24 aa, Homo sapiens
SFASDPILYRPVAVALDTKGPEIR

SEQ ID NO: 36033 - protein, 13 aa, Homo sapiens
SHGTHEYHAETIK

SEQ ID NO: 36034 - protein, 10 aa, Homo sapiens
SVETLKEMIK

SEQ ID NO: 36035 - protein, 17 aa, Homo sapiens
SVETLKEMIKSGMNVAR

SEQ ID NO: 36036 - protein, 14 aa, Homo sapiens
TATESFASDPILYR

SEQ ID NO: 36037 - protein, 23 aa, Homo sapiens
TATESFASDPILYRPVAVALDTK

SEQ ID NO: 36038 - protein, 28 aa, Homo sapiens
TATESFASDPILYRPVAVALDTKGPEIR

SEQ ID NO: 36039 - protein, 16 aa, Homo sapiens
TGLIKGSGTAEVELKK

SEQ ID NO: 36040 - protein, 9 aa, Homo sapiens
TLDNAYMEK

SEQ ID NO: 36041 - protein, 9 aa, Homo sapiens
VNFAMNVGK

SEQ ID NO: 36042 - protein, 7 aa, Homo sapiens
VVEVGSK

SEQ ID NO: 36043 - protein, 8 aa, Homo sapiens
KLFEELVR

SEQ ID NO: 36044 - protein, 15 aa, Homo sapiens
DLWVNIDQMEKDKVK

SEQ ID NO: 36045 - protein, 17 aa, Homo sapiens
HRQDWVDSGCPEESKEK

SEQ ID NO: 36046 - protein, 10 aa, Homo sapiens
IHGILSNTHR

SEQ ID NO: 36047 - protein, 10 aa, Homo sapiens
IYGPSDSASR

SEQ ID NO: 36048 - protein, 22 aa, Homo sapiens
KITNISAVEMTPLPTCLQFNRC

SEQ ID NO: 36049 - protein, 23 aa, Homo sapiens
NLDFLKAVDTNRASVGQDSPEPR

SEQ ID NO: 36050 - protein, 28 aa, Homo sapiens
RMLTATQYIAPLMANFDPSVSRNSTVRY

SEQ ID NO: 36051 - protein, 31 aa, Homo sapiens
RSFTDLLLDDGQDNNTQIEEDTDHNYYISRI

SEQ ID NO: 36052 - protein, 17 aa, Homo sapiens
RVNLSFDFPFYGHFLRE

SEQ ID NO: 36053 - protein, 29 aa, Homo sapiens
SFTDLLLDDGQDNNTQIEEDTDHNYYISR

SEQ ID NO: 36054 - protein, 15 aa, Homo sapiens
VNLSFDFPFYGHFLR

SEQ ID NO: 36055 - protein, 25 aa, Homo sapiens
KHMRQDQITNGMVNAISTGNWSLKR

SEQ ID NO: 36056 - protein, 26 aa, Homo sapiens
FKEPPAYGPMCDILWSDPLEDFGNEK

SEQ ID NO: 36057 - protein, 17 aa, Homo sapiens
KALTSETNGTDSNGSNS

SEQ ID NO: 36058 - protein, 12 aa, Homo sapiens
LFEVGGSPANTR

SEQ ID NO: 36059 - protein, 11 aa, Homo sapiens
TQEHFTHNTVR

SEQ ID NO: 36060 - protein, 12 aa, Homo sapiens
DFTPVCTTELGR

SEQ ID NO: 36061 - protein, 17 aa, Homo sapiens
DGDSVMVLPTIPEEEAK

SEQ ID NO: 36062 - protein, 13 aa, Homo sapiens
DINAYNCEEPTEK

SEQ ID NO: 36063 - protein, 14 aa, Homo sapiens
ELAILLGMLDPAEK

SEQ ID NO: 36064 - protein, 17 aa, Homo sapiens
ELAILLGMLDPAEKDEK

SEQ ID NO: 36065 - protein, 17 aa, Homo sapiens
FHDFLGDSWGILFSHPR

SEQ ID NO: 36066 - protein, 11 aa, Homo sapiens
GVFTKELPSGK

SEQ ID NO: 36067 - protein, 15 aa, Homo sapiens
GVFTKELPSGKKYLR

SEQ ID NO: 36068 - protein, 16 aa, Homo sapiens
HDFLGDSWGILFSHPR

SEQ ID NO: 36069 - protein, 17 aa, Homo sapiens
LIALSIDSVEDHLAWSK

SEQ ID NO: 36070 - protein, 9 aa, Homo sapiens
LPFPIIDDR

SEQ ID NO: 36071 - protein, 11 aa, Homo sapiens
LSILYPATTGR

SEQ ID NO: 36072 - protein, 7 aa, Homo sapiens
NFDEILR

SEQ ID NO: 36073 - protein, 21 aa, Homo sapiens
PGGLLLGDVAPNFEANTTVGR

SEQ ID NO: 36074 - protein, 9 aa, Homo sapiens
PVCTTELGR

SEQ ID NO: 36075 - protein, 13 aa, Homo sapiens
SIDSVEDHLAWSK

SEQ ID NO: 36076 - protein, 10 aa, Homo sapiens
TPVCTTELGR

SEQ ID NO: 36077 - protein, 8 aa, Homo sapiens
VATPVDWK

SEQ ID NO: 36078 - protein, 9 aa, Homo sapiens
VVFVFGPDK

SEQ ID NO: 36079 - protein, 10 aa, Homo sapiens
VVFVFGPDKK

SEQ ID NO: 36080 - protein, 7 aa, Homo sapiens
FSEPHAR

SEQ ID NO: 36081 - protein, 12 aa, Homo sapiens
ILQAVNFPFLVK

SEQ ID NO: 36082 - protein, 9 aa, Homo sapiens
KVEAPFIPK

SEQ ID NO: 36083 - protein, 9 aa, Homo sapiens
NLLQVDLTK

SEQ ID NO: 36084 - protein, 10 aa, Homo sapiens
NLLQVDLTKR

SEQ ID NO: 36085 - protein, 9 aa, Homo sapiens
QIEHTLNEK

SEQ ID NO: 36086 - protein, 13 aa, Homo sapiens
AQQEQELAADAFK

SEQ ID NO: 36087 - protein, 32 aa, Homo sapiens
DGSDEPGTAACPNGSFHCTNTGYKPLYIPSNR

SEQ ID NO: 36088 - protein, 19 aa, Homo sapiens
GSFHCTNTGYKPLYIPSNR

SEQ ID NO: 36089 - protein, 16 aa, Homo sapiens
GVSLTNHHFYDESKPF

SEQ ID NO: 36090 - protein, 21 aa, Homo sapiens
LGGSPTSLGTWGSWIGPDHDK

SEQ ID NO: 36091 - protein, 9 aa, Homo sapiens
LIELQAGKK

SEQ ID NO: 36092 - protein, 16 aa, Homo sapiens
LLSGDTQTDATSFYDR

SEQ ID NO: 36093 - protein, 8 aa, Homo sapiens
NKFEEAER

SEQ ID NO: 36094 - protein, 20 aa, Homo sapiens
SEALPTDLPAPSAPDLTEPK

SEQ ID NO: 36095 - protein, 10 aa, Homo sapiens
SLEDQVEMLR

SEQ ID NO: 36096 - protein, 22 aa, Homo sapiens
TCLDGSATIPFDQVNDDYCDCK

SEQ ID NO: 36097 - protein, 11 aa, Homo sapiens
TVKEEAEKPER

SEQ ID NO: 36098 - protein, 26 aa, Homo sapiens
VNDGVCDCCDGTDEYNSGVICENTCK

SEQ ID NO: 36099 - protein, 13 aa, Homo sapiens
YEQGTGCWQGPNR

SEQ ID NO: 36100 - protein, 15 aa, Homo sapiens
FSNQETCVEIGESVR

SEQ ID NO: 36101 - protein, 13 aa, Homo sapiens
IFSGSSHQDLSQK

SEQ ID NO: 36102 - protein, 17 aa, Homo sapiens
RNCTIVSPDAGGAKRVT

SEQ ID NO: 36103 - protein, 16 aa, Homo sapiens
THNGESVSYLFSHVPL

SEQ ID NO: 36104 - protein, 17 aa, Homo sapiens
LPIFFFGTHETAFLGPK

SEQ ID NO: 36105 - protein, 24 aa, Homo sapiens
KKNPMVETLGTVLQLKQPLNTTRI

SEQ ID NO: 36106 - protein, 24 aa, Homo sapiens
TWPDHGVPSDPGGVLDFLEEVHHK

SEQ ID NO: 36107 - protein, 18 aa, Homo sapiens
WFHPNITGVEAENLLLTR

SEQ ID NO: 36108 - protein, 33 aa, Homo sapiens
AACEQLHQQQQQQQEETAAATLLLQGEEEGEED

SEQ ID NO: 36109 - protein, 9 aa, Homo sapiens
FFFDVGSNK

SEQ ID NO: 36110 - protein, 7 aa, Homo sapiens
FGHTFCK

SEQ ID NO: 36111 - protein, 25 aa, Homo sapiens
LIDDYGVEEEPAELPEGTSLTVDNK

SEQ ID NO: 36112 - protein, 26 aa, Homo sapiens
LIDDYGVEEEPAELPEGTSLTVDNKR

SEQ ID NO: 36113 - protein, 12 aa, Homo sapiens
DASDQNFDYMFK

SEQ ID NO: 36114 - protein, 18 aa, Homo sapiens
GQLLAEQLGFDFFEASAK

SEQ ID NO: 36115 - protein, 11 aa, Homo sapiens
LLIIGNSSVGK

SEQ ID NO: 36116 - protein, 16 aa, Homo sapiens
MSDSLDTDPSMLGSSK

SEQ ID NO: 36117 - protein, 8 aa, Homo sapiens
TITTAYYR

SEQ ID NO: 36118 - protein, 15 aa, Homo sapiens
TYSWDNAQVILVGNK

SEQ ID NO: 36119 - protein, 19 aa, Homo sapiens
YADDTFTPAFVSTVGIDFK

SEQ ID NO: 36120 - protein, 19 aa, Homo sapiens
ILVVDEADKAPTNVTCILK

SEQ ID NO: 36121 - protein, 22 aa, Homo sapiens
LGHILVVDEADKAPTNVTCILK

SEQ ID NO: 36122 - protein, 13 aa, Homo sapiens
LLCPVETHHIDIK

SEQ ID NO: 36123 - protein, 16 aa, Homo sapiens
RGELEPQLGSPQQKPK

SEQ ID NO: 36124 - protein, 26 aa, Homo sapiens
SESLSPYTTWLSTISDTDALLAEWDK

SEQ ID NO: 36125 - protein, 19 aa, Homo sapiens
AYSVLQATVAAATTTPTAK

SEQ ID NO: 36126 - protein, 24 aa, Homo sapiens
VCTQLLVSRPDEENITSYLQLIEK

SEQ ID NO: 36127 - protein, 15 aa, Homo sapiens
KSVNLSDGELLSIRG

SEQ ID NO: 36128 - protein, 14 aa, Homo sapiens
RDPYWNDTEPLCRA

SEQ ID NO: 36129 - protein, 25 aa, Homo sapiens
RGVDGPTLTVLANQTLLVEGQVIRS

SEQ ID NO: 36130 - protein, 14 aa, Homo sapiens
GTAYVVYEDIFDAK

SEQ ID NO: 36131 - protein, 14 aa, Homo sapiens
NACDHLSGFNVCNR

SEQ ID NO: 36132 - protein, 11 aa, Homo sapiens
RDDSDINTSKT

SEQ ID NO: 36133 - protein, 34 aa, Homo sapiens
KDDWIRPALLSGPVAANVLNFSDHHVIPMPLLKG

SEQ ID NO: 36134 - protein, 36 aa, Homo sapiens
KHAAFFADAEGYFAACTTDTTMNSSLSEPLYVPVKF

SEQ ID NO: 36135 - protein, 36 aa, Homo sapiens
RLYMLSFLPFLVLLVLIRNLRILTIFSMLANISMLV

SEQ ID NO: 36136 - protein, 20 aa, Homo sapiens
TNNCYSNETVILTPTMDSRL

SEQ ID NO: 36137 - protein, 14 aa, Homo sapiens
AGGSLCHILAAAYK

SEQ ID NO: 36138 - protein, 35 aa, Homo sapiens
RHQGTVTEDKNNASHVVYPVPGNLEEEEWVRPVMK

SEQ ID NO: 36139 - protein, 19 aa, Homo sapiens
SLSSLVVQLLQFQEEVFGK

SEQ ID NO: 36140 - protein, 11 aa, Homo sapiens
TQDECILHFLR

SEQ ID NO: 36141 - protein, 11 aa, Homo sapiens
ATNETNVNIPQ

SEQ ID NO: 36142 - protein, 12 aa, Homo sapiens
CKLEFHACSTGK

SEQ ID NO: 36143 - protein, 9 aa, Homo sapiens
DSLGWMFNK

SEQ ID NO: 36144 - protein, 10 aa, Homo sapiens
HWVGPSNLVK

SEQ ID NO: 36145 - protein, 10 aa, Homo sapiens
LEFHACSTGK

SEQ ID NO: 36146 - protein, 20 aa, Homo sapiens
SLATLCDGPCPCLPEPEPPK

SEQ ID NO: 36147 - protein, 9 aa, Homo sapiens
SLLGAFIPR

SEQ ID NO: 36148 - protein, 13 aa, Homo sapiens
AAMRETWLSENQR

SEQ ID NO: 36149 - protein, 29 aa, Homo sapiens
AELFTQSCADLDKWLHGLESQIQSDDYGK

SEQ ID NO: 36150 - protein, 20 aa, Homo sapiens
DALLSALSIQNYHLECNETK

SEQ ID NO: 36151 - protein, 19 aa, Homo sapiens
DASVAEAWLLGQEPYLSSR

SEQ ID NO: 36152 - protein, 20 aa, Homo sapiens
DDEEMNTWIQAISSAISSDK

SEQ ID NO: 36153 - protein, 17 aa, Homo sapiens
DGLNEAWADLLELIDTR

SEQ ID NO: 36154 - protein, 34 aa, Homo sapiens
DVAEEIANYRPTLDTLHEQASALPQEHAESPDVR

SEQ ID NO: 36155 - protein, 11 aa, Homo sapiens
EAVCEVALDYK

SEQ ID NO: 36156 - protein, 17 aa, Homo sapiens
EGMQLISEKPETEAVVK

SEQ ID NO: 36157 - protein, 22 aa, Homo sapiens
EVVAGSHELGQDYEHVTMLQER

SEQ ID NO: 36158 - protein, 17 aa, Homo sapiens
FATDGEGYKPCDPQVIR

SEQ ID NO: 36159 - protein, 15 aa, Homo sapiens
FLQDCQELSLWINEK

SEQ ID NO: 36160 - protein, 15 aa, Homo sapiens
HEVSASTQSTPASSR

SEQ ID NO: 36161 - protein, 11 aa, Homo sapiens
HLLGVEDLLQK

SEQ ID NO: 36162 - protein, 20 aa, Homo sapiens
HQILEQAVEDYAETVHQLSK

SEQ ID NO: 36163 - protein, 10 aa, Homo sapiens
HRPDLIDFDK

SEQ ID NO: 36164 - protein, 9 aa, Homo sapiens
IHCLENVDK

SEQ ID NO: 36165 - protein, 19 aa, Homo sapiens
IVSSSDVGHDEYSTQSLVK

SEQ ID NO: 36166 - protein, 15 aa, Homo sapiens
KHEAIETDIAAYEER

SEQ ID NO: 36167 - protein, 26 aa, Homo sapiens
LEEASLLHQFQADADDIDAWMLDILK

SEQ ID NO: 36168 - protein, 21 aa, Homo sapiens
LLTQHENIKNEIDNYEEDYQK

SEQ ID NO: 36169 - protein, 19 aa, Homo sapiens
LVSQDNFGFDLPAVEAATK

SEQ ID NO: 36170 - protein, 17 aa, Homo sapiens
MHTTFEHDIQALGTQVR

SEQ ID NO: 36171 - protein, 21 aa, Homo sapiens
MPLATSTDHGHNLQTVQLLIK

SEQ ID NO: 36172 - protein, 15 aa, Homo sapiens
QNLLSQSHAYQQFLR

SEQ ID NO: 36173 - protein, 22 aa, Homo sapiens
SNAHYNLQNAFNLAEQHLGLTK

SEQ ID NO: 36174 - protein, 17 aa, Homo sapiens
TAASGIPYHSEVPVSLK

SEQ ID NO: 36175 - protein, 17 aa, Homo sapiens
TAGYPNVNIHNFTTSWR

SEQ ID NO: 36176 - protein, 18 aa, Homo sapiens
VAHMEFCYQELCQLAAER

SEQ ID NO: 36177 - protein, 26 aa, Homo sapiens
VDTVNHLADELINSGHSDAATIAEWK

SEQ ID NO: 36178 - protein, 16 aa, Homo sapiens
WLHGLESQIQSDDYGK

SEQ ID NO: 36179 - protein, 8 aa, Homo sapiens
WVNSHLAR

SEQ ID NO: 36180 - protein, 19 aa, Homo sapiens
DQNVLSPVNCWNLLLNQVK

SEQ ID NO: 36181 - protein, 23 aa, Homo sapiens
SDSHGLSSSLTDSSSPGVGASCR

SEQ ID NO: 36182 - protein, 12 aa, Homo sapiens
VQLLQDLQDFFR

SEQ ID NO: 36183 - protein, 24 aa, Homo sapiens
IIEENITSAAPSNDQDGEYCPEVK

SEQ ID NO: 36184 - protein, 22 aa, Homo sapiens
IIHTDIKPENILMCVDDAYVRR

SEQ ID NO: 36185 - protein, 16 aa, Homo sapiens
RGGNNSFTHEALTLKY

SEQ ID NO: 36186 - protein, 25 aa, Homo sapiens
DAYELQEVIGSGATAVVQAALCKPR

SEQ ID NO: 36187 - protein, 15 aa, Homo sapiens
LASGCDGSEIPDEVK

SEQ ID NO: 36188 - protein, 14 aa, Homo sapiens
NGVLEEAIIATILK

SEQ ID NO: 36189 - protein, 10 aa, Homo sapiens
VPGSSGHLHK

SEQ ID NO: 36190 - protein, 13 aa, Homo sapiens
RHIKFYDNNTGKL

SEQ ID NO: 36191 - protein, 15 aa, Homo sapiens
KFVNSTGYLTEAEKF

SEQ ID NO: 36192 - protein, 12 aa, Homo sapiens
DLQSAEKEEQEK

SEQ ID NO: 36193 - protein, 8 aa, Homo sapiens
HDIIGEFK

SEQ ID NO: 36194 - protein, 10 aa, Homo sapiens
HWSDMLANPR

SEQ ID NO: 36195 - protein, 13 aa, Homo sapiens
TLNPVFNEQFTFK

SEQ ID NO: 36196 - protein, 13 aa, Homo sapiens
VFVGYNSTGAELR

SEQ ID NO: 36197 - protein, 17 aa, Homo sapiens
DCSYGAVTSPTSTLESR

SEQ ID NO: 36198 - protein, 18 aa, Homo sapiens
DSAYISSSPLGSHQVFDF

SEQ ID NO: 36199 - protein, 21 aa, Homo sapiens
SCDELSPVSPTQGGYPSEPTR

SEQ ID NO: 36200 - protein, 25 aa, Homo sapiens
RFPSAMVVTDTSSISTLTNMSSSKQ

SEQ ID NO: 36201 - protein, 17 aa, Homo sapiens
RQFNQTVQSSGNMTDKS

SEQ ID NO: 36202 - protein, 24 aa, Homo sapiens
KGNKNGDNNSNHNGEGNGQSGHSA

SEQ ID NO: 36203 - protein, 27 aa, Homo sapiens
RGFVVLPITEFLVGDLVVTQNTSLPWP

SEQ ID NO: 36204 - protein, 18 aa, Homo sapiens
RGDPSVISVNGTDFTFRS

SEQ ID NO: 36205 - protein, 10 aa, Homo sapiens
LEDPHVDIIR

SEQ ID NO: 36206 - protein, 15 aa, Homo sapiens
LLSDPNYGVHLPAVK

SEQ ID NO: 36207 - protein, 9 aa, Homo sapiens
LVHIIGALR

SEQ ID NO: 36208 - protein, 21 aa, Homo sapiens
SGDTLLLLHHGDFSAEEVFHR

SEQ ID NO: 36209 - protein, 28 aa, Homo sapiens
TATSLAEGLSLVVSPDSIHSVAPENEGR

SEQ ID NO: 36210 - protein, 26 aa, Homo sapiens
VSFSYAGLSGDDPDLGPAHVVTVIAR

SEQ ID NO: 36211 - protein, 17 aa, Homo sapiens
LEECCTHNNSATLSWKQ

SEQ ID NO: 36212 - protein, 15 aa, Homo sapiens
EILEPPEIDLDASMR

SEQ ID NO: 36213 - protein, 15 aa, Homo sapiens
IGVGPPLDSTPTVAK

SEQ ID NO: 36214 - protein, 16 aa, Homo sapiens
KPDKPTGPIVIEALLK

SEQ ID NO: 36215 - protein, 10 aa, Homo sapiens
RVDLIQDLPR

SEQ ID NO: 36216 - protein, 19 aa, Homo sapiens
SSVSLAWSKPIYDGGAPVK

SEQ ID NO: 36217 - protein, 30 aa, Homo sapiens
VKVASIEIGPVSGQIMHAVGEEGGHVKYVC

SEQ ID NO: 36218 - protein, 10 aa, Homo sapiens
YSVTKLIEGK

SEQ ID NO: 36219 - protein, 10 aa, Homo sapiens
ADSSSILIIK

SEQ ID NO: 36220 - protein, 14 aa, Homo sapiens
AENKIGTGPPTESK

SEQ ID NO: 36221 - protein, 14 aa, Homo sapiens
AGSDLVLDAAVGGK

SEQ ID NO: 36222 - protein, 18 aa, Homo sapiens
AGSPFTIDVPISGRPAPK

SEQ ID NO: 36223 - protein, 18 aa, Homo sapiens
AMFECEVSEPDITVQWMK

SEQ ID NO: 36224 - protein, 11 aa, Homo sapiens
AQNEKGVSEPR

SEQ ID NO: 36225 - protein, 23 aa, Homo sapiens
CSLDYGVAYSRDSGIITCRATNK

SEQ ID NO: 36226 - protein, 21 aa, Homo sapiens
DDVVAPDLDLKGLPDLCYLAK

SEQ ID NO: 36227 - protein, 16 aa, Homo sapiens
DEITLKCEVSKDVPVK

SEQ ID NO: 36228 - protein, 10 aa, Homo sapiens
DGKAITQGGK

SEQ ID NO: 36229 - protein, 8 aa, Homo sapiens
DGKIVVEK

SEQ ID NO: 36230 - protein, 18 aa, Homo sapiens
DMCSAQLSVKEPPKFVKK

SEQ ID NO: 36231 - protein, 17 aa, Homo sapiens
DSCSAQILILEPPYFVK

SEQ ID NO: 36232 - protein, 10 aa, Homo sapiens
EEKITIVTQR

SEQ ID NO: 36233 - protein, 14 aa, Homo sapiens
EGVKITEKPSPPEK

SEQ ID NO: 36234 - protein, 7 aa, Homo sapiens
EIYESDK

SEQ ID NO: 36235 - protein, 7 aa, Homo sapiens
ELDLCEK

SEQ ID NO: 36236 - protein, 28 aa, Homo sapiens
ESDNIWISYSENIATLQFSRVEPANAGK

SEQ ID NO: 36237 - protein, 6 aa, Homo sapiens
FERSAR

SEQ ID NO: 36238 - protein, 11 aa, Homo sapiens
FRVSAINGAGK

SEQ ID NO: 36239 - protein, 14 aa, Homo sapiens
GQPLYLSCELNKER

SEQ ID NO: 36240 - protein, 14 aa, Homo sapiens
GSPVIQVTWFKNNK

SEQ ID NO: 36241 - protein, 19 aa, Homo sapiens
GVNYTQLSIDNCDRNDAGK

SEQ ID NO: 36242 - protein, 15 aa, Homo sapiens
GVYTVEAKNASGSAK

SEQ ID NO: 36243 - protein, 13 aa, Homo sapiens
IDHYIVQKRETSR

SEQ ID NO: 36244 - protein, 11 aa, Homo sapiens
IELSPSMEAPK

SEQ ID NO: 36245 - protein, 13 aa, Homo sapiens
IRIEGTKGEAALK

SEQ ID NO: 36246 - protein, 14 aa, Homo sapiens
ITQFVVPDLQTKEK

SEQ ID NO: 36247 - protein, 7 aa, Homo sapiens
KDGTLLK

SEQ ID NO: 36248 - protein, 14 aa, Homo sapiens
KPEAPPPKVPEAPK

SEQ ID NO: 36249 - protein, 14 aa, Homo sapiens
KPEVTPVKVPEAPK

SEQ ID NO: 36250 - protein, 11 aa, Homo sapiens
KVPEKPQVPEK

SEQ ID NO: 36251 - protein, 9 aa, Homo sapiens
KVPLVVPKK

SEQ ID NO: 36252 - protein, 13 aa, Homo sapiens
LEAPELDLDSELR

SEQ ID NO: 36253 - protein, 23 aa, Homo sapiens
LHIIDVQLSDAGEYTCVLRLGNK

SEQ ID NO: 36254 - protein, 19 aa, Homo sapiens
LNGSAPIQVCWYRDGVLLR

SEQ ID NO: 36255 - protein, 18 aa, Homo sapiens
LQSMTVRQGSQVRLQVRV

SEQ ID NO: 36256 - protein, 17 aa, Homo sapiens
LSYKVTNLQEGAIYYFR

SEQ ID NO: 36257 - protein, 10 aa, Homo sapiens
LTVAGGAISK

SEQ ID NO: 36258 - protein, 18 aa, Homo sapiens
MAEILSGTESVPLTQVAK

SEQ ID NO: 36259 - protein, 19 aa, Homo sapiens
NAAGVFSEPSESTGAITAR

SEQ ID NO: 36260 - protein, 9 aa, Homo sapiens
NAVGVSLPR

SEQ ID NO: 36261 - protein, 34 aa, Homo sapiens
NPEVTTITKDSMVVCWGHPDSDGGSEIINYIVER

SEQ ID NO: 36262 - protein, 26 aa, Homo sapiens
NVTGTTSETIKVIILDKPGPPTGPIK

SEQ ID NO: 36263 - protein, 11 aa, Homo sapiens
PSFCTKPITCK

SEQ ID NO: 36264 - protein, 9 aa, Homo sapiens
PSPSSDPIK

SEQ ID NO: 36265 - protein, 20 aa, Homo sapiens
QEASFSSFSSSSASSMTEMK

SEQ ID NO: 36266 - protein, 16 aa, Homo sapiens
RDVASAQWSPLSATSK

SEQ ID NO: 36267 - protein, 10 aa, Homo sapiens
SGVPLTTGYR

SEQ ID NO: 36268 - protein, 19 aa, Homo sapiens
SHRVPCGQNTRFILNVQSK

SEQ ID NO: 36269 - protein, 24 aa, Homo sapiens
SIATVEMVIDGAAGQQLPHKTPPR

SEQ ID NO: 36270 - protein, 8 aa, Homo sapiens
TGYLLEMR

SEQ ID NO: 36271 - protein, 11 aa, Homo sapiens
TNIEVEKLLEK

SEQ ID NO: 36272 - protein, 6 aa, Homo sapiens
VPEVPK

SEQ ID NO: 36273 - protein, 13 aa, Homo sapiens
VPPTKVPDVLPPK

SEQ ID NO: 36274 - protein, 17 aa, Homo sapiens
VSNDAGSALCTSSIVIK

SEQ ID NO: 36275 - protein, 28 aa, Homo sapiens
WVLNGVELTNSEEYRYGVSGSDQTLTIK

SEQ ID NO: 36276 - protein, 26 aa, Homo sapiens
KCVAENNSGAVESVSDLTVEPVTYRE

SEQ ID NO: 36277 - protein, 26 aa, Homo sapiens
KDVTALENATVAFEVSVSHDTVPVKW

SEQ ID NO: 36278 - protein, 20 aa, Homo sapiens
KEKIPSPETLQPDTHNISKS

SEQ ID NO: 36279 - protein, 22 aa, Homo sapiens
KVYENTTLGFIVEVEGLPVPGV

SEQ ID NO: 36280 - protein, 27 aa, Homo sapiens
ESFVEMSSSSFMGISNMTQLESSTSKM

SEQ ID NO: 36281 - protein, 21 aa, Homo sapiens
KFEENTSNSQWHVSLSVSFKK

SEQ ID NO: 36282 - protein, 15 aa, Homo sapiens
KNASGTKAVSVMVKV

SEQ ID NO: 36283 - protein, 22 aa, Homo sapiens
KVNRYDAGKYTIEAENQSGKKS

SEQ ID NO: 36284 - protein, 22 aa, Homo sapiens
KWRRPDYDGGSPNLSYHVERRL

SEQ ID NO: 36285 - protein, 16 aa, Homo sapiens
RANHTPESCPETKYKV

SEQ ID NO: 36286 - protein, 33 aa, Homo sapiens
RNKCGPGEPAYVDEPVNMSTPATVPDPPENVKW

SEQ ID NO: 36287 - protein, 24 aa, Homo sapiens
MRANGNTTSNKNSAAMDAEIVLRS

SEQ ID NO: 36288 - protein, 25 aa, Homo sapiens
RYVKQPLPDEFGSSPLEPGACNGSR

SEQ ID NO: 36289 - protein, 16 aa, Homo sapiens
GKSFSQLCNLTRHQRI

SEQ ID NO: 36290 - protein, 21 aa, Homo sapiens
AEPEDHYFLLTEPPLNTPENR

SEQ ID NO: 36291 - protein, 11 aa, Homo sapiens
DYEEIGPSICR

SEQ ID NO: 36292 - protein, 22 aa, Homo sapiens
GVDDLDFFIGDEAIEKPTYATK

SEQ ID NO: 36293 - protein, 12 aa, Homo sapiens
HGIVEDWDLMER

SEQ ID NO: 36294 - protein, 12 aa, Homo sapiens
KDYEEIGPSICR

SEQ ID NO: 36295 - protein, 20 aa, Homo sapiens
LGYAGNTEPQFIIPSCIAIK

SEQ ID NO: 36296 - protein, 14 aa, Homo sapiens
LPACVVDCGTGYTK

SEQ ID NO: 36297 - protein, 13 aa, Homo sapiens
PIDVQVITHHMQR

SEQ ID NO: 36298 - protein, 30 aa, Homo sapiens
TLTGTVIDSGDGVTHVIPVAEGYVIGSCIK

SEQ ID NO: 36299 - protein, 23 aa, Homo sapiens
YAVWFGGSMLASTPEFYQVCHTK

SEQ ID NO: 36300 - protein, 10 aa, Homo sapiens
YSYVCPDLVK

SEQ ID NO: 36301 - protein, 18 aa, Homo sapiens
EKLDSVIEFSIPDSLLIR

SEQ ID NO: 36302 - protein, 23 aa, Homo sapiens
GIHSAIDASQTPDVVFASILAAF

SEQ ID NO: 36303 - protein, 25 aa, Homo sapiens
GIHSAIDASQTPDVVFASILAAFSK

SEQ ID NO: 36304 - protein, 17 aa, Homo sapiens
LAENFCVCHLATGDMLR

SEQ ID NO: 36305 - protein, 16 aa, Homo sapiens
LDSVIEFSIPDSLLIR

SEQ ID NO: 36306 - protein, 16 aa, Homo sapiens
LQAYHTQTTPLIEYYR

SEQ ID NO: 36307 - protein, 24 aa, Homo sapiens
SYHEEFNPPKEPMKDDITGEPLIR

SEQ ID NO: 36308 - protein, 17 aa, Homo sapiens
KHSRIVELLNETEKYKL

SEQ ID NO: 36309 - protein, 22 aa, Homo sapiens
EEIFGPVMSILSFDTEAEVLER

SEQ ID NO: 36310 - protein, 22 aa, Homo sapiens
EPLGVCVGIGAWNYPFQIASWK

SEQ ID NO: 36311 - protein, 12 aa, Homo sapiens
GIKPVTLELGGK

SEQ ID NO: 36312 - protein, 7 aa, Homo sapiens
ILLEAAR

SEQ ID NO: 36313 - protein, 12 aa, Homo sapiens
MGPLINRPHLER

SEQ ID NO: 36314 - protein, 14 aa, Homo sapiens
VLCGGDIYVPEDPK

SEQ ID NO: 36315 - protein, 12 aa, Homo sapiens
VSFTGSVPTGMK

SEQ ID NO: 36316 - protein, 8 aa, Homo sapiens
VTLELGGK

SEQ ID NO: 36317 - protein, 7 aa, Homo sapiens
AAIQALR

SEQ ID NO: 36318 - protein, 21 aa, Homo sapiens
AALGKLPQQANDYLNSFNWER

SEQ ID NO: 36319 - protein, 22 aa, Homo sapiens
AALTELSLGSAYQAMILGVDSK

SEQ ID NO: 36320 - protein, 13 aa, Homo sapiens
AASGTTGTYQEWK

SEQ ID NO: 36321 - protein, 23 aa, Homo sapiens
ADSVVDLLSYNVQGSGETTYDHK

SEQ ID NO: 36322 - protein, 15 aa, Homo sapiens
ADTVAKVQGVEFSHR

SEQ ID NO: 36323 - protein, 30 aa, Homo sapiens
ADYVETVLDSTCSSTVQFLEYELNVLGTHK

SEQ ID NO: 36324 - protein, 16 aa, Homo sapiens
AEEEMLENVSLVCPKD

SEQ ID NO: 36325 - protein, 13 aa, Homo sapiens
AEPLAFTFSHDYK

SEQ ID NO: 36326 - protein, 23 aa, Homo sapiens
AEPLAFTFSHDYKGSTSHHLVSR

SEQ ID NO: 36327 - protein, 11 aa, Homo sapiens
AGHIAWTSSGK

SEQ ID NO: 36328 - protein, 12 aa, Homo sapiens
AHLDIAGSLEGH

SEQ ID NO: 36329 - protein, 14 aa, Homo sapiens
AHLDIAGSLEGHLR

SEQ ID NO: 36330 - protein, 6 aa, Homo sapiens
AHLNIK

SEQ ID NO: 36331 - protein, 16 aa, Homo sapiens
AHLNIKSPAFTDLHLR

SEQ ID NO: 36332 - protein, 6 aa, Homo sapiens
AIQSLK

SEQ ID NO: 36333 - protein, 12 aa, Homo sapiens
AISSAALSASYK

SEQ ID NO: 36334 - protein, 18 aa, Homo sapiens
ALFLSPSAQQASWQVSAR

SEQ ID NO: 36335 - protein, 11 aa, Homo sapiens
ALNLPTLPEVK

SEQ ID NO: 36336 - protein, 11 aa, Homo sapiens
ALSHAVNNYHK

SEQ ID NO: 36337 - protein, 7 aa, Homo sapiens
ALVDTLK

SEQ ID NO: 36338 - protein, 16 aa, Homo sapiens
ALVDTLKFVTQAEGAK

SEQ ID NO: 36339 - protein, 13 aa, Homo sapiens
ALVEQGFTVPEIK

SEQ ID NO: 36340 - protein, 15 aa, Homo sapiens
ALYWVNGQVPDGVSK

SEQ ID NO: 36341 - protein, 13 aa, Homo sapiens
AMGNITYDFSFKS

SEQ ID NO: 36342 - protein, 6 aa, Homo sapiens
ANLFNK

SEQ ID NO: 36343 - protein, 12 aa, Homo sapiens
ANLFNKLVTELR

SEQ ID NO: 36344 - protein, 24 aa, Homo sapiens
ANYLMEQIQDDCTGDEDYTYLILR

SEQ ID NO: 36345 - protein, 21 aa, Homo sapiens
AQNLYQELLTQEGQASFQGLK

SEQ ID NO: 36346 - protein, 30 aa, Homo sapiens
AQNLYQELLTQEGQASFQGLKDNVFDGLVR

SEQ ID NO: 36347 - protein, 13 aa, Homo sapiens
ASADLIEIGLEGK

SEQ ID NO: 36348 - protein, 16 aa, Homo sapiens
ASGSLPYTQTLQDHLN

SEQ ID NO: 36349 - protein, 19 aa, Homo sapiens
ASGSLPYTQTLQDHLNSLK

SEQ ID NO: 36350 - protein, 11 aa, Homo sapiens
ASLHDLQLLGK

SEQ ID NO: 36351 - protein, 24 aa, Homo sapiens
ASQPSSFHDFPDLGQEVALNANTK

SEQ ID NO: 36352 - protein, 16 aa, Homo sapiens
ATFQTPDFIVPLTDLR

SEQ ID NO: 36353 - protein, 25 aa, Homo sapiens
ATFQTPDFIVPLTDLRIPSVQINFK

SEQ ID NO: 36354 - protein, 11 aa, Homo sapiens
ATGVLYDYVNK

SEQ ID NO: 36355 - protein, 8 aa, Homo sapiens
ATLYALSH

SEQ ID NO: 36356 - protein, 15 aa, Homo sapiens
ATLYALSHAVNNYHK

SEQ ID NO: 36357 - protein, 14 aa, Homo sapiens
ATVAVYLESLQDTK

SEQ ID NO: 36358 - protein, 15 aa, Homo sapiens
AVSMPSFSILGSDVR

SEQ ID NO: 36359 - protein, 35 aa, Homo sapiens
AVSMPSFSILGSDVRVPSYTLILPSLELPVLHVPR

SEQ ID NO: 36360 - protein, 22 aa, Homo sapiens
CSLLVLENELNAELGLSGASMK

SEQ ID NO: 36361 - protein, 10 aa, Homo sapiens
CSTHILQWLK

SEQ ID NO: 36362 - protein, 13 aa, Homo sapiens
CVQSTKPSLMIQK

SEQ ID NO: 36363 - protein, 25 aa, Homo sapiens
CVQSTKPSLMIQKAAIQALRKMEPK

SEQ ID NO: 36364 - protein, 9 aa, Homo sapiens
DAVEKPQEF

SEQ ID NO: 36365 - protein, 14 aa, Homo sapiens
DAVEKPQEFTIVAF

SEQ ID NO: 36366 - protein, 16 aa, Homo sapiens
DAVEKPQEFTIVAFVK

SEQ ID NO: 36367 - protein, 16 aa, Homo sapiens
DAYNTKDKIGVELTGR

SEQ ID NO: 36368 - protein, 18 aa, Homo sapiens
DDKHEQDMVNGIMLSVEK

SEQ ID NO: 36369 - protein, 10 aa, Homo sapiens
DEPTYILNIK

SEQ ID NO: 36370 - protein, 27 aa, Homo sapiens
DFHSEYIVSASNFTSQLSSQVEQFLHR

SEQ ID NO: 36371 - protein, 11 aa, Homo sapiens
DFSAEYEEDGK

SEQ ID NO: 36372 - protein, 7 aa, Homo sapiens
DFSLWEK

SEQ ID NO: 36373 - protein, 11 aa, Homo sapiens
DIAGSLEGHLR

SEQ ID NO: 36374 - protein, 23 aa, Homo sapiens
DKAQNLYQELLTQEGQASFQGLK

SEQ ID NO: 36375 - protein, 20 aa, Homo sapiens
DKDQEVLLQTFLDDASPGDK

SEQ ID NO: 36376 - protein, 21 aa, Homo sapiens
DKDQEVLLQTFLDDASPGDKR

SEQ ID NO: 36377 - protein, 10 aa, Homo sapiens
DKIGVELTGR

SEQ ID NO: 36378 - protein, 18 aa, Homo sapiens
DLDAYNTKDKIGVELTGR

SEQ ID NO: 36379 - protein, 11 aa, Homo sapiens
DLKVEDIPLAR

SEQ ID NO: 36380 - protein, 9 aa, Homo sapiens
DNVFDGLVR

SEQ ID NO: 36381 - protein, 18 aa, Homo sapiens
DQEVLLQTFLDDASPGDK

SEQ ID NO: 36382 - protein, 14 aa, Homo sapiens
DSPVYNATWSASLK

SEQ ID NO: 36383 - protein, 13 aa, Homo sapiens
DSSATAYGSTVSK

SEQ ID NO: 36384 - protein, 22 aa, Homo sapiens
DSTCSSTVQFLEYELNVLGTHK

SEQ ID NO: 36385 - protein, 9 aa, Homo sapiens
DSYDLHDLK

SEQ ID NO: 36386 - protein, 18 aa, Homo sapiens
DTLKFVTQAEGAKQTEAT

SEQ ID NO: 36387 - protein, 15 aa, Homo sapiens
EALKESQLPTVMDFR

SEQ ID NO: 36388 - protein, 7 aa, Homo sapiens
EAQEVFK

SEQ ID NO: 36389 - protein, 14 aa, Homo sapiens
EEEMLENVSLVCPK

SEQ ID NO: 36390 - protein, 14 aa, Homo sapiens
EEYFDPSIVGWTVK

SEQ ID NO: 36391 - protein, 21 aa, Homo sapiens
EFNLQNMGLPDFHIPENLFLK

SEQ ID NO: 36392 - protein, 11 aa, Homo sapiens
EFQVPTFTIPK

SEQ ID NO: 36393 - protein, 13 aa, Homo sapiens
EGSHNSTVSLTTK

SEQ ID NO: 36394 - protein, 6 aa, Homo sapiens
EIQIYK

SEQ ID NO: 36395 - protein, 13 aa, Homo sapiens
EITASTNNEGNLK

SEQ ID NO: 36396 - protein, 11 aa, Homo sapiens
ENFAGEATLQR

SEQ ID NO: 36397 - protein, 9 aa, Homo sapiens
ENLCLNLHK

SEQ ID NO: 36398 - protein, 8 aa, Homo sapiens
EQHLFLPF

SEQ ID NO: 36399 - protein, 9 aa, Homo sapiens
ESDEETQIK

SEQ ID NO: 36400 - protein, 11 aa, Homo sapiens
ESQLPTVMDFR

SEQ ID NO: 36401 - protein, 8 aa, Homo sapiens
ESVKFSSK

SEQ ID NO: 36402 - protein, 12 aa, Homo sapiens
EVGTVLSQVYSK

SEQ ID NO: 36403 - protein, 10 aa, Homo sapiens
EVYGFNPEGK

SEQ ID NO: 36404 - protein, 17 aa, Homo sapiens
EYSGTIASEANTYLNSK

SEQ ID NO: 36405 - protein, 19 aa, Homo sapiens
FDHTNSLNIAGLSLDFSSK

SEQ ID NO: 36406 - protein, 17 aa, Homo sapiens
FEVDSPVYNATWSASLK

SEQ ID NO: 36407 - protein, 7 aa, Homo sapiens
FFGEGTK

SEQ ID NO: 36408 - protein, 17 aa, Homo sapiens
FFGEGTKKMGLAFESTK

SEQ ID NO: 36409 - protein, 14 aa, Homo sapiens
FFHESGLEAHVALK

SEQ ID NO: 36410 - protein, 12 aa, Homo sapiens
FFSLLSGSLNSH

SEQ ID NO: 36411 - protein, 25 aa, Homo sapiens
FFSLLSGSLNSHGLELNADILGTDK

SEQ ID NO: 36412 - protein, 6 aa, Homo sapiens
FIAESK

SEQ ID NO: 36413 - protein, 7 aa, Homo sapiens
FIIPSPK

SEQ ID NO: 36414 - protein, 7 aa, Homo sapiens
FLDMLIK

SEQ ID NO: 36415 - protein, 7 aa, Homo sapiens
FLDSNIK

SEQ ID NO: 36416 - protein, 13 aa, Homo sapiens
FLDSNIKFSHVEK

SEQ ID NO: 36417 - protein, 12 aa, Homo sapiens
FLKNIILPVYDK

SEQ ID NO: 36418 - protein, 16 aa, Homo sapiens
FLSPSAQQASWQVSAR

SEQ ID NO: 36419 - protein, 22 aa, Homo sapiens
FNEFIQNELQEASQELQQIHQY

SEQ ID NO: 36420 - protein, 27 aa, Homo sapiens
FNEFIQNELQEASQELQQIHQYIMALR

SEQ ID NO: 36421 - protein, 15 aa, Homo sapiens
FNSSYLQGTNQITGR

SEQ ID NO: 36422 - protein, 9 aa, Homo sapiens
FPEVDVLTK

SEQ ID NO: 36423 - protein, 12 aa, Homo sapiens
FQFPGKPGIYTR

SEQ ID NO: 36424 - protein, 9 aa, Homo sapiens
FRETLEDTR

SEQ ID NO: 36425 - protein, 13 aa, Homo sapiens
FSDEGTHESQISF

SEQ ID NO: 36426 - protein, 27 aa, Homo sapiens
FSDEGTHESQISFTIEGPLTSFGLSNK

SEQ ID NO: 36427 - protein, 6 aa, Homo sapiens
FSHVEK

SEQ ID NO: 36428 - protein, 6 aa, Homo sapiens
FSLDGK

SEQ ID NO: 36429 - protein, 28 aa, Homo sapiens
FSLDGKAALTELSLGSAYQAMILGVDSK

SEQ ID NO: 36430 - protein, 17 aa, Homo sapiens
FSTPEFTILNTFHIPSF

SEQ ID NO: 36431 - protein, 25 aa, Homo sapiens
FSTPEFTILNTFHIPSFTIDFVEMK

SEQ ID NO: 36432 - protein, 15 aa, Homo sapiens
FSVPAGIVIPSFQAL

SEQ ID NO: 36433 - protein, 18 aa, Homo sapiens
FSVPAGIVIPSFQALTAR

SEQ ID NO: 36434 - protein, 15 aa, Homo sapiens
FVEGSHNSTVSLTTK

SEQ ID NO: 36435 - protein, 9 aa, Homo sapiens
FVTQAEGAK

SEQ ID NO: 36436 - protein, 18 aa, Homo sapiens
FVTQAEGAKQTEATMTFK

SEQ ID NO: 36437 - protein, 9 aa, Homo sapiens
GAYQNNEIK

SEQ ID NO: 36438 - protein, 18 aa, Homo sapiens
GEANLDFLNIPLTIPEMR

SEQ ID NO: 36439 - protein, 17 aa, Homo sapiens
GEELGFASLHDLQLLGK

SEQ ID NO: 36440 - protein, 15 aa, Homo sapiens
GFASADLIEIGLEGK

SEQ ID NO: 36441 - protein, 12 aa, Homo sapiens
GFEPTLEALFGK

SEQ ID NO: 36442 - protein, 22 aa, Homo sapiens
GFEPTLEALFGKQGFFPDSVNK

SEQ ID NO: 36443 - protein, 12 aa, Homo sapiens
GGNTSTDHFSLR

SEQ ID NO: 36444 - protein, 16 aa, Homo sapiens
GIISALLVPPETEEAK

SEQ ID NO: 36445 - protein, 26 aa, Homo sapiens
GISTSAASPAVGTVGMDMDEDDDFSK

SEQ ID NO: 36446 - protein, 13 aa, Homo sapiens
GLELNADILGTDK

SEQ ID NO: 36447 - protein, 13 aa, Homo sapiens
GLKLATALSLSNK

SEQ ID NO: 36448 - protein, 28 aa, Homo sapiens
GLKLATALSLSNKFVEGSHNSTVSLTTK

SEQ ID NO: 36449 - protein, 24 aa, Homo sapiens
GLLIFDASSSWGPQMSASVHLDSK

SEQ ID NO: 36450 - protein, 14 aa, Homo sapiens
GLPDFHIPENLFLK

SEQ ID NO: 36451 - protein, 18 aa, Homo sapiens
GLSDEAVTSLLPQLIEVS

SEQ ID NO: 36452 - protein, 37 aa, Homo sapiens
GLSDEAVTSLLPQLIEVSSPITLQALVQCGQPQCSTH

SEQ ID NO: 36453 - protein, 9 aa, Homo sapiens
GMALFGEGK

SEQ ID NO: 36454 - protein, 13 aa, Homo sapiens
GMALFGEGKAEFT

SEQ ID NO: 36455 - protein, 18 aa, Homo sapiens
GMTRPLSTLISSSQSCQY

SEQ ID NO: 36456 - protein, 23 aa, Homo sapiens
GMTRPLSTLISSSQSCQYTLDAK

SEQ ID NO: 36457 - protein, 11 aa, Homo sapiens
GNTSTDHFSLR

SEQ ID NO: 36458 - protein, 12 aa, Homo sapiens
GNTSTDHFSLRA

SEQ ID NO: 36459 - protein, 11 aa, Homo sapiens
GNVATEISTER

SEQ ID NO: 36460 - protein, 10 aa, Homo sapiens
GSTSHHLVSR

SEQ ID NO: 36461 - protein, 23 aa, Homo sapiens
GSVLSREYSGTIASEANTYLNSK

SEQ ID NO: 36462 - protein, 9 aa, Homo sapiens
GTYGLSCQR

SEQ ID NO: 36463 - protein, 7 aa, Homo sapiens
GVISIPR

SEQ ID NO: 36464 - protein, 8 aa, Homo sapiens
HDAHLNGK

SEQ ID NO: 36465 - protein, 15 aa, Homo sapiens
HEQDMVNGIMLSVEK

SEQ ID NO: 36466 - protein, 15 aa, Homo sapiens
HFVINLIGDFEVAEK

SEQ ID NO: 36467 - protein, 17 aa, Homo sapiens
HIANILNSEELDIQDLK

SEQ ID NO: 36468 - protein, 9 aa, Homo sapiens
HINIDQFVR

SEQ ID NO: 36469 - protein, 10 aa, Homo sapiens
HINIDQFVRK

SEQ ID NO: 36470 - protein, 13 aa, Homo sapiens
HIQNIDIQHLAGK

SEQ ID NO: 36471 - protein, 15 aa, Homo sapiens
HIYAISSAALSASYK

SEQ ID NO: 36472 - protein, 15 aa, Homo sapiens
HKFLDSNIKFSHVEK

SEQ ID NO: 36473 - protein, 8 aa, Homo sapiens
HLFVKEVK

SEQ ID NO: 36474 - protein, 14 aa, Homo sapiens
HLIDSLIDFLNFPR

SEQ ID NO: 36475 - protein, 24 aa, Homo sapiens
HLRKYTYNYEAESSSGVPGTADSR

SEQ ID NO: 36476 - protein, 16 aa, Homo sapiens
HSITNPLAVLCEFISQ

SEQ ID NO: 36477 - protein, 19 aa, Homo sapiens
HSITNPLAVLCEFISQSIK

SEQ ID NO: 36478 - protein, 8 aa, Homo sapiens
HVAEAICK

SEQ ID NO: 36479 - protein, 22 aa, Homo sapiens
IADFELPTIIVPEQTIEIPSIK

SEQ ID NO: 36480 - protein, 13 aa, Homo sapiens
IAELSATAQEIIK

SEQ ID NO: 36481 - protein, 11 aa, Homo sapiens
IAGLSLDFSSK

SEQ ID NO: 36482 - protein, 13 aa, Homo sapiens
IAIANIIDEIIEK

SEQ ID NO: 36483 - protein, 15 aa, Homo sapiens
IAIANIIDEIIEKLK

SEQ ID NO: 36484 - protein, 16 aa, Homo sapiens
IANILNSEELDIQDLK

SEQ ID NO: 36485 - protein, 17 aa, Homo sapiens
IANILNSEELDIQDLKK

SEQ ID NO: 36486 - protein, 10 aa, Homo sapiens
IDDIWNLEVK

SEQ ID NO: 36487 - protein, 25 aa, Homo sapiens
IDFLNNYALFLSPSAQQASWQVSAR

SEQ ID NO: 36488 - protein, 9 aa, Homo sapiens
IEDGTLASK

SEQ ID NO: 36489 - protein, 14 aa, Homo sapiens
IEFEWNTGTNVDTK

SEQ ID NO: 36490 - protein, 15 aa, Homo sapiens
IEGNLIFDPNNYLPK

SEQ ID NO: 36491 - protein, 10 aa, Homo sapiens
IEIPLPFGGK

SEQ ID NO: 36492 - protein, 15 aa, Homo sapiens
IGQDGISTSATTNLK

SEQ ID NO: 36493 - protein, 8 aa, Homo sapiens
IGVELTGR

SEQ ID NO: 36494 - protein, 18 aa, Homo sapiens
IHSGSFQSQVELSNDQEK

SEQ ID NO: 36495 - protein, 10 aa, Homo sapiens
IISDYHQQFR

SEQ ID NO: 36496 - protein, 7 aa, Homo sapiens
IKDYFEK

SEQ ID NO: 36497 - protein, 12 aa, Homo sapiens
ILGEELGFASLH

SEQ ID NO: 36498 - protein, 16 aa, Homo sapiens
ILGEELGFASLHDLQL

SEQ ID NO: 36499 - protein, 19 aa, Homo sapiens
ILGEELGFASLHDLQLLGK

SEQ ID NO: 36500 - protein, 13 aa, Homo sapiens
ILNSEELDIQDLK

SEQ ID NO: 36501 - protein, 14 aa, Homo sapiens
ILNSEELDIQDLKK

SEQ ID NO: 36502 - protein, 9 aa, Homo sapiens
INDVLEHVK

SEQ ID NO: 36503 - protein, 12 aa, Homo sapiens
INNQLTLDSNTK

SEQ ID NO: 36504 - protein, 7 aa, Homo sapiens
INPLALK

SEQ ID NO: 36505 - protein, 11 aa, Homo sapiens
INPLALKESVK

SEQ ID NO: 36506 - protein, 9 aa, Homo sapiens
IPSVQINFK

SEQ ID NO: 36507 - protein, 12 aa, Homo sapiens
IPSVQINFKDLK

SEQ ID NO: 36508 - protein, 12 aa, Homo sapiens
ISHTIEVPTFGK

SEQ ID NO: 36509 - protein, 12 aa, Homo sapiens
ISSSGVIAPGAK

SEQ ID NO: 36510 - protein, 14 aa, Homo sapiens
ITENDIQIALDDAK

SEQ ID NO: 36511 - protein, 9 aa, Homo sapiens
ITEVALMGH

SEQ ID NO: 36512 - protein, 15 aa, Homo sapiens
ITEVALMGHLSCDTK

SEQ ID NO: 36513 - protein, 18 aa, Homo sapiens
ITEVALMGHLSCDTKEER

SEQ ID NO: 36514 - protein, 19 aa, Homo sapiens
ITLIINWLQEALSSASLAH

SEQ ID NO: 36515 - protein, 7 aa, Homo sapiens
ITLPDFR

SEQ ID NO: 36516 - protein, 14 aa, Homo sapiens
IVQILPWEQNEQVK

SEQ ID NO: 36517 - protein, 13 aa, Homo sapiens
IVSLIKNLLVALK

SEQ ID NO: 36518 - protein, 10 aa, Homo sapiens
IYSLWEHSTK

SEQ ID NO: 36519 - protein, 29 aa, Homo sapiens
KDFHSEYIVSASNFTSQLSSQVEQFLHRN

SEQ ID NO: 36520 - protein, 17 aa, Homo sapiens
KFVEGSHNSTVSLTTKN

SEQ ID NO: 36521 - protein, 27 aa, Homo sapiens
KGISTSAASPAVGTVGMDMDEDDDFSK

SEQ ID NO: 36522 - protein, 12 aa, Homo sapiens
KGNVATEISTER

SEQ ID NO: 36523 - protein, 19 aa, Homo sapiens
KGNVATEISTERDLGQCDR

SEQ ID NO: 36524 - protein, 9 aa, Homo sapiens
KHVAEAICK

SEQ ID NO: 36525 - protein, 11 aa, Homo sapiens
KIISDYHQQFR

SEQ ID NO: 36526 - protein, 35 aa, Homo sapiens
KIQSPLFTLDANADIGNGTTSANEAGIAASITAKG

SEQ ID NO: 36527 - protein, 16 aa, Homo sapiens
KITEVALMGHLSCDTK

SEQ ID NO: 36528 - protein, 8 aa, Homo sapiens
KLNELSFK

SEQ ID NO: 36529 - protein, 13 aa, Homo sapiens
KLQSTTVMNPYMK

SEQ ID NO: 36530 - protein, 6 aa, Homo sapiens
KLTIFK

SEQ ID NO: 36531 - protein, 10 aa, Homo sapiens
KLTIFKTELR

SEQ ID NO: 36532 - protein, 11 aa, Homo sapiens
KLTISEQNIQR

SEQ ID NO: 36533 - protein, 32 aa, Homo sapiens
KLYQLQVPLLGVLDLSTNVYSNLYNWSASYSG

SEQ ID NO: 36534 - protein, 44 aa, Homo sapiens
KLYQLQVPLLGVLDLSTNVYSNLYNWSASYSGGNTSTDHFSLRA

SEQ ID NO: 36535 - protein, 10 aa, Homo sapiens
KMGLAFESTK

SEQ ID NO: 36536 - protein, 15 aa, Homo sapiens
KMTSNFPVDLSDYPK

SEQ ID NO: 36537 - protein, 18 aa, Homo sapiens
KNLTDFAEQYSIQDWAKR

SEQ ID NO: 36538 - protein, 35 aa, Homo sapiens
KQVFPGLNYCTSGAYSNASSTDSASYYPLTGDTRL

SEQ ID NO: 36539 - protein, 21 aa, Homo sapiens
KQVLFLDTVYGNCSTHFTVKT

SEQ ID NO: 36540 - protein, 10 aa, Homo sapiens
KSISAALEHK

SEQ ID NO: 36541 - protein, 21 aa, Homo sapiens
KSISAALEHKVSALLTPAEQT

SEQ ID NO: 36542 - protein, 25 aa, Homo sapiens
KSISAALEHKVSALLTPAEQTGTWK

SEQ ID NO: 36543 - protein, 38 aa, Homo sapiens
KSSVITLNTNAELFNQSDIVAHLLSSSSSVIDALQYKL

SEQ ID NO: 36544 - protein, 8 aa, Homo sapiens
KSYNETKI

SEQ ID NO: 36545 - protein, 18 aa, Homo sapiens
KTIHDLHLFIENIDFNKS

SEQ ID NO: 36546 - protein, 26 aa, Homo sapiens
KVHNGSEILFSYFQDLVITLPFELRK

SEQ ID NO: 36547 - protein, 15 aa, Homo sapiens
KYDFNSSMLYSTAKG

SEQ ID NO: 36548 - protein, 19 aa, Homo sapiens
KYNQNFSAGNNENIMEAHV

SEQ ID NO: 36549 - protein, 41 aa, Homo sapiens
KYNQNFSAGNNENIMEAHVGINGEANLDFLNIPLTIPEMRL

SEQ ID NO: 36550 - protein, 21 aa, Homo sapiens
KYTYNYEAESSSGVPGTADSR

SEQ ID NO: 36551 - protein, 25 aa, Homo sapiens
KYTYNYEAESSSGVPGTADSRSATR

SEQ ID NO: 36552 - protein, 9 aa, Homo sapiens
LAAYLMLMR

SEQ ID NO: 36553 - protein, 7 aa, Homo sapiens
LAIPEGK

SEQ ID NO: 36554 - protein, 12 aa, Homo sapiens
LALWGEHTGQLY

SEQ ID NO: 36555 - protein, 14 aa, Homo sapiens
LALWGEHTGQLYSK

SEQ ID NO: 36556 - protein, 10 aa, Homo sapiens
LAPGELTIIL

SEQ ID NO: 36557 - protein, 10 aa, Homo sapiens
LATALSLSNK

SEQ ID NO: 36558 - protein, 25 aa, Homo sapiens
LATALSLSNKFVEGSHNSTVSLTTK

SEQ ID NO: 36559 - protein, 10 aa, Homo sapiens
LDFSSQADLR

SEQ ID NO: 36560 - protein, 14 aa, Homo sapiens
LDFSSQADLRNEIK

SEQ ID NO: 36561 - protein, 9 aa, Homo sapiens
LDNIYSSDK

SEQ ID NO: 36562 - protein, 12 aa, Homo sapiens
LDNIYSSDKFYK

SEQ ID NO: 36563 - protein, 23 aa, Homo sapiens
LDSTCSSTVQFLEYELNVLGTHK

SEQ ID NO: 36564 - protein, 9 aa, Homo sapiens
LDVTTSIGR

SEQ ID NO: 36565 - protein, 6 aa, Homo sapiens
LEDTPK

SEQ ID NO: 36566 - protein, 14 aa, Homo sapiens
LEIQSQVDSQHVGH

SEQ ID NO: 36567 - protein, 17 aa, Homo sapiens
LEIQSQVDSQHVGHSVL

SEQ ID NO: 36568 - protein, 20 aa, Homo sapiens
LEIQSQVDSQHVGHSVLTAK

SEQ ID NO: 36569 - protein, 14 aa, Homo sapiens
LELELRPTGEIEQY

SEQ ID NO: 36570 - protein, 18 aa, Homo sapiens
LELELRPTGEIEQYSVSA

SEQ ID NO: 36571 - protein, 20 aa, Homo sapiens
LELELRPTGEIEQYSVSATY

SEQ ID NO: 36572 - protein, 24 aa, Homo sapiens
LELELRPTGEIEQYSVSATYELQR

SEQ ID NO: 36573 - protein, 13 aa, Homo sapiens
LEVANMQAELVAK

SEQ ID NO: 36574 - protein, 18 aa, Homo sapiens
LEVLNFDFQANAQLSNPK

SEQ ID NO: 36575 - protein, 7 aa, Homo sapiens
LFLEETK

SEQ ID NO: 36576 - protein, 18 aa, Homo sapiens
LGEELGFASLHDLQLLGK

SEQ ID NO: 36577 - protein, 8 aa, Homo sapiens
LGNNPVSK

SEQ ID NO: 36578 - protein, 8 aa, Homo sapiens
LHVAGNLK

SEQ ID NO: 36579 - protein, 34 aa, Homo sapiens
LIDLSIQNYHTFLIYITELLKKLQSTTVMNPYMK

SEQ ID NO: 36580 - protein, 9 aa, Homo sapiens
LIDVISMYR

SEQ ID NO: 36581 - protein, 10 aa, Homo sapiens
LIGDFEVAEK

SEQ ID NO: 36582 - protein, 11 aa, Homo sapiens
LIVAMSSWLQK

SEQ ID NO: 36583 - protein, 11 aa, Homo sapiens
LKQHIEAIDVR

SEQ ID NO: 36584 - protein, 20 aa, Homo sapiens
LKTQFNNNEYSQDLDAYNTK

SEQ ID NO: 36585 - protein, 22 aa, Homo sapiens
LKTQFNNNEYSQDLDAYNTKDK

SEQ ID NO: 36586 - protein, 30 aa, Homo sapiens
LKTQFNNNEYSQDLDAYNTKDKIGVELTGR

SEQ ID NO: 36587 - protein, 14 aa, Homo sapiens
LLDHRVPETDMTFR

SEQ ID NO: 36588 - protein, 18 aa, Homo sapiens
LLLQMDSSATAYGSTVSK

SEQ ID NO: 36589 - protein, 19 aa, Homo sapiens
LLLQMDSSATAYGSTVSKR

SEQ ID NO: 36590 - protein, 15 aa, Homo sapiens
LLSEPINIIDALEMR

SEQ ID NO: 36591 - protein, 15 aa, Homo sapiens
LLSGGNTLHLVSTTK

SEQ ID NO: 36592 - protein, 26 aa, Homo sapiens
LLSGGNTLHLVSTTKTEVIPPLIENR

SEQ ID NO: 36593 - protein, 15 aa, Homo sapiens
LLSSSSSVIDALQYK

SEQ ID NO: 36594 - protein, 26 aa, Homo sapiens
LNDLNSVLVMPTFHVPFTDLQVPSCK

SEQ ID NO: 36595 - protein, 7 aa, Homo sapiens
LNELSFK

SEQ ID NO: 36596 - protein, 13 aa, Homo sapiens
LNGEIQALELPQK

SEQ ID NO: 36597 - protein, 18 aa, Homo sapiens
LNGEIQALELPQKAEALK

SEQ ID NO: 36598 - protein, 8 aa, Homo sapiens
LNGESNLR

SEQ ID NO: 36599 - protein, 23 aa, Homo sapiens
LNGESNLRFNSSYLQGTNQITGR

SEQ ID NO: 36600 - protein, 25 aa, Homo sapiens
LNTDIAGLASAIDMSTNYNSDSLHF

SEQ ID NO: 36601 - protein, 30 aa, Homo sapiens
LNTDIAGLASAIDMSTNYNSDSLHFSNVFR

SEQ ID NO: 36602 - protein, 33 aa, Homo sapiens
LPEIAIPEFIIPTLNLNDFQVPDLHIPEFQLPH

SEQ ID NO: 36603 - protein, 16 aa, Homo sapiens
LPQQANDYLNSFNWER

SEQ ID NO: 36604 - protein, 12 aa, Homo sapiens
LPYTIITTPPLK

SEQ ID NO: 36605 - protein, 19 aa, Homo sapiens
LPYTIITTPPLKDFSLWEK

SEQ ID NO: 36606 - protein, 6 aa, Homo sapiens
LQAEAR

SEQ ID NO: 36607 - protein, 17 aa, Homo sapiens
LQAEARSEILAHWSPAK

SEQ ID NO: 36608 - protein, 14 aa, Homo sapiens
LQDFSDQLSDYYEK

SEQ ID NO: 36609 - protein, 12 aa, Homo sapiens
LQSTTVMNPYMK

SEQ ID NO: 36610 - protein, 14 aa, Homo sapiens
LSGGNTLHLVSTTK

SEQ ID NO: 36611 - protein, 10 aa, Homo sapiens
LSILTDPDGK

SEQ ID NO: 36612 - protein, 10 aa, Homo sapiens
LSLESLTSYF

SEQ ID NO: 36613 - protein, 17 aa, Homo sapiens
LSLESLTSYFSIESSTK

SEQ ID NO: 36614 - protein, 13 aa, Homo sapiens
LSNDMMGSYAEMK

SEQ ID NO: 36615 - protein, 9 aa, Homo sapiens
LSNVLQQVK

SEQ ID NO: 36616 - protein, 15 aa, Homo sapiens
LSPSAQQASWQVSAR

SEQ ID NO: 36617 - protein, 9 aa, Homo sapiens
LTIFKTELR

SEQ ID NO: 36618 - protein, 10 aa, Homo sapiens
LTISEQNIQR

SEQ ID NO: 36619 - protein, 8 aa, Homo sapiens
LTLDIQNK

SEQ ID NO: 36620 - protein, 9 aa, Homo sapiens
LTLDIQNKK

SEQ ID NO: 36621 - protein, 9 aa, Homo sapiens
LVDHFGYTK

SEQ ID NO: 36622 - protein, 9 aa, Homo sapiens
LVELTHQYK

SEQ ID NO: 36623 - protein, 10 aa, Homo sapiens
LVGFIDDAVK

SEQ ID NO: 36624 - protein, 19 aa, Homo sapiens
LVMPTFHVPFTDLQVPSCK

SEQ ID NO: 36625 - protein, 12 aa, Homo sapiens
LWGEHTGQLYSK

SEQ ID NO: 36626 - protein, 19 aa, Homo sapiens
LYQLQVPLLGVLDLSTNVY

SEQ ID NO: 36627 - protein, 6 aa, Homo sapiens
LYSILK

SEQ ID NO: 36628 - protein, 9 aa, Homo sapiens
MGLAFESTK

SEQ ID NO: 36629 - protein, 13 aa, Homo sapiens
MGQTMEQLTPELK

SEQ ID NO: 36630 - protein, 9 aa, Homo sapiens
MIQFDQYIK

SEQ ID NO: 36631 - protein, 15 aa, Homo sapiens
MKALVEQGFTVPEIK

SEQ ID NO: 36632 - protein, 6 aa, Homo sapiens
MLETVR

SEQ ID NO: 36633 - protein, 12 aa, Homo sapiens
MNFKQELNGNTK

SEQ ID NO: 36634 - protein, 14 aa, Homo sapiens
MTSNFPVDLSDYPK

SEQ ID NO: 36635 - protein, 12 aa, Homo sapiens
MYQMDIQQELQR

SEQ ID NO: 36636 - protein, 11 aa, Homo sapiens
NAEWVYQGAIR

SEQ ID NO: 36637 - protein, 7 aa, Homo sapiens
NDFFLHY

SEQ ID NO: 36638 - protein, 7 aa, Homo sapiens
NFATSNK

SEQ ID NO: 36639 - protein, 9 aa, Homo sapiens
NFVASHIAN

SEQ ID NO: 36640 - protein, 22 aa, Homo sapiens
NFVASHIANILNSEELDIQDLK

SEQ ID NO: 36641 - protein, 23 aa, Homo sapiens
NFVASHIANILNSEELDIQDLKK

SEQ ID NO: 36642 - protein, 10 aa, Homo sapiens
NHLQLEGLFF

SEQ ID NO: 36643 - protein, 18 aa, Homo sapiens
NHLQLEGLFFTNGEHTSK

SEQ ID NO: 36644 - protein, 6 aa, Homo sapiens
NIFNFK

SEQ ID NO: 36645 - protein, 13 aa, Homo sapiens
NIFNFKVSQEGLK

SEQ ID NO: 36646 - protein, 9 aa, Homo sapiens
NIILPVYDK

SEQ ID NO: 36647 - protein, 15 aa, Homo sapiens
NIQEYLSILTDPDGK

SEQ ID NO: 36648 - protein, 17 aa, Homo sapiens
NIQEYLSILTDPDGKGK

SEQ ID NO: 36649 - protein, 32 aa, Homo sapiens
NKADYVETVLDSTCSSTVQFLEYELNVLGTHK

SEQ ID NO: 36650 - protein, 12 aa, Homo sapiens
NLKHINIDQFVR

SEQ ID NO: 36651 - protein, 7 aa, Homo sapiens
NLLVALK

SEQ ID NO: 36652 - protein, 15 aa, Homo sapiens
NLQNNAEWVYQGAIR

SEQ ID NO: 36653 - protein, 9 aa, Homo sapiens
NLTDFAEQY

SEQ ID NO: 36654 - protein, 16 aa, Homo sapiens
NLTDFAEQYSIQDWAK

SEQ ID NO: 36655 - protein, 17 aa, Homo sapiens
NLTDFAEQYSIQDWAKR

SEQ ID NO: 36656 - protein, 16 aa, Homo sapiens
NMGLPDFHIPENLFLK

SEQ ID NO: 36657 - protein, 9 aa, Homo sapiens
NNALDFVTK

SEQ ID NO: 36658 - protein, 15 aa, Homo sapiens
NNALDFVTKSYNETK

SEQ ID NO: 36659 - protein, 12 aa, Homo sapiens
NPNGYSFSIPVK

SEQ ID NO: 36660 - protein, 21 aa, Homo sapiens
NQDVHSINLPFFETLQEYFER

SEQ ID NO: 36661 - protein, 11 aa, Homo sapiens
NRNNALDFVTK

SEQ ID NO: 36662 - protein, 11 aa, Homo sapiens
NSEEFAAAMSR

SEQ ID NO: 36663 - protein, 15 aa, Homo sapiens
NSEEFAAAMSRYELK

SEQ ID NO: 36664 - protein, 23 aa, Homo sapiens
NSLFFSAQPFEITASTNNEGNLK

SEQ ID NO: 36665 - protein, 14 aa, Homo sapiens
NSLKIEIPLPFGGK

SEQ ID NO: 36666 - protein, 22 aa, Homo sapiens
NSVLVMPTFHVPFTDLQVPSCK

SEQ ID NO: 36667 - protein, 15 aa, Homo sapiens
NTASLKYENYELTLK

SEQ ID NO: 36668 - protein, 9 aa, Homo sapiens
NTFTLSCDG

SEQ ID NO: 36669 - protein, 12 aa, Homo sapiens
NTFTLSCDGSLR

SEQ ID NO: 36670 - protein, 12 aa, Homo sapiens
NTLELSNGVIVK

SEQ ID NO: 36671 - protein, 17 aa, Homo sapiens
NYEAESSSGVPGTADSR

SEQ ID NO: 36672 - protein, 6 aa, Homo sapiens
NYQLYK

SEQ ID NO: 36673 - protein, 9 aa, Homo sapiens
PAEQTGTWK

SEQ ID NO: 36674 - protein, 15 aa, Homo sapiens
PAGIVIPSFQALTAR

SEQ ID NO: 36675 - protein, 11 aa, Homo sapiens
PEQTIEIPSIK

SEQ ID NO: 36676 - protein, 14 aa, Homo sapiens
PESQLTVSQFTLPK

SEQ ID NO: 36677 - protein, 21 aa, Homo sapiens
PFFEITVPESQLTVSQFTLPK

SEQ ID NO: 36678 - protein, 12 aa, Homo sapiens
PFFETLQEYFER

SEQ ID NO: 36679 - protein, 11 aa, Homo sapiens
PLAFTFSHDYK

SEQ ID NO: 36680 - protein, 19 aa, Homo sapiens
PLSTLISSSQSCQYTLDAK

SEQ ID NO: 36681 - protein, 7 aa, Homo sapiens
PSLMIQK

SEQ ID NO: 36682 - protein, 20 aa, Homo sapiens
PSVSVEFVTNMGIIIPDFAR

SEQ ID NO: 36683 - protein, 16 aa, Homo sapiens
PTIIVPEQTIEIPSIK

SEQ ID NO: 36684 - protein, 9 aa, Homo sapiens
PTLEALFGK

SEQ ID NO: 36685 - protein, 12 aa, Homo sapiens
PVYNATWSASLK

SEQ ID NO: 36686 - protein, 14 aa, Homo sapiens
PYTQTLQDHLNSLK

SEQ ID NO: 36687 - protein, 7 aa, Homo sapiens
QAEAVLK

SEQ ID NO: 36688 - protein, 16 aa, Homo sapiens
QDDCTGDEDYTYLILR

SEQ ID NO: 36689 - protein, 8 aa, Homo sapiens
QELNGNTK

SEQ ID NO: 36690 - protein, 10 aa, Homo sapiens
QGFFPDSVNK

SEQ ID NO: 36691 - protein, 9 aa, Homo sapiens
QHIEAIDVR

SEQ ID NO: 36692 - protein, 6 aa, Homo sapiens
QHLFVK

SEQ ID NO: 36693 - protein, 6 aa, Homo sapiens
QNALLR

SEQ ID NO: 36694 - protein, 17 aa, Homo sapiens
QNALLRSEYQADYESLR

SEQ ID NO: 36695 - protein, 8 aa, Homo sapiens
QSFDLSVK

SEQ ID NO: 36696 - protein, 23 aa, Homo sapiens
QSMTLSSEVQIPDFDVDLGTILR

SEQ ID NO: 36697 - protein, 12 aa, Homo sapiens
QSQVELSNDQEK

SEQ ID NO: 36698 - protein, 9 aa, Homo sapiens
QTEATMTFK

SEQ ID NO: 36699 - protein, 13 aa, Homo sapiens
QTPDFIVPLTDLR

SEQ ID NO: 36700 - protein, 10 aa, Homo sapiens
QTVNLQLQPY

SEQ ID NO: 36701 - protein, 21 aa, Homo sapiens
QTVNLQLQPYSLVTTLNSDLK

SEQ ID NO: 36702 - protein, 16 aa, Homo sapiens
QVFLYPEKDEPTYILN

SEQ ID NO: 36703 - protein, 18 aa, Homo sapiens
QVFLYPEKDEPTYILNIK

SEQ ID NO: 36704 - protein, 33 aa, Homo sapiens
QVFPGLNYCTSGAYSNASSTDSASYYPLTGDTR

SEQ ID NO: 36705 - protein, 19 aa, Homo sapiens
QVLFLDTVYGNCSTHFTVK

SEQ ID NO: 36706 - protein, 19 aa, Homo sapiens
RFEVDSPVYNATWSASLKN

SEQ ID NO: 36707 - protein, 17 aa, Homo sapiens
RFNSSYLQGTNQITGRY

SEQ ID NO: 36708 - protein, 17 aa, Homo sapiens
RGIISALLVPPETEEAK

SEQ ID NO: 36709 - protein, 22 aa, Homo sapiens
RLIDLSIQNYHTFLIYITELLK

SEQ ID NO: 36710 - protein, 16 aa, Homo sapiens
RNLQNNAEWVYQGAIR

SEQ ID NO: 36711 - protein, 18 aa, Homo sapiens
RVNQNLVYESGSLNFSKL

SEQ ID NO: 36712 - protein, 12 aa, Homo sapiens
SADLIEIGLEGK

SEQ ID NO: 36713 - protein, 9 aa, Homo sapiens
SAFGYVFPK

SEQ ID NO: 36714 - protein, 31 aa, Homo sapiens
SALVQVHASQPSSFHDFPDLGQEVALNANTK

SEQ ID NO: 36715 - protein, 18 aa, Homo sapiens
SAQPFEITASTNNEGNLK

SEQ ID NO: 36716 - protein, 11 aa, Homo sapiens
SEILAHWSPAK

SEQ ID NO: 36717 - protein, 13 aa, Homo sapiens
SEPINIIDALEMR

SEQ ID NO: 36718 - protein, 11 aa, Homo sapiens
SEYQADYESLR

SEQ ID NO: 36719 - protein, 12 aa, Homo sapiens
SFDYHQFVDETN

SEQ ID NO: 36720 - protein, 14 aa, Homo sapiens
SFDYHQFVDETNDK

SEQ ID NO: 36721 - protein, 16 aa, Homo sapiens
SFDYHQFVDETNDKIR

SEQ ID NO: 36722 - protein, 13 aa, Homo sapiens
SGGNTLHLVSTTK

SEQ ID NO: 36723 - protein, 15 aa, Homo sapiens
SGSSTASWIQNVDTK

SEQ ID NO: 36724 - protein, 19 aa, Homo sapiens
SGSSTASWIQNVDTKYQIR

SEQ ID NO: 36725 - protein, 18 aa, Homo sapiens
SGVQMNTNFFHESGLEAH

SEQ ID NO: 36726 - protein, 22 aa, Homo sapiens
SGVQMNTNFFHESGLEAHVALK

SEQ ID NO: 36727 - protein, 7 aa, Homo sapiens
SHDELPR

SEQ ID NO: 36728 - protein, 15 aa, Homo sapiens
SHGLELNADILGTDK

SEQ ID NO: 36729 - protein, 16 aa, Homo sapiens
SINLPFFETLQEYFER

SEQ ID NO: 36730 - protein, 9 aa, Homo sapiens
SISAALEHK

SEQ ID NO: 36731 - protein, 24 aa, Homo sapiens
SISAALEHKVSALLTPAEQTGTWK

SEQ ID NO: 36732 - protein, 18 aa, Homo sapiens
SITNPLAVLCEFISQSIK

SEQ ID NO: 36733 - protein, 8 aa, Homo sapiens
SKEVPEAR

SEQ ID NO: 36734 - protein, 12 aa, Homo sapiens
SKPTVSSSMEFK

SEQ ID NO: 36735 - protein, 25 aa, Homo sapiens
SKPTVSSSMEFKYDFNSSMLYSTAK

SEQ ID NO: 36736 - protein, 9 aa, Homo sapiens
SLDEHYHIR

SEQ ID NO: 36737 - protein, 8 aa, Homo sapiens
SLHMYANR

SEQ ID NO: 36738 - protein, 14 aa, Homo sapiens
SLNIAGLSLDFSSK

SEQ ID NO: 36739 - protein, 16 aa, Homo sapiens
SLPYTQTLQDHLNSLK

SEQ ID NO: 36740 - protein, 11 aa, Homo sapiens
SLVTTLNSDLK

SEQ ID NO: 36741 - protein, 7 aa, Homo sapiens
SLWDFLK

SEQ ID NO: 36742 - protein, 11 aa, Homo sapiens
SNTVASLHTEK

SEQ ID NO: 36743 - protein, 23 aa, Homo sapiens
SNTVASLHTEKNTLELSNGVIVK

SEQ ID NO: 36744 - protein, 10 aa, Homo sapiens
SPAFTDLHLR

SEQ ID NO: 36745 - protein, 13 aa, Homo sapiens
SPAFTDLHLRYQK

SEQ ID NO: 36746 - protein, 16 aa, Homo sapiens
SPAFTDLHLRYQKDKK

SEQ ID NO: 36747 - protein, 9 aa, Homo sapiens
SPSQADINK

SEQ ID NO: 36748 - protein, 7 aa, Homo sapiens
SQAIATK

SEQ ID NO: 36749 - protein, 17 aa, Homo sapiens
SRATLYALSHAVNNYHK

SEQ ID NO: 36750 - protein, 9 aa, Homo sapiens
SSRDLKMLE

SEQ ID NO: 36751 - protein, 21 aa, Homo sapiens
STCSSTVQFLEYELNVLGTHK

SEQ ID NO: 36752 - protein, 13 aa, Homo sapiens
STSPPKQAEAVLK

SEQ ID NO: 36753 - protein, 9 aa, Homo sapiens
SVGFHLPSR

SEQ ID NO: 36754 - protein, 20 aa, Homo sapiens
SVGFHLPSREFQVPTFTIPK

SEQ ID NO: 36755 - protein, 15 aa, Homo sapiens
SVMAPFTMTIDAHTN

SEQ ID NO: 36756 - protein, 17 aa, Homo sapiens
SVMAPFTMTIDAHTNGN

SEQ ID NO: 36757 - protein, 19 aa, Homo sapiens
SVMAPFTMTIDAHTNGNGK

SEQ ID NO: 36758 - protein, 10 aa, Homo sapiens
SVSATYELQR

SEQ ID NO: 36759 - protein, 17 aa, Homo sapiens
SVSDGIAALDLNAVANK

SEQ ID NO: 36760 - protein, 13 aa, Homo sapiens
SVSLPSLDPASAK

SEQ ID NO: 36761 - protein, 18 aa, Homo sapiens
SYTLILPSLELPVLHVPR

SEQ ID NO: 36762 - protein, 17 aa, Homo sapiens
TEHGSEMLFFGNAIEGK

SEQ ID NO: 36763 - protein, 11 aa, Homo sapiens
TEVIPPLIENR

SEQ ID NO: 36764 - protein, 8 aa, Homo sapiens
TFIEDVNK

SEQ ID NO: 36765 - protein, 19 aa, Homo sapiens
TFQIPGYTVPVVNVEVSPF

SEQ ID NO: 36766 - protein, 23 aa, Homo sapiens
TFQIPGYTVPVVNVEVSPFTIEM

SEQ ID NO: 36767 - protein, 32 aa, Homo sapiens
TFQIPGYTVPVVNVEVSPFTIEMSAFGYVFPK

SEQ ID NO: 36768 - protein, 15 aa, Homo sapiens
TFQTPDFIVPLTDLR

SEQ ID NO: 36769 - protein, 12 aa, Homo sapiens
TGDEDYTYLILR

SEQ ID NO: 36770 - protein, 10 aa, Homo sapiens
TGISPLALIK

SEQ ID NO: 36771 - protein, 8 aa, Homo sapiens
TGLKEFLK

SEQ ID NO: 36772 - protein, 20 aa, Homo sapiens
TIDQMQNSELQWPVPDIYLR

SEQ ID NO: 36773 - protein, 14 aa, Homo sapiens
TIEGPLTSFGLSNK

SEQ ID NO: 36774 - protein, 13 aa, Homo sapiens
TIEMSAFGYVFPK

SEQ ID NO: 36775 - protein, 12 aa, Homo sapiens
TIFNDYIPYVFK

SEQ ID NO: 36776 - protein, 16 aa, Homo sapiens
TIHDLHLFIENIDFNK

SEQ ID NO: 36777 - protein, 18 aa, Homo sapiens
TILGTMPAFEVSLQALQK

SEQ ID NO: 36778 - protein, 13 aa, Homo sapiens
TKNSEEFAAAMSR

SEQ ID NO: 36779 - protein, 13 aa, Homo sapiens
TLADLTLLDSPIK

SEQ ID NO: 36780 - protein, 16 aa, Homo sapiens
TLADLTLLDSPIKVPL

SEQ ID NO: 36781 - protein, 31 aa, Homo sapiens
TLADLTLLDSPIKVPLLLSEPINIIDALEMR

SEQ ID NO: 36782 - protein, 9 aa, Homo sapiens
TLHLVSTTK

SEQ ID NO: 36783 - protein, 16 aa, Homo sapiens
TLILPSLELPVLHVPR

SEQ ID NO: 36784 - protein, 14 aa, Homo sapiens
TLQGIPQMIGEVIR

SEQ ID NO: 36785 - protein, 14 aa, Homo sapiens
TMPAFEVSLQALQK

SEQ ID NO: 36786 - protein, 13 aa, Homo sapiens
TMTIDAHTNGNGK

SEQ ID NO: 36787 - protein, 16 aa, Homo sapiens
TNFFHESGLEAHVALK

SEQ ID NO: 36788 - protein, 7 aa, Homo sapiens
TPALHFK

SEQ ID NO: 36789 - protein, 12 aa, Homo sapiens
TPDFIVPLTDLR

SEQ ID NO: 36790 - protein, 18 aa, Homo sapiens
TQFNNNEYSQDLDAYNTK

SEQ ID NO: 36791 - protein, 20 aa, Homo sapiens
TQFNNNEYSQDLDAYNTKDK

SEQ ID NO: 36792 - protein, 28 aa, Homo sapiens
TQFNNNEYSQDLDAYNTKDKIGVELTGR

SEQ ID NO: 36793 - protein, 12 aa, Homo sapiens
TQTLQDHLNSLK

SEQ ID NO: 36794 - protein, 14 aa, Homo sapiens
TRKGNVATEISTER

SEQ ID NO: 36795 - protein, 17 aa, Homo sapiens
TSQCTLKEVYGFNPEGK

SEQ ID NO: 36796 - protein, 15 aa, Homo sapiens
TSSFALNLPTLPEVK

SEQ ID NO: 36797 - protein, 24 aa, Homo sapiens
TSSFALNLPTLPEVKFPEVDVLTK

SEQ ID NO: 36798 - protein, 9 aa, Homo sapiens
TSTDHFSLR

SEQ ID NO: 36799 - protein, 11 aa, Homo sapiens
TSYFSIESSTK

SEQ ID NO: 36800 - protein, 11 aa, Homo sapiens
TTKQSFDLSVK

SEQ ID NO: 36801 - protein, 21 aa, Homo sapiens
TTLTAFGFASADLIEIGLEGK

SEQ ID NO: 36802 - protein, 9 aa, Homo sapiens
VAWHYDEEK

SEQ ID NO: 36803 - protein, 23 aa, Homo sapiens
VAWHYDEEKIEFEWNTGTNVDTK

SEQ ID NO: 36804 - protein, 14 aa, Homo sapiens
VEGSHNSTVSLTTK

SEQ ID NO: 36805 - protein, 11 aa, Homo sapiens
VELEVPQLCSF

SEQ ID NO: 36806 - protein, 14 aa, Homo sapiens
VELEVPQLCSFILK

SEQ ID NO: 36807 - protein, 22 aa, Homo sapiens
VGINGEANLDFLNIPLTIPEMR

SEQ ID NO: 36808 - protein, 13 aa, Homo sapiens
VHANPLLIDVVTY

SEQ ID NO: 36809 - protein, 27 aa, Homo sapiens
VHANPLLIDVVTYLVALIPEPSAQQLR

SEQ ID NO: 36810 - protein, 7 aa, Homo sapiens
VHELIER

SEQ ID NO: 36811 - protein, 17 aa, Homo sapiens
VIGNMGQTMEQLTPELK

SEQ ID NO: 36812 - protein, 6 aa, Homo sapiens
VIGTLK

SEQ ID NO: 36813 - protein, 16 aa, Homo sapiens
VKHLIDSLIDFLNFPR

SEQ ID NO: 36814 - protein, 21 aa, Homo sapiens
VKYTLNKNSLKIEIPLPFGGK

SEQ ID NO: 36815 - protein, 14 aa, Homo sapiens
VLLDQLGTTISFER

SEQ ID NO: 36816 - protein, 8 aa, Homo sapiens
VLVDHFGY

SEQ ID NO: 36817 - protein, 10 aa, Homo sapiens
VLVDHFGYTK

SEQ ID NO: 36818 - protein, 28 aa, Homo sapiens
VLVDHFGYTKDDKHEQDMVNGIMLSVEK

SEQ ID NO: 36819 - protein, 9 aa, Homo sapiens
VNDESTEGK

SEQ ID NO: 36820 - protein, 16 aa, Homo sapiens
VNQNLVYESGSLNFSK

SEQ ID NO: 36821 - protein, 16 aa, Homo sapiens
VNWEEEAASGLLTSLK

SEQ ID NO: 36822 - protein, 21 aa, Homo sapiens
VNWEEEAASGLLTSLKDNVPK

SEQ ID NO: 36823 - protein, 9 aa, Homo sapiens
VPETDMTFR

SEQ ID NO: 36824 - protein, 18 aa, Homo sapiens
VPLLLSEPINIIDALEMR

SEQ ID NO: 36825 - protein, 20 aa, Homo sapiens
VPSYTLILPSLELPVLHVPR

SEQ ID NO: 36826 - protein, 9 aa, Homo sapiens
VQGVEFSHR

SEQ ID NO: 36827 - protein, 11 aa, Homo sapiens
VRESDEETQIK

SEQ ID NO: 36828 - protein, 15 aa, Homo sapiens
VSALLTPAEQTGTWK

SEQ ID NO: 36829 - protein, 7 aa, Homo sapiens
VSQEGLK

SEQ ID NO: 36830 - protein, 7 aa, Homo sapiens
VSSFYAK

SEQ ID NO: 36831 - protein, 9 aa, Homo sapiens
VSTAFVYTK

SEQ ID NO: 36832 - protein, 21 aa, Homo sapiens
VSTAFVYTKNPNGYSFSIPVK

SEQ ID NO: 36833 - protein, 8 aa, Homo sapiens
VTQKFHMK

SEQ ID NO: 36834 - protein, 6 aa, Homo sapiens
WKNEVR

SEQ ID NO: 36835 - protein, 13 aa, Homo sapiens
WNFYYSPQSSPDK

SEQ ID NO: 36836 - protein, 14 aa, Homo sapiens
WNFYYSPQSSPDKK

SEQ ID NO: 36837 - protein, 13 aa, Homo sapiens
YDFNSSMLYSTAK

SEQ ID NO: 36838 - protein, 24 aa, Homo sapiens
YDKNQDVHSINLPFFETLQEYFER

SEQ ID NO: 36839 - protein, 20 aa, Homo sapiens
YEDGTLSLTSTSDLQSGIIK

SEQ ID NO: 36840 - protein, 11 aa, Homo sapiens
YELKLAIPEGK

SEQ ID NO: 36841 - protein, 9 aa, Homo sapiens
YENYELTLK

SEQ ID NO: 36842 - protein, 13 aa, Homo sapiens
YEVDQQIQVLMDK

SEQ ID NO: 36843 - protein, 12 aa, Homo sapiens
YGMVAQVTQTLK

SEQ ID NO: 36844 - protein, 22 aa, Homo sapiens
YGMVAQVTQTLKLEDTPKINSR

SEQ ID NO: 36845 - protein, 11 aa, Homo sapiens
YGNCSTHFTVK

SEQ ID NO: 36846 - protein, 17 aa, Homo sapiens
YHMKADSVVDLLSYNVQ

SEQ ID NO: 36847 - protein, 11 aa, Homo sapiens
YHWEHTGLTLR

SEQ ID NO: 36848 - protein, 12 aa, Homo sapiens
YKAEKSHDELPR

SEQ ID NO: 36849 - protein, 16 aa, Homo sapiens
YKLQDFSDQLSDYYEK

SEQ ID NO: 36850 - protein, 9 aa, Homo sapiens
YKNFATSNK

SEQ ID NO: 36851 - protein, 20 aa, Homo sapiens
YLRTEHGSEMLFFGNAIEGK

SEQ ID NO: 36852 - protein, 11 aa, Homo sapiens
YNALDLTNNGK

SEQ ID NO: 36853 - protein, 17 aa, Homo sapiens
YNQNFSAGNNENIMEAH

SEQ ID NO: 36854 - protein, 13 aa, Homo sapiens
YNSDSLHFSNVFR

SEQ ID NO: 36855 - protein, 26 aa, Homo sapiens
YSQPEDSLIPFFEITVPESQLTVSQF

SEQ ID NO: 36856 - protein, 30 aa, Homo sapiens
YSQPEDSLIPFFEITVPESQLTVSQFTLPK

SEQ ID NO: 36857 - protein, 19 aa, Homo sapiens
YTLNKNSLKIEIPLPFGGK

SEQ ID NO: 36858 - protein, 20 aa, Homo sapiens
YTYNYEAESSSGVPGTADSR

SEQ ID NO: 36859 - protein, 7 aa, Homo sapiens
YYELEEK

SEQ ID NO: 36860 - protein, 19 aa, Homo sapiens
MQKSTNSDTSVETLNSTRQ

SEQ ID NO: 36861 - protein, 35 aa, Homo sapiens
MTPNPGYQPSMNTSDMMGRMSYEPNKDPYGSMRKA

SEQ ID NO: 36862 - protein, 28 aa, Homo sapiens
QDGAESNGGGGGGGAGSGGGPGAEPDLK

SEQ ID NO: 36863 - protein, 17 aa, Homo sapiens
TELLPSRPHAPCPPAPR

SEQ ID NO: 36864 - protein, 19 aa, Homo sapiens
DSSLLTLPNIENHHLHLFK

SEQ ID NO: 36865 - protein, 19 aa, Homo sapiens
FLNEHLQEACTPELKPVEK

SEQ ID NO: 36866 - protein, 14 aa, Homo sapiens
FRPVPLGQTFLGIK

SEQ ID NO: 36867 - protein, 21 aa, Homo sapiens
HPPHTELLDLQPLPITALGCK

SEQ ID NO: 36868 - protein, 22 aa, Homo sapiens
ILGENAKPNYGCQVTIQSEQEK

SEQ ID NO: 36869 - protein, 30 aa, Homo sapiens
IPYSEPMPLSFEEKPVYIQDLDEIGQLAFK

SEQ ID NO: 36870 - protein, 27 aa, Homo sapiens
KAGHQVMVFVHARNATVRTAMSLIERA

SEQ ID NO: 36871 - protein, 26 aa, Homo sapiens
LKPECSTEELLSILSDAEEYTDLPVR

SEQ ID NO: 36872 - protein, 21 aa, Homo sapiens
NCGHIPFFFPTQGHDYVLAEK

SEQ ID NO: 36873 - protein, 23 aa, Homo sapiens
SGDELQDELFELLGPEGLELIEK

SEQ ID NO: 36874 - protein, 16 aa, Homo sapiens
TSIESLPELIHACGGK

SEQ ID NO: 36875 - protein, 31 aa, Homo sapiens
VREEEIEELDTLLSNFCELSTPGGVENSYGK

SEQ ID NO: 36876 - protein, 30 aa, Homo sapiens
KNAKSSGNSSSSGSGSGSTSAGSSSPGARR

SEQ ID NO: 36877 - protein, 18 aa, Homo sapiens
LGIYDADGDGDFDVDDAK

SEQ ID NO: 36878 - protein, 17 aa, Homo sapiens
NDLGVGYLLIGDNDNAK

SEQ ID NO: 36879 - protein, 21 aa, Homo sapiens
RQGAIVAVTGDGVNDSPALKK

SEQ ID NO: 36880 - protein, 17 aa, Homo sapiens
AQFGSDLDAATQQLLSR

SEQ ID NO: 36881 - protein, 13 aa, Homo sapiens
EAYPGDVFYLHSR

SEQ ID NO: 36882 - protein, 12 aa, Homo sapiens
EIVTNFLAGFEA

SEQ ID NO: 36883 - protein, 22 aa, Homo sapiens
EVAAFAQFGSDLDAATQQLLSR

SEQ ID NO: 36884 - protein, 16 aa, Homo sapiens
FENAFLSHVVSQHQAL

SEQ ID NO: 36885 - protein, 21 aa, Homo sapiens
FENAFLSHVVSQHQALLGTIR

SEQ ID NO: 36886 - protein, 14 aa, Homo sapiens
GIRPAINVGLSVSR

SEQ ID NO: 36887 - protein, 20 aa, Homo sapiens
GMSLNLEPDNVGVVVFGNDK

SEQ ID NO: 36888 - protein, 11 aa, Homo sapiens
HALIIYDDLSK

SEQ ID NO: 36889 - protein, 15 aa, Homo sapiens
ILGADTSVDLEETGR

SEQ ID NO: 36890 - protein, 16 aa, Homo sapiens
LSHVVSQHQALLGTIR

SEQ ID NO: 36891 - protein, 19 aa, Homo sapiens
NAFLSHVVSQHQALLGTIR

SEQ ID NO: 36892 - protein, 21 aa, Homo sapiens
QGQYSPMAIEEQVAVIYAGVR

SEQ ID NO: 36893 - protein, 16 aa, Homo sapiens
TGAIVDVPVGEELLGR

SEQ ID NO: 36894 - protein, 12 aa, Homo sapiens
TSIAIDTIINQK

SEQ ID NO: 36895 - protein, 12 aa, Homo sapiens
VVDALGNAIDGK

SEQ ID NO: 36896 - protein, 31 aa, Homo sapiens
YTIVVSATASDAAPLQYLAPYSGCSMGEYFR

SEQ ID NO: 36897 - protein, 23 aa, Homo sapiens
QKFNDSEGDDTEETEDYRQFRKS

SEQ ID NO: 36898 - protein, 14 aa, Homo sapiens
VVAVQFCNNGDSLR

SEQ ID NO: 36899 - protein, 18 aa, Homo sapiens
VVVNELNNGVSRVQEECR

SEQ ID NO: 36900 - protein, 25 aa, Homo sapiens
APLATGEDDDDEVPDLVENFDEASK

SEQ ID NO: 36901 - protein, 29 aa, Homo sapiens
APLATGEDDDDEVPDLVENFDEASKNEAN

SEQ ID NO: 36902 - protein, 16 aa, Homo sapiens
GGCPGGEATLSQPPPR

SEQ ID NO: 36903 - protein, 28 aa, Homo sapiens
LGVNNISGIEEVNMFTNQGTVIHFNNPK

SEQ ID NO: 36904 - protein, 22 aa, Homo sapiens
QLTEMLPSILNQLGADSLTSLR

SEQ ID NO: 36905 - protein, 19 aa, Homo sapiens
VQASLAANTFTITGHAETK

SEQ ID NO: 36906 - protein, 16 aa, Homo sapiens
AVLTNPQGDYDTSTGK

SEQ ID NO: 36907 - protein, 18 aa, Homo sapiens
FNAVLTNPQGDYDTSTGK

SEQ ID NO: 36908 - protein, 9 aa, Homo sapiens
FQSVFTVTR

SEQ ID NO: 36909 - protein, 17 aa, Homo sapiens
NAVLTNPQGDYDTSTGK

SEQ ID NO: 36910 - protein, 13 aa, Homo sapiens
QTHQPPAPNSLIR

SEQ ID NO: 36911 - protein, 12 aa, Homo sapiens
TNQVNSGGVLLR

SEQ ID NO: 36912 - protein, 10 aa, Homo sapiens
VPGLYYFVYH

SEQ ID NO: 36913 - protein, 23 aa, Homo sapiens
VPGLYYFVYHASHTANLCVLLYR

SEQ ID NO: 36914 - protein, 10 aa, Homo sapiens
VVTFCGHTSK

SEQ ID NO: 36915 - protein, 13 aa, Homo sapiens
YKQKFQSVFTVTR

SEQ ID NO: 36916 - protein, 17 aa, Homo sapiens
AVECCPTSVELWLALAR

SEQ ID NO: 36917 - protein, 10 aa, Homo sapiens
HGELWCAVSK

SEQ ID NO: 36918 - protein, 14 aa, Homo sapiens
HLQTGENHTSVDPR

SEQ ID NO: 36919 - protein, 14 aa, Homo sapiens
KNLSGPDDLLIDKN

SEQ ID NO: 36920 - protein, 14 aa, Homo sapiens
MPSNSSASISKLRE

SEQ ID NO: 36921 - protein, 16 aa, Homo sapiens
AVQQPDGLAVLGIFLK

SEQ ID NO: 36922 - protein, 12 aa, Homo sapiens
EPISVSSEQVLK

SEQ ID NO: 36923 - protein, 16 aa, Homo sapiens
GPEHWHKDFPIAKGER

SEQ ID NO: 36924 - protein, 18 aa, Homo sapiens
HNGPEHWHKDFPIAKGER

SEQ ID NO: 36925 - protein, 25 aa, Homo sapiens
KLNFNGEGEPEELMVDNWRPAQPLK

SEQ ID NO: 36926 - protein, 27 aa, Homo sapiens
KLNFNGEGEPEELMVDNWRPAQPLKNR

SEQ ID NO: 36927 - protein, 30 aa, Homo sapiens
KLNFNGEGEPEELMVDNWRPAQPLKNRQIK

SEQ ID NO: 36928 - protein, 17 aa, Homo sapiens
PSLKPLSVSYDQATSLR

SEQ ID NO: 36929 - protein, 12 aa, Homo sapiens
QSPVDIDTHTAK

SEQ ID NO: 36930 - protein, 10 aa, Homo sapiens
SADFTNFDPR

SEQ ID NO: 36931 - protein, 10 aa, Homo sapiens
VGSAKPGLQK

SEQ ID NO: 36932 - protein, 9 aa, Homo sapiens
VVDVLDSIK

SEQ ID NO: 36933 - protein, 13 aa, Homo sapiens
YAAELHLVHWNTK

SEQ ID NO: 36934 - protein, 19 aa, Homo sapiens
YDPSLKPLSVSYDQATSLR

SEQ ID NO: 36935 - protein, 6 aa, Homo sapiens
YGDFGK

SEQ ID NO: 36936 - protein, 27 aa, Homo sapiens
RLGSSKSGDNSSSSLGDVVTGTRRPTP

SEQ ID NO: 36937 - protein, 21 aa, Homo sapiens
KLKGAILTTMLATRNFSAAKS

SEQ ID NO: 36938 - protein, 16 aa, Homo sapiens
SANTTIEDEDAKARKQ

SEQ ID NO: 36939 - protein, 16 aa, Homo sapiens
APVPTGEVYFADSFDR

SEQ ID NO: 36940 - protein, 6 aa, Homo sapiens
FLFDTK

SEQ ID NO: 36941 - protein, 14 aa, Homo sapiens
IPNPDFFEDLEPFR

SEQ ID NO: 36942 - protein, 15 aa, Homo sapiens
KIPNPDFFEDLEPFR

SEQ ID NO: 36943 - protein, 27 aa, Homo sapiens
LFDTKPLIVQYEVNFQNGIECGGAYVK

SEQ ID NO: 36944 - protein, 6 aa, Homo sapiens
LHFIFR

SEQ ID NO: 36945 - protein, 32 aa, Homo sapiens
LNKPFLFDTKPLIVQYEVNFQNGIECGGAYVK

SEQ ID NO: 36946 - protein, 12 aa, Homo sapiens
TPELNLDQFHDK

SEQ ID NO: 36947 - protein, 18 aa, Homo sapiens
WKPPMIDNPSYQGIWKPR

SEQ ID NO: 36948 - protein, 13 aa, Homo sapiens
KVDEFNVSSPQFV

SEQ ID NO: 36949 - protein, 21 aa, Homo sapiens
RSVGCIMGELLNGSPLFPGKN

SEQ ID NO: 36950 - protein, 20 aa, Homo sapiens
ACTLKPECVQQLLVCSQEAK

SEQ ID NO: 36951 - protein, 17 aa, Homo sapiens
GCNIENACYPLGICAER

SEQ ID NO: 36952 - protein, 17 aa, Homo sapiens
LKPECVQQLLVCSQEAK

SEQ ID NO: 36953 - protein, 21 aa, Homo sapiens
PACTLKPECVQQLLVCSQEAK

SEQ ID NO: 36954 - protein, 22 aa, Homo sapiens
RPACTLKPECVQQLLVCSQEAK

SEQ ID NO: 36955 - protein, 21 aa, Homo sapiens
SAYCPYSHFPVGAALLTQEGR

SEQ ID NO: 36956 - protein, 15 aa, Homo sapiens
SHFPVGAALLTQEGR

SEQ ID NO: 36957 - protein, 23 aa, Homo sapiens
AIGNEVTVDKWEPLLNNLGHVCR

SEQ ID NO: 36958 - protein, 20 aa, Homo sapiens
DPFHASCLPVHIGTLVELNK

SEQ ID NO: 36959 - protein, 24 aa, Homo sapiens
CPNQTTAIDMWSAGVIFLSLLSGR

SEQ ID NO: 36960 - protein, 13 aa, Homo sapiens
DGKEGSVGLSVQR

SEQ ID NO: 36961 - protein, 12 aa, Homo sapiens
ELDQQSTTKASV

SEQ ID NO: 36962 - protein, 25 aa, Homo sapiens
IAAELQCLTVAGGQDNVMGVKYCFR

SEQ ID NO: 36963 - protein, 14 aa, Homo sapiens
RQQVAPRAGTPGFR

SEQ ID NO: 36964 - protein, 31 aa, Homo sapiens
RVENISHTEPAVSLHLYSPPFDTCHAFDQRT

SEQ ID NO: 36965 - protein, 16 aa, Homo sapiens
FAEVECLAESHQHLSK

SEQ ID NO: 36966 - protein, 16 aa, Homo sapiens
FHNLEGFLEEFADIAK

SEQ ID NO: 36967 - protein, 16 aa, Homo sapiens
HDYWLLAGIINHGYAR

SEQ ID NO: 36968 - protein, 19 aa, Homo sapiens
HLCEPGADGAETFADGVPR

SEQ ID NO: 36969 - protein, 16 aa, Homo sapiens
KLERPPETPTVDPTVK

SEQ ID NO: 36970 - protein, 15 aa, Homo sapiens
MLDLLEDFLEHEGYK

SEQ ID NO: 36971 - protein, 12 aa, Homo sapiens
SDSEGSDYTPGK

SEQ ID NO: 36972 - protein, 24 aa, Homo sapiens
SSAQLLEDWGMEDIDHVFSEEDYR

SEQ ID NO: 36973 - protein, 26 aa, Homo sapiens
TPTPSTPGDTQPNTPAPVPPAEDGIK

SEQ ID NO: 36974 - protein, 24 aa, Homo sapiens
KVELPPPDLGPSSALNQTLMLLRE

SEQ ID NO: 36975 - protein, 26 aa, Homo sapiens
MQDLDEDATLTQLATAWVSLATGGEK

SEQ ID NO: 36976 - protein, 17 aa, Homo sapiens
NAFYIGSYQQCINEAQR

SEQ ID NO: 36977 - protein, 18 aa, Homo sapiens
EGGGGISCVLQDGCVFEK

SEQ ID NO: 36978 - protein, 20 aa, Homo sapiens
GIGGIFFDDLDSPSKEEVFR

SEQ ID NO: 36979 - protein, 19 aa, Homo sapiens
KEGGGGISCVLQDGCVFEK

SEQ ID NO: 36980 - protein, 12 aa, Homo sapiens
NPHAPTIHFNYR

SEQ ID NO: 36981 - protein, 12 aa, Homo sapiens
APILIATDVASR

SEQ ID NO: 36982 - protein, 12 aa, Homo sapiens
DMVGIAQTGSGK

SEQ ID NO: 36983 - protein, 13 aa, Homo sapiens
GDGPICLVLAPTR

SEQ ID NO: 36984 - protein, 16 aa, Homo sapiens
LLPAIVHINHQPYLER

SEQ ID NO: 36985 - protein, 15 aa, Homo sapiens
LPAIVHINHQPYLER

SEQ ID NO: 36986 - protein, 11 aa, Homo sapiens
NFYVEHPEVAR

SEQ ID NO: 36987 - protein, 30 aa, Homo sapiens
RGLDVEDVKFVINYDYPNSSEDYVHRIGRT

SEQ ID NO: 36988 - protein, 14 aa, Homo sapiens
SSQSSSQQFSGIGR

SEQ ID NO: 36989 - protein, 10 aa, Homo sapiens
STCIYGGAPK

SEQ ID NO: 36990 - protein, 20 aa, Homo sapiens
TLAYLLPAIVHINHQPYLER

SEQ ID NO: 36991 - protein, 17 aa, Homo sapiens
ELEPGDGPIAVIVCPTR

SEQ ID NO: 36992 - protein, 21 aa, Homo sapiens
SEYTQPTPIQCQGVPVALSGR

SEQ ID NO: 36993 - protein, 12 aa, Homo sapiens
TADGFAVPEPPK

SEQ ID NO: 36994 - protein, 27 aa, Homo sapiens
VSGAAPPRPGSSFAHFGFDEQLMHQIR

SEQ ID NO: 36995 - protein, 20 aa, Homo sapiens
RFFVELVGHYSLNMTVTERG

SEQ ID NO: 36996 - protein, 34 aa, Homo sapiens
RTSHGEPKSAVPFNQYLPNKSNQTAYVPAPLRKK

SEQ ID NO: 36997 - protein, 20 aa, Homo sapiens
MFSFSGFDSTNQHTVQTENR

SEQ ID NO: 36998 - protein, 17 aa, Homo sapiens
LAHVENVFHPVECSYCR

SEQ ID NO: 36999 - protein, 24 aa, Homo sapiens
LQYSQDIPSHLADEHALIASYVAR

SEQ ID NO: 37000 - protein, 6 aa, Homo sapiens
DLQEVK

SEQ ID NO: 37001 - protein, 13 aa, Homo sapiens
DSKEDQVPYVVEK

SEQ ID NO: 37002 - protein, 8 aa, Homo sapiens
KELTDFLR

SEQ ID NO: 37003 - protein, 17 aa, Homo sapiens
LLNAINTLPKGVVPHIK

SEQ ID NO: 37004 - protein, 26 aa, Homo sapiens
NDHWFDIDPTEDEDLPTTFKDLLNNF

SEQ ID NO: 37005 - protein, 13 aa, Homo sapiens
SLSELTFDEIVCK

SEQ ID NO: 37006 - protein, 13 aa, Homo sapiens
LQVEQQLANITVS

SEQ ID NO: 37007 - protein, 10 aa, Homo sapiens
AHTEEPQAKK

SEQ ID NO: 37008 - protein, 21 aa, Homo sapiens
AKEMGLPVGTAAIAPIIAAVK

SEQ ID NO: 37009 - protein, 23 aa, Homo sapiens
AWLQQYHNQCQEVLHHISMIPAK

SEQ ID NO: 37010 - protein, 29 aa, Homo sapiens
DAIITCNPEEFIVEALQLPNFQQSVQEYR

SEQ ID NO: 37011 - protein, 21 aa, Homo sapiens
FGPDTQHLVLNENCASVHNLR

SEQ ID NO: 37012 - protein, 20 aa, Homo sapiens
IQTQLNLIHPDIFPLLTSFR

SEQ ID NO: 37013 - protein, 8 aa, Homo sapiens
LMQEHKLK

SEQ ID NO: 37014 - protein, 28 aa, Homo sapiens
VLGTLAAVFVSHLHADHHTGLPSILLQR

SEQ ID NO: 37015 - protein, 25 aa, Homo sapiens
KMEDGLLTCHGPGPDNCTKCSHFKD

SEQ ID NO: 37016 - protein, 22 aa, Homo sapiens
IFEQVLSELEPLCLAEQDFISK

SEQ ID NO: 37017 - protein, 16 aa, Homo sapiens
LLSEIEFLVNHMDLAK

SEQ ID NO: 37018 - protein, 22 aa, Homo sapiens
VGILPFVAEFEEFAGLAESIFK

SEQ ID NO: 37019 - protein, 12 aa, Homo sapiens
AKPDCIITCDGK

SEQ ID NO: 37020 - protein, 9 aa, Homo sapiens
ELGVGIALR

SEQ ID NO: 37021 - protein, 22 aa, Homo sapiens
KTQTVCNFTDGALVQHQEWDGK

SEQ ID NO: 37022 - protein, 16 aa, Homo sapiens
MGAMAKPDCIITCDGK

SEQ ID NO: 37023 - protein, 10 aa, Homo sapiens
PDCIITCDGK

SEQ ID NO: 37024 - protein, 21 aa, Homo sapiens
TQTVCNFTDGALVQHQEWDGK

SEQ ID NO: 37025 - protein, 11 aa, Homo sapiens
TTQFSCTLGEK

SEQ ID NO: 37026 - protein, 19 aa, Homo sapiens
TVCNFTDGALVQHQEWDGK

SEQ ID NO: 37027 - protein, 16 aa, Homo sapiens
DCLADVDTKPAYQNLR

SEQ ID NO: 37028 - protein, 17 aa, Homo sapiens
EPLLVNESLNVENSGFR

SEQ ID NO: 37029 - protein, 26 aa, Homo sapiens
GLEAVVIGEVHENVTLHCGNISGLRG

SEQ ID NO: 37030 - protein, 23 aa, Homo sapiens
HGHLLSIDDLEGAQETDVDTGLR

SEQ ID NO: 37031 - protein, 19 aa, Homo sapiens
QTDGDMPPPPGSAGPGDND

SEQ ID NO: 37032 - protein, 18 aa, Homo sapiens
AAQTTIETAIHSLIETLK

SEQ ID NO: 37033 - protein, 11 aa, Homo sapiens
ELIEELHPIIK

SEQ ID NO: 37034 - protein, 14 aa, Homo sapiens
ASAETVDPASLWEY

SEQ ID NO: 37035 - protein, 21 aa, Homo sapiens
DELFALEQSCAQVVLQAANER

SEQ ID NO: 37036 - protein, 18 aa, Homo sapiens
DVPWGVDSLITLAFQDQR

SEQ ID NO: 37037 - protein, 10 aa, Homo sapiens
FLIVAHDDGR

SEQ ID NO: 37038 - protein, 9 aa, Homo sapiens
GEHGFIGCR

SEQ ID NO: 37039 - protein, 10 aa, Homo sapiens
LINRPIIVFR

SEQ ID NO: 37040 - protein, 13 aa, Homo sapiens
LSCFAQTVSPAEK

SEQ ID NO: 37041 - protein, 16 aa, Homo sapiens
LVARPEPATGYTLEFR

SEQ ID NO: 37042 - protein, 11 aa, Homo sapiens
NASCYFDIEWR

SEQ ID NO: 37043 - protein, 20 aa, Homo sapiens
NGQLAASVETAGDSELFLMK

SEQ ID NO: 37044 - protein, 16 aa, Homo sapiens
PWGVDSLITLAFQDQR

SEQ ID NO: 37045 - protein, 20 aa, Homo sapiens
QIWTLEQPPDEAGSAAVCLR

SEQ ID NO: 37046 - protein, 18 aa, Homo sapiens
SSYDVFQLEFNDGAYNIK

SEQ ID NO: 37047 - protein, 24 aa, Homo sapiens
VGKDELFALEQSCAQVVLQAANER

SEQ ID NO: 37048 - protein, 9 aa, Homo sapiens
WSLQSEAHR

SEQ ID NO: 37049 - protein, 14 aa, Homo sapiens
YLAADKDGNVTCER

SEQ ID NO: 37050 - protein, 9 aa, Homo sapiens
YSVQTADHR

SEQ ID NO: 37051 - protein, 26 aa, Homo sapiens
MASSTPSSSATSSNAGADPNTTNLRP

SEQ ID NO: 37052 - protein, 20 aa, Homo sapiens
DQLVIPDGQEEEQEAAGEGR

SEQ ID NO: 37053 - protein, 12 aa, Homo sapiens
EQVVEDRPVGGR

SEQ ID NO: 37054 - protein, 14 aa, Homo sapiens
IQSSHNFQLESVNK

SEQ ID NO: 37055 - protein, 14 aa, Homo sapiens
KAVLVNNITTGERL

SEQ ID NO: 37056 - protein, 12 aa, Homo sapiens
KNEFQGELEKQR

SEQ ID NO: 37057 - protein, 15 aa, Homo sapiens
LQAAGLPHTEVPQGK

SEQ ID NO: 37058 - protein, 10 aa, Homo sapiens
LQQDVLQFQK

SEQ ID NO: 37059 - protein, 9 aa, Homo sapiens
NEFQGELEK

SEQ ID NO: 37060 - protein, 12 aa, Homo sapiens
NIDVFNVEDQKR

SEQ ID NO: 37061 - protein, 19 aa, Homo sapiens
RLQQDVLQFQKNQTNLERK

SEQ ID NO: 37062 - protein, 7 aa, Homo sapiens
VLQDQLK

SEQ ID NO: 37063 - protein, 11 aa, Homo sapiens
VLQDQLKTLQR

SEQ ID NO: 37064 - protein, 8 aa, Homo sapiens
AVLHVALR

SEQ ID NO: 37065 - protein, 7 aa, Homo sapiens
DPSAVAK

SEQ ID NO: 37066 - protein, 19 aa, Homo sapiens
EFGIDPQNMFEFWDWVGGR

SEQ ID NO: 37067 - protein, 7 aa, Homo sapiens
ELQAAGK

SEQ ID NO: 37068 - protein, 8 aa, Homo sapiens
EWFLQAAK

SEQ ID NO: 37069 - protein, 15 aa, Homo sapiens
FAAYFQQGDMESNGK

SEQ ID NO: 37070 - protein, 14 aa, Homo sapiens
FNHFSLTLNTNHGH

SEQ ID NO: 37071 - protein, 21 aa, Homo sapiens
FNHFSLTLNTNHGHILVDYSK

SEQ ID NO: 37072 - protein, 25 aa, Homo sapiens
GIGGSDLGPLMVTEALKPYSSGGPR

SEQ ID NO: 37073 - protein, 23 aa, Homo sapiens
GKSTEEARKELQAAGKSPEDLER

SEQ ID NO: 37074 - protein, 11 aa, Homo sapiens
HFVALSTNTTK

SEQ ID NO: 37075 - protein, 26 aa, Homo sapiens
IEPELDGSAQVTSHDASTNGLINFIK

SEQ ID NO: 37076 - protein, 15 aa, Homo sapiens
ILLANFLAQTEALMR

SEQ ID NO: 37077 - protein, 7 aa, Homo sapiens
INYTEGR

SEQ ID NO: 37078 - protein, 8 aa, Homo sapiens
KELQAAGK

SEQ ID NO: 37079 - protein, 28 aa, Homo sapiens
KEWFLQAAKDPSAVAKHFVALSTNTTKV

SEQ ID NO: 37080 - protein, 27 aa, Homo sapiens
KIEPELDGSAQVTSHDASTNGLINFIK

SEQ ID NO: 37081 - protein, 8 aa, Homo sapiens
LFDANKDR

SEQ ID NO: 37082 - protein, 17 aa, Homo sapiens
MIPCDFLIPVQTQHPIR

SEQ ID NO: 37083 - protein, 7 aa, Homo sapiens
MLVDLAK

SEQ ID NO: 37084 - protein, 9 aa, Homo sapiens
NLVTEDVMR

SEQ ID NO: 37085 - protein, 24 aa, Homo sapiens
PELDGSAQVTSHDASTNGLINFIK

SEQ ID NO: 37086 - protein, 9 aa, Homo sapiens
RLFDANKDR

SEQ ID NO: 37087 - protein, 10 aa, Homo sapiens
SGDWKGYTGK

SEQ ID NO: 37088 - protein, 17 aa, Homo sapiens
SLTLNTNHGHILVDYSK

SEQ ID NO: 37089 - protein, 10 aa, Homo sapiens
SNTPILVDGK

SEQ ID NO: 37090 - protein, 18 aa, Homo sapiens
SNTPILVDGKDVMPEVNK

SEQ ID NO: 37091 - protein, 7 aa, Homo sapiens
SPEDLER

SEQ ID NO: 37092 - protein, 15 aa, Homo sapiens
TFTTQETITNAETAK

SEQ ID NO: 37093 - protein, 23 aa, Homo sapiens
TFTTQETITNAETAKEWFLQAAK

SEQ ID NO: 37094 - protein, 33 aa, Homo sapiens
TITDVINIGIGGSDLGPLMVTEALKPYSSGGPR

SEQ ID NO: 37095 - protein, 17 aa, Homo sapiens
TLAQLNPESSLFIIASK

SEQ ID NO: 37096 - protein, 12 aa, Homo sapiens
TNHGHILVDYSK

SEQ ID NO: 37097 - protein, 21 aa, Homo sapiens
VDHQTGPIVWGEPGTNGQHAF

SEQ ID NO: 37098 - protein, 30 aa, Homo sapiens
VDHQTGPIVWGEPGTNGQHAFYQLIHQGTK

SEQ ID NO: 37099 - protein, 15 aa, Homo sapiens
VFEGNRPTNSIVFTK

SEQ ID NO: 37100 - protein, 14 aa, Homo sapiens
VWYVSNIDGTHIAK

SEQ ID NO: 37101 - protein, 17 aa, Homo sapiens
RLPFQCSASYLGNDTRI

SEQ ID NO: 37102 - protein, 17 aa, Homo sapiens
FKVDLTPYPTISSINKR

SEQ ID NO: 37103 - protein, 20 aa, Homo sapiens
MISDLIAGGIQPLQNLSVLK

SEQ ID NO: 37104 - protein, 13 aa, Homo sapiens
MQAGKPILYSYFR

SEQ ID NO: 37105 - protein, 23 aa, Homo sapiens
DDECPVVNAYATLIENDSNPEVR

SEQ ID NO: 37106 - protein, 26 aa, Homo sapiens
KDDECPVVNAYATLIENDSNPEVRRA

SEQ ID NO: 37107 - protein, 31 aa, Homo sapiens
LDVENSSEVAVSVLNALFSITPLSELVGLCK

SEQ ID NO: 37108 - protein, 42 aa, Homo sapiens
KEAASQRPLSSSASNRLSVSSLLAAGAPMSSSASVPNLSSRE

SEQ ID NO: 37109 - protein, 36 aa, Homo sapiens
LKDENTISPYEMCSSGLVQALLTVLNNVSIFRATKQ

SEQ ID NO: 37110 - protein, 21 aa, Homo sapiens
EQSGDYECSASNDVAAPVVRR

SEQ ID NO: 37111 - protein, 23 aa, Homo sapiens
GTLQCEASAVPSAEFQWYKDDKR

SEQ ID NO: 37112 - protein, 13 aa, Homo sapiens
KGVKVENRPFLSK

SEQ ID NO: 37113 - protein, 20 aa, Homo sapiens
KLGHTNASIMLFGPGAVSEV

SEQ ID NO: 37114 - protein, 15 aa, Homo sapiens
VKVTVNYPPYISEAK

SEQ ID NO: 37115 - protein, 24 aa, Homo sapiens
VKVTVNYPPYISEAKGTGVPVGQK

SEQ ID NO: 37116 - protein, 13 aa, Homo sapiens
VTVNYPPYISEAK

SEQ ID NO: 37117 - protein, 26 aa, Homo sapiens
AAQLIGTCSQNVAAIQEQVLGLGALR

SEQ ID NO: 37118 - protein, 36 aa, Homo sapiens
LPLALPPASQGCSSGGGGGGGGGSSAGGSGNSRPPR

SEQ ID NO: 37119 - protein, 16 aa, Homo sapiens
SAFLLQNLLVGHPEHK

SEQ ID NO: 37120 - protein, 26 aa, Homo sapiens
TEHSPFHEHVLGALCSLVTDFPQGVR

SEQ ID NO: 37121 - protein, 38 aa, Homo sapiens
HSFLVHLIGLLVWQCDISVSPVAAIVTDIFNTSDGGRF

SEQ ID NO: 37122 - protein, 9 aa, Homo sapiens
DFRPLKDSR

SEQ ID NO: 37123 - protein, 24 aa, Homo sapiens
EGDALELTCEAIGKPQPVMVTWVR

SEQ ID NO: 37124 - protein, 12 aa, Homo sapiens
FQLLNFSSSELK

SEQ ID NO: 37125 - protein, 25 aa, Homo sapiens
GADDAADADTAIINAEGGQNNSEEK

SEQ ID NO: 37126 - protein, 20 aa, Homo sapiens
KDVTVIEGEVATISCQVNKS

SEQ ID NO: 37127 - protein, 15 aa, Homo sapiens
KVSLTNVSISDEGRY

SEQ ID NO: 37128 - protein, 27 aa, Homo sapiens
RDTAVEGEEIEVNCTAMASKPATTIRW

SEQ ID NO: 37129 - protein, 14 aa, Homo sapiens
RFQLLNFSSSELKV

SEQ ID NO: 37130 - protein, 25 aa, Homo sapiens
RVDDEMPQHAVLSGPNLFINNLNKT

SEQ ID NO: 37131 - protein, 32 aa, Homo sapiens
RVDDEMPQHAVLSGPNLFINNLNKTDNGTYRC

SEQ ID NO: 37132 - protein, 13 aa, Homo sapiens
SDDSVIQLLNPNR

SEQ ID NO: 37133 - protein, 27 aa, Homo sapiens
VHKEDDGVPVICQVEHPAVTGNLQTQR

SEQ ID NO: 37134 - protein, 24 aa, Homo sapiens
KQVLLFNNSHLTYVSFDFHEHCRG

SEQ ID NO: 37135 - protein, 19 aa, Homo sapiens
MSSDNDSYHSDEFLTNSKS

SEQ ID NO: 37136 - protein, 36 aa, Homo sapiens
KANTSQPGVLQGGAVYLCPWGASPTQCTPIEFDSKG

SEQ ID NO: 37137 - protein, 19 aa, Homo sapiens
KGNLTYGYVTILNGSDIRS

SEQ ID NO: 37138 - protein, 12 aa, Homo sapiens
KIYLRNESEFRD

SEQ ID NO: 37139 - protein, 12 aa, Homo sapiens
KLSPIHIALNFS

SEQ ID NO: 37140 - protein, 25 aa, Homo sapiens
KNALNLTFHAQNVGEGGAYEAELRV

SEQ ID NO: 37141 - protein, 15 aa, Homo sapiens
KNLNNSQSDVVSFRL

SEQ ID NO: 37142 - protein, 24 aa, Homo sapiens
RTEKEPLSDPVGTCYLSTDNFTRI

SEQ ID NO: 37143 - protein, 17 aa, Homo sapiens
RVTGLNCTTNHPINPKG

SEQ ID NO: 37144 - protein, 16 aa, Homo sapiens
DKLPQPVQPDPVSHCK

SEQ ID NO: 37145 - protein, 9 aa, Homo sapiens
GICECGVCK

SEQ ID NO: 37146 - protein, 32 aa, Homo sapiens
IRPLGFTEEVEVILQYICECECQSEGIPESPK

SEQ ID NO: 37147 - protein, 16 aa, Homo sapiens
KDTCTQECSYFNITKV

SEQ ID NO: 37148 - protein, 13 aa, Homo sapiens
KNGVNGTGENGRK

SEQ ID NO: 37149 - protein, 36 aa, Homo sapiens
KSAVGTLSANSSNVIQLIIDAYNSLSSEVILENGKL

SEQ ID NO: 37150 - protein, 32 aa, Homo sapiens
KSCGECIQAGPNCGWCTNSTFLQEGMPTSARC

SEQ ID NO: 37151 - protein, 17 aa, Homo sapiens
LKPEDITQIQPQQLVLR

SEQ ID NO: 37152 - protein, 17 aa, Homo sapiens
LLVFSTDAGFHFAGDGK

SEQ ID NO: 37153 - protein, 14 aa, Homo sapiens
LPQPVQPDPVSHCK

SEQ ID NO: 37154 - protein, 21 aa, Homo sapiens
LSENNIQTIFAVTEEFQPVYK

SEQ ID NO: 37155 - protein, 24 aa, Homo sapiens
RKENSSEICSNNGECVCGQCVCRK

SEQ ID NO: 37156 - protein, 18 aa, Homo sapiens
RNPCTSEQNCTSPFSYKN

SEQ ID NO: 37157 - protein, 13 aa, Homo sapiens
SNGLICGGNGVCK

SEQ ID NO: 37158 - protein, 33 aa, Homo sapiens
VCECNPNYTGSACDCSLDTSTCEASNGQICNGR

SEQ ID NO: 37159 - protein, 16 aa, Homo sapiens
MHAVVFGNVTAIIQRM

SEQ ID NO: 37160 - protein, 16 aa, Homo sapiens
MSNYSSSSLLSGAGKD

SEQ ID NO: 37161 - protein, 17 aa, Homo sapiens
AFEWYGTYLELCGVLHK

SEQ ID NO: 37162 - protein, 18 aa, Homo sapiens
IEGEVNEILFCQLHPEQK

SEQ ID NO: 37163 - protein, 25 aa, Homo sapiens
TVQHQDCSPLSGDYVIEDVQGDDKR

SEQ ID NO: 37164 - protein, 32 aa, Homo sapiens
RDVMWENYSNFISLGPSISKPDVITLLDEERK

SEQ ID NO: 37165 - protein, 27 aa, Homo sapiens
CLQKGSLTIQQVNDLLDSIASNNSAKR

SEQ ID NO: 37166 - protein, 16 aa, Homo sapiens
DLFGDKEFLPQSAFLK

SEQ ID NO: 37167 - protein, 11 aa, Homo sapiens
FQAFDWGSSAK

SEQ ID NO: 37168 - protein, 25 aa, Homo sapiens
VDVYTTHSPAGTSVQNMLHWSQAVK

SEQ ID NO: 37169 - protein, 17 aa, Homo sapiens
MSDHLCSMNETLSKQRE

SEQ ID NO: 37170 - protein, 27 aa, Homo sapiens
AYHDLCDGSANQLQQLQSQLAHQTEQK

SEQ ID NO: 37171 - protein, 27 aa, Homo sapiens
EQQLQSTLQQAQGFHSEIEDFLLELTR

SEQ ID NO: 37172 - protein, 30 aa, Homo sapiens
FQDALEPLLSWLADTEELIANQKPPSAEYK

SEQ ID NO: 37173 - protein, 34 aa, Homo sapiens
GLNDATTAAEEAEALQWVVGTEVEIINQQLADFK

SEQ ID NO: 37174 - protein, 19 aa, Homo sapiens
ILGADLIFACGETEKPEVR

SEQ ID NO: 37175 - protein, 22 aa, Homo sapiens
KEEEELAYDWSDNNSNISAKRN

SEQ ID NO: 37176 - protein, 10 aa, Homo sapiens
LEGIGQFHCR

SEQ ID NO: 37177 - protein, 22 aa, Homo sapiens
LSQEEVVLADLSALEAHWSTLR

SEQ ID NO: 37178 - protein, 19 aa, Homo sapiens
RKSIDEMNNAWENLNKTWK

SEQ ID NO: 37179 - protein, 28 aa, Homo sapiens
SLLEILNSAADILINSSEADEDGIRDEK

SEQ ID NO: 37180 - protein, 16 aa, Homo sapiens
YQWHVEDLVPWIEDCK

SEQ ID NO: 37181 - protein, 10 aa, Homo sapiens
QLAGGMVSLK

SEQ ID NO: 37182 - protein, 17 aa, Homo sapiens
LFQSVPIGQSVNLVLCR

SEQ ID NO: 37183 - protein, 14 aa, Homo sapiens
PQPLQLQGHENSYR

SEQ ID NO: 37184 - protein, 13 aa, Homo sapiens
SPGSVSTHHSSPR

SEQ ID NO: 37185 - protein, 23 aa, Homo sapiens
KTDEKLNVSDENTASCPLSPIKM

SEQ ID NO: 37186 - protein, 16 aa, Homo sapiens
AHFDYDPSDDPYVPCR

SEQ ID NO: 37187 - protein, 25 aa, Homo sapiens
HIQHTLVDSQSQEDISLLLQLVQNK

SEQ ID NO: 37188 - protein, 10 aa, Homo sapiens
RAEVDEEHRK

SEQ ID NO: 37189 - protein, 15 aa, Homo sapiens
RCSVGTYNSSGAYRF

SEQ ID NO: 37190 - protein, 29 aa, Homo sapiens
MFKMAKNWSAAGNAFCQAAKLHMQLQSKH

SEQ ID NO: 37191 - protein, 31 aa, Homo sapiens
KSMINTTGAVDSGSSSSSSSSSFVNGATSKN

SEQ ID NO: 37192 - protein, 8 aa, Homo sapiens
LFLSDMIK

SEQ ID NO: 37193 - protein, 13 aa, Homo sapiens
MFVNSNGYNLGVR

SEQ ID NO: 37194 - protein, 27 aa, Homo sapiens
RCYVNGQLVSYGDMAWHVNTNDSYDKC

SEQ ID NO: 37195 - protein, 17 aa, Homo sapiens
RYLLQNTALEVFMANRT

SEQ ID NO: 37196 - protein, 10 aa, Homo sapiens
MLSQDAPTVK

SEQ ID NO: 37197 - protein, 14 aa, Homo sapiens
NYCDPQGHPSTGLK

SEQ ID NO: 37198 - protein, 20 aa, Homo sapiens
NFSVTNLSQTDEIPVLTLKD

SEQ ID NO: 37199 - protein, 25 aa, Homo sapiens
FEVLNYTSIPIFLPEVTIGAHQTDR

SEQ ID NO: 37200 - protein, 32 aa, Homo sapiens
HFPEAGIHYPDSTTGDGKPLATDYNGNCSLEK

SEQ ID NO: 37201 - protein, 22 aa, Homo sapiens
LLQYSDALEHLLTTGQGVVLER

SEQ ID NO: 37202 - protein, 19 aa, Homo sapiens
SIFSDFVFLEAMYNQGFIR

SEQ ID NO: 37203 - protein, 12 aa, Homo sapiens
VITVDGNICTGK

SEQ ID NO: 37204 - protein, 15 aa, Homo sapiens
AAAHHYGAQCDKPNK

SEQ ID NO: 37205 - protein, 22 aa, Homo sapiens
HCAEPFTEYWTCIDYTGQQLFR

SEQ ID NO: 37206 - protein, 21 aa, Homo sapiens
PRPDPSPEIEGDLQPATHGSR

SEQ ID NO: 37207 - protein, 13 aa, Homo sapiens
TDRPLPENPYHSR

SEQ ID NO: 37208 - protein, 12 aa, Homo sapiens
AVQGCGAHPAIR

SEQ ID NO: 37209 - protein, 14 aa, Homo sapiens
IQALLLTVLATLVK

SEQ ID NO: 37210 - protein, 18 aa, Homo sapiens
RYMLMLSFNNSLDVAAHL

SEQ ID NO: 37211 - protein, 12 aa, Homo sapiens
ESYNVQLQLPAR

SEQ ID NO: 37212 - protein, 22 aa, Homo sapiens
FTPTHAFLATWEQVGAYEEVKR

SEQ ID NO: 37213 - protein, 10 aa, Homo sapiens
GNLYWTDWNR

SEQ ID NO: 37214 - protein, 12 aa, Homo sapiens
HAQAQYAYPGAR

SEQ ID NO: 37215 - protein, 17 aa, Homo sapiens
ITQTAEGLDPENYLSIK

SEQ ID NO: 37216 - protein, 24 aa, Homo sapiens
KTNIQGQVPYVPANFTAHISPYKE

SEQ ID NO: 37217 - protein, 11 aa, Homo sapiens
LANPLHFYEAR

SEQ ID NO: 37218 - protein, 18 aa, Homo sapiens
LYTQGQQIGYLPLNGTRL

SEQ ID NO: 37219 - protein, 46 aa, Homo sapiens
NLYQLSNLGIPGVWAFHIGSTSPLDNVRPAAVGDLSAAHSSVPLGR

SEQ ID NO: 37220 - protein, 18 aa, Homo sapiens
RDYSLTFGAINQTWSYRI

SEQ ID NO: 37221 - protein, 13 aa, Homo sapiens
RIHQNITYQVCRH

SEQ ID NO: 37222 - protein, 30 aa, Homo sapiens
RNATHFPPVCPQNIHTAVPEVMLPVWFTAN

SEQ ID NO: 37223 - protein, 27 aa, Homo sapiens
SLRENSISPEGAQAIAHALCANSTLKN

SEQ ID NO: 37224 - protein, 11 aa, Homo sapiens
MFNISPGAVQF

SEQ ID NO: 37225 - protein, 26 aa, Homo sapiens
HSSSTVFDLVEEYENICGSQVNILSK

SEQ ID NO: 37226 - protein, 14 aa, Homo sapiens
VLEENQEHYHIVQK

SEQ ID NO: 37227 - protein, 36 aa, Homo sapiens
KLHIVDLSNNSLTQILPGTLINLTNLTHLYLHNNKF

SEQ ID NO: 37228 - protein, 28 aa, Homo sapiens
MTLSITSGMPNNFSEMPQQSTTLNLWRE

SEQ ID NO: 37229 - protein, 13 aa, Homo sapiens
RSLEVLNLSSNKL

SEQ ID NO: 37230 - protein, 15 aa, Homo sapiens
RSLWNMSAANNNIKL

SEQ ID NO: 37231 - protein, 12 aa, Homo sapiens
ACGNFGIPCELR

SEQ ID NO: 37232 - protein, 18 aa, Homo sapiens
AEYEGDGIPTVFVAVAGR

SEQ ID NO: 37233 - protein, 11 aa, Homo sapiens
ASILNTWISLK

SEQ ID NO: 37234 - protein, 21 aa, Homo sapiens
CGETAFIAPQCEMIPIEWVCR

SEQ ID NO: 37235 - protein, 18 aa, Homo sapiens
DDANNDPQWSEEQLIAAK

SEQ ID NO: 37236 - protein, 20 aa, Homo sapiens
IKAEYEGDGIPTVFVAVAGR

SEQ ID NO: 37237 - protein, 15 aa, Homo sapiens
ITSCIFQLLQEAGIK

SEQ ID NO: 37238 - protein, 34 aa, Homo sapiens
LPSGLGCSTVLSPEGSAQFAAQIFGLSNHLVWSK

SEQ ID NO: 37239 - protein, 36 aa, Homo sapiens
SNGLGPVMSGNTAYPVISCPPLTPDWGVQDVWSSLR

SEQ ID NO: 37240 - protein, 25 aa, Homo sapiens
TAYPVISCPPLTPDWGVQDVWSSLR

SEQ ID NO: 37241 - protein, 24 aa, Homo sapiens
VELFFKDDANNDPQWSEEQLIAAK

SEQ ID NO: 37242 - protein, 16 aa, Homo sapiens
VVVLMGSTSDLGHCEK

SEQ ID NO: 37243 - protein, 24 aa, Homo sapiens
RITTPHNPAQGQPHLNGMSNITKT

SEQ ID NO: 37244 - protein, 26 aa, Homo sapiens
RYHLMPIITPAYPQQNSTYNVSTSTR

SEQ ID NO: 37245 - protein, 20 aa, Homo sapiens
DFPEYTFAIADEEDYAGEVK

SEQ ID NO: 37246 - protein, 12 aa, Homo sapiens
DGDDVIIIGVFK

SEQ ID NO: 37247 - protein, 21 aa, Homo sapiens
DLGLSESGEDVNAAILDESGK

SEQ ID NO: 37248 - protein, 22 aa, Homo sapiens
DLGLSESGEDVNAAILDESGKK

SEQ ID NO: 37249 - protein, 19 aa, Homo sapiens
EVSQPDWTPPPEVTLVLTK

SEQ ID NO: 37250 - protein, 11 aa, Homo sapiens
FHHTFSTEIAK

SEQ ID NO: 37251 - protein, 18 aa, Homo sapiens
GESDPAYQQYQDAANNLR

SEQ ID NO: 37252 - protein, 10 aa, Homo sapiens
GRPYDYNGPR

SEQ ID NO: 37253 - protein, 12 aa, Homo sapiens
GRPYDYNGPREK

SEQ ID NO: 37254 - protein, 12 aa, Homo sapiens
IDATSASVLASR

SEQ ID NO: 37255 - protein, 12 aa, Homo sapiens
MDATANDVPSDR

SEQ ID NO: 37256 - protein, 12 aa, Homo sapiens
NNKGPVKVVVGK

SEQ ID NO: 37257 - protein, 8 aa, Homo sapiens
RAATQFWR

SEQ ID NO: 37258 - protein, 9 aa, Homo sapiens
RSPPIPLAK

SEQ ID NO: 37259 - protein, 16 aa, Homo sapiens
SHMMDVQGSTQDSAIK

SEQ ID NO: 37260 - protein, 8 aa, Homo sapiens
TQEEIVAK

SEQ ID NO: 37261 - protein, 11 aa, Homo sapiens
VDATAETDLAK

SEQ ID NO: 37262 - protein, 15 aa, Homo sapiens
VEGFPTIYFAPSGDK

SEQ ID NO: 37263 - protein, 16 aa, Homo sapiens
YGIVDYMIEQSGPPSK

SEQ ID NO: 37264 - protein, 27 aa, Homo sapiens
DAEEDDSLANSSDLLKELLETGDNRER

SEQ ID NO: 37265 - protein, 18 aa, Homo sapiens
GLKRSPQLEDEAKELQKR

SEQ ID NO: 37266 - protein, 29 aa, Homo sapiens
MKKDAEEDDSLANSSDLLKELLETGDNRE

SEQ ID NO: 37267 - protein, 12 aa, Homo sapiens
ETLAQLQQEFQR

SEQ ID NO: 37268 - protein, 26 aa, Homo sapiens
LEAQLTENNIVKEELALLDGSNVVFK

SEQ ID NO: 37269 - protein, 10 aa, Homo sapiens
RLDYITAEIK

SEQ ID NO: 37270 - protein, 10 aa, Homo sapiens
SLCVSTPGHR

SEQ ID NO: 37271 - protein, 16 aa, Homo sapiens
YAEQLPVAQIIHQKPK

SEQ ID NO: 37272 - protein, 24 aa, Homo sapiens
DPDIGDLLDQLVEEITGSLSGPAK

SEQ ID NO: 37273 - protein, 36 aa, Homo sapiens
TNIYLDEEGHQKDPDIGDLLDQLVEEITGSLSGPAK

SEQ ID NO: 37274 - protein, 20 aa, Homo sapiens
VVATAPGCGVIECIPDCTSR

SEQ ID NO: 37275 - protein, 8 aa, Homo sapiens
FQTSLVLR

SEQ ID NO: 37276 - protein, 10 aa, Homo sapiens
TVENCVCTLR

SEQ ID NO: 37277 - protein, 19 aa, Homo sapiens
MKNVSHNPLLLLTPQKVKR

SEQ ID NO: 37278 - protein, 12 aa, Homo sapiens
AYFHLLNQIAPK

SEQ ID NO: 37279 - protein, 19 aa, Homo sapiens
EGICALGGTSELSSEGTQH

SEQ ID NO: 37280 - protein, 26 aa, Homo sapiens
EGICALGGTSELSSEGTQHSYSEEEK

SEQ ID NO: 37281 - protein, 28 aa, Homo sapiens
FSLVGIGGQDLNDGNQTLTLALVWQLMR

SEQ ID NO: 37282 - protein, 16 aa, Homo sapiens
IDINMSGFNETDDLKR

SEQ ID NO: 37283 - protein, 29 aa, Homo sapiens
IIQENLNLALNSASAIGCHVVNIGAEDLR

SEQ ID NO: 37284 - protein, 14 aa, Homo sapiens
ISFDEFVYIFQEVK

SEQ ID NO: 37285 - protein, 12 aa, Homo sapiens
LNLAFVANLFNK

SEQ ID NO: 37286 - protein, 19 aa, Homo sapiens
VDLNSNGFICDYELHELFK

SEQ ID NO: 37287 - protein, 20 aa, Homo sapiens
VNHLYADLQDALVILQLYER

SEQ ID NO: 37288 - protein, 13 aa, Homo sapiens
WANFHLENSGWQK

SEQ ID NO: 37289 - protein, 22 aa, Homo sapiens
YPALTKPENQDIDWTLLEGETR

SEQ ID NO: 37290 - protein, 31 aa, Homo sapiens
PEISSSQHPVKTGLSDAFMILNPSPDVPESR

SEQ ID NO: 37291 - protein, 12 aa, Homo sapiens
VVEDNHSYYVSR

SEQ ID NO: 37292 - protein, 20 aa, Homo sapiens
AIGTFLFGAAASQSLTDIAK

SEQ ID NO: 37293 - protein, 10 aa, Homo sapiens
GVFCNDESIK

SEQ ID NO: 37294 - protein, 9 aa, Homo sapiens
NNYIATIYK

SEQ ID NO: 37295 - protein, 19 aa, Homo sapiens
NHEFIATFFGQPTFCSVCK

SEQ ID NO: 37296 - protein, 10 aa, Homo sapiens
VANLCGINQK

SEQ ID NO: 37297 - protein, 22 aa, Homo sapiens
VHNYMSPTFCDHCGSLLWGLVK

SEQ ID NO: 37298 - protein, 11 aa, Homo sapiens
FATHGAALTVK

SEQ ID NO: 37299 - protein, 23 aa, Homo sapiens
NLSPVVSNELLEQAFSQFGPVEK

SEQ ID NO: 37300 - protein, 20 aa, Homo sapiens
AWVWNTHADFADECPKPELL

SEQ ID NO: 37301 - protein, 23 aa, Homo sapiens
AWVWNTHADFADECPKPELLAIR

SEQ ID NO: 37302 - protein, 34 aa, Homo sapiens
DTHEDHDTSTENTDESNHDPQFEPIVSLPEQEIK

SEQ ID NO: 37303 - protein, 18 aa, Homo sapiens
THADFADECPKPELLAIR

SEQ ID NO: 37304 - protein, 21 aa, Homo sapiens
VWNTHADFADECPKPELLAIR

SEQ ID NO: 37305 - protein, 24 aa, Homo sapiens
ALAPLLLAFVTKPNSALESCSFAR

SEQ ID NO: 37306 - protein, 9 aa, Homo sapiens
HSLLQTLYK

SEQ ID NO: 37307 - protein, 11 aa, Homo sapiens
ILAAALTECHR

SEQ ID NO: 37308 - protein, 32 aa, Homo sapiens
ILDPNTGEPAPVLSSPPPADVSTFLAFPSPEK

SEQ ID NO: 37309 - protein, 19 aa, Homo sapiens
MQKAFNSSSFNSNTFLTRL

SEQ ID NO: 37310 - protein, 13 aa, Homo sapiens
QVEVINFGDCLVR

SEQ ID NO: 37311 - protein, 34 aa, Homo sapiens
VIGTLEEVHMPQNGINHPGITALAQAFAVNPLLR

SEQ ID NO: 37312 - protein, 12 aa, Homo sapiens
GSPPGFNNTERT

SEQ ID NO: 37313 - protein, 13 aa, Homo sapiens
RQNQSKYTQNGRP

SEQ ID NO: 37314 - protein, 11 aa, Homo sapiens
EFDLSDPLALK

SEQ ID NO: 37315 - protein, 13 aa, Homo sapiens
KDLPARQSDNDVR

SEQ ID NO: 37316 - protein, 12 aa, Homo sapiens
LVCTDIADVSVK

SEQ ID NO: 37317 - protein, 19 aa, Homo sapiens
NFNNWMKSVLIGEFLEKVR

SEQ ID NO: 37318 - protein, 16 aa, Homo sapiens
GLDVDSLVIEHIQVNK

SEQ ID NO: 37319 - protein, 18 aa, Homo sapiens
INPYMSSPCHIEMILTEK

SEQ ID NO: 37320 - protein, 10 aa, Homo sapiens
SAEFLLHMLK

SEQ ID NO: 37321 - protein, 11 aa, Homo sapiens
AAAAAAALQAK

SEQ ID NO: 37322 - protein, 16 aa, Homo sapiens
APIRPDIVNFVHTNLR

SEQ ID NO: 37323 - protein, 19 aa, Homo sapiens
AVSELAGHQTSAESWGTGR

SEQ ID NO: 37324 - protein, 10 aa, Homo sapiens
FCIWTESAFR

SEQ ID NO: 37325 - protein, 14 aa, Homo sapiens
GPCIIYNEDNGIIK

SEQ ID NO: 37326 - protein, 14 aa, Homo sapiens
IEEVPELPLVVEDK

SEQ ID NO: 37327 - protein, 19 aa, Homo sapiens
IEEVPELPLVVEDKVEGYK

SEQ ID NO: 37328 - protein, 14 aa, Homo sapiens
IRPDIVNFVHTNLR

SEQ ID NO: 37329 - protein, 10 aa, Homo sapiens
KLDELYGTWR

SEQ ID NO: 37330 - protein, 9 aa, Homo sapiens
LAPGGHVGR

SEQ ID NO: 37331 - protein, 12 aa, Homo sapiens
NIPGITLLNVSK

SEQ ID NO: 37332 - protein, 10 aa, Homo sapiens
PELPLVVEDK

SEQ ID NO: 37333 - protein, 22 aa, Homo sapiens
QPYAVSELAGHQTSAESWGTGR

SEQ ID NO: 37334 - protein, 15 aa, Homo sapiens
RGPCIIYNEDNGIIK

SEQ ID NO: 37335 - protein, 9 aa, Homo sapiens
SNYNLPMHK

SEQ ID NO: 37336 - protein, 19 aa, Homo sapiens
YAICSALAASALPALVMSK

SEQ ID NO: 37337 - protein, 27 aa, Homo sapiens
DELILEGNDIELVSNSAALIQQATTVK

SEQ ID NO: 37338 - protein, 14 aa, Homo sapiens
DFNHINVELSLLGK

SEQ ID NO: 37339 - protein, 10 aa, Homo sapiens
FLDGIYVSEK

SEQ ID NO: 37340 - protein, 21 aa, Homo sapiens
KTILSNQTVDIPENVDITLKG

SEQ ID NO: 37341 - protein, 14 aa, Homo sapiens
MRPGVACSVSQAQK

SEQ ID NO: 37342 - protein, 12 aa, Homo sapiens
PGVACSVSQAQK

SEQ ID NO: 37343 - protein, 22 aa, Homo sapiens
SVYAHFPINVVIQENGSLVEIR

SEQ ID NO: 37344 - protein, 11 aa, Homo sapiens
TICSHVQNMIK

SEQ ID NO: 37345 - protein, 19 aa, Homo sapiens
TILSNQTVDIPENVDITLK

SEQ ID NO: 37346 - protein, 15 aa, Homo sapiens
IIDVVYNASNNELVR

SEQ ID NO: 37347 - protein, 13 aa, Homo sapiens
ISSLLEEQFQQGK

SEQ ID NO: 37348 - protein, 15 aa, Homo sapiens
LDVGNFSWGSECCTR

SEQ ID NO: 37349 - protein, 8 aa, Homo sapiens
LLACIASR

SEQ ID NO: 37350 - protein, 12 aa, Homo sapiens
NCIVLIDSTPYR

SEQ ID NO: 37351 - protein, 17 aa, Homo sapiens
RIIDVVYNASNNELVRT

SEQ ID NO: 37352 - protein, 26 aa, Homo sapiens
AEIIPGVLFIDEVHMLDIESFSFLNR

SEQ ID NO: 37353 - protein, 16 aa, Homo sapiens
ALESDMAPVLIMATNR

SEQ ID NO: 37354 - protein, 17 aa, Homo sapiens
EVVHTVSLHEIDVINSR

SEQ ID NO: 37355 - protein, 11 aa, Homo sapiens
FVQCPDGELQK

SEQ ID NO: 37356 - protein, 17 aa, Homo sapiens
GTSYQSPHGIPIDLLDR

SEQ ID NO: 37357 - protein, 8 aa, Homo sapiens
IGAHSHIR

SEQ ID NO: 37358 - protein, 22 aa, Homo sapiens
PGVLFIDEVHMLDIESFSFLNR

SEQ ID NO: 37359 - protein, 10 aa, Homo sapiens
SEDAYTVLTR

SEQ ID NO: 37360 - protein, 16 aa, Homo sapiens
TQGFLALFSGDTGEIK

SEQ ID NO: 37361 - protein, 34 aa, Homo sapiens
LGQHVPTLHPTSEELTIAGMTFTTFDLGGHEQAR

SEQ ID NO: 37362 - protein, 20 aa, Homo sapiens
NYLPAINGIVFLVDCADHSR

SEQ ID NO: 37363 - protein, 17 aa, Homo sapiens
PAINGIVFLVDCADHSR

SEQ ID NO: 37364 - protein, 23 aa, Homo sapiens
VELNALMTDETISNVPILILGNK

SEQ ID NO: 37365 - protein, 24 aa, Homo sapiens
RRLRIHNLGLNCSSQLADLYKSCE

SEQ ID NO: 37366 - protein, 19 aa, Homo sapiens
AAAQLLQSQAQQSGAQQTK

SEQ ID NO: 37367 - protein, 24 aa, Homo sapiens
DDSYKPIVEYIDAQFEAYLQEELK

SEQ ID NO: 37368 - protein, 19 aa, Homo sapiens
QYPWGVVQVENENHCDFVK

SEQ ID NO: 37369 - protein, 20 aa, Homo sapiens
STSQGFCFNILCVGETGIGK

SEQ ID NO: 37370 - protein, 7 aa, Homo sapiens
EKLIAEK

SEQ ID NO: 37371 - protein, 11 aa, Homo sapiens
GGGREVITIYS

SEQ ID NO: 37372 - protein, 21 aa, Homo sapiens
SIPTGTILAIVTTSFIYLSCI

SEQ ID NO: 37373 - protein, 23 aa, Homo sapiens
VYGTCTLVLMALVVFVGVKYVNK

SEQ ID NO: 37374 - protein, 23 aa, Homo sapiens
KASLCLPTTSAPASAPSNGNCSS

SEQ ID NO: 37375 - protein, 17 aa, Homo sapiens
DVTELYLDGNQFTLVPK

SEQ ID NO: 37376 - protein, 17 aa, Homo sapiens
GLTEIPTNLPETITEIR

SEQ ID NO: 37377 - protein, 20 aa, Homo sapiens
IDLSNNQISELAPDAFQGLR

SEQ ID NO: 37378 - protein, 7 aa, Homo sapiens
IVTGNPR

SEQ ID NO: 37379 - protein, 35 aa, Homo sapiens
KESYLQIPSAKVRPQTNITLQIATDEDSGILLYKG

SEQ ID NO: 37380 - protein, 13 aa, Homo sapiens
LDLSENQIQAIPR

SEQ ID NO: 37381 - protein, 9 aa, Homo sapiens
LVSVNFINK

SEQ ID NO: 37382 - protein, 11 aa, Homo sapiens
SLNSLVLYGNK

SEQ ID NO: 37383 - protein, 10 aa, Homo sapiens
GSGSGFKPFK

SEQ ID NO: 37384 - protein, 17 aa, Homo sapiens
KEWHGPPSQGPSYHDTR

SEQ ID NO: 37385 - protein, 26 aa, Homo sapiens
RLKVMCEDALCSNLSVENAAEILILA

SEQ ID NO: 37386 - protein, 30 aa, Homo sapiens
FGGQLLSFDIGDQPVFEIPLSNVSQCTTGK

SEQ ID NO: 37387 - protein, 24 aa, Homo sapiens
FYVPPTQEDGVDPVEAFAQNVLSK

SEQ ID NO: 37388 - protein, 13 aa, Homo sapiens
GFIYVHKPPVHIR

SEQ ID NO: 37389 - protein, 21 aa, Homo sapiens
ITVPGNFQGHSGAQCITCSYK

SEQ ID NO: 37390 - protein, 11 aa, Homo sapiens
IYPTFLHLHGK

SEQ ID NO: 37391 - protein, 16 aa, Homo sapiens
MKMYSDAFLNDSYLKY

SEQ ID NO: 37392 - protein, 20 aa, Homo sapiens
AAHVFFTDSCPDALFNELVK

SEQ ID NO: 37393 - protein, 17 aa, Homo sapiens
MNTGEKTTMRDLSQMLK

SEQ ID NO: 37394 - protein, 12 aa, Homo sapiens
LPTEEEWEFAAR

SEQ ID NO: 37395 - protein, 15 aa, Homo sapiens
MGNTPDSASDNLGFR

SEQ ID NO: 37396 - protein, 18 aa, Homo sapiens
DLEGENIEIVFAKPPDQK

SEQ ID NO: 37397 - protein, 13 aa, Homo sapiens
DLFEDELVPLFEK

SEQ ID NO: 37398 - protein, 12 aa, Homo sapiens
HIGVCISVANNR

SEQ ID NO: 37399 - protein, 18 aa, Homo sapiens
LDEIYVAGLVAHSDLDER

SEQ ID NO: 37400 - protein, 8 aa, Homo sapiens
LYNNHEIR

SEQ ID NO: 37401 - protein, 24 aa, Homo sapiens
VWGNVGTVEWADPIEDPDPEVMAK

SEQ ID NO: 37402 - protein, 25 aa, Homo sapiens
YGGPPPDSVYSGQQPSVGTEIFVGK

SEQ ID NO: 37403 - protein, 23 aa, Homo sapiens
KNLTAVKSGGTSDSFVKGYLLPD

SEQ ID NO: 37404 - protein, 18 aa, Homo sapiens
MSKNSEFINLSFLLDHEK

SEQ ID NO: 37405 - protein, 16 aa, Homo sapiens
NLTAVKSGGTSDSFVK

SEQ ID NO: 37406 - protein, 15 aa, Homo sapiens
QDAEKSDTSPVAGKK

SEQ ID NO: 37407 - protein, 24 aa, Homo sapiens
RRNTSGTPSIAVSGTSLSSDQSRS

SEQ ID NO: 37408 - protein, 21 aa, Homo sapiens
KCEVLCSQSNKPVTLTVEQSR

SEQ ID NO: 37409 - protein, 20 aa, Homo sapiens
SSCTLPEGTNSSPQEIDPTK

SEQ ID NO: 37410 - protein, 18 aa, Homo sapiens
VNNSLSFFDLSELGMGKS

SEQ ID NO: 37411 - protein, 20 aa, Homo sapiens
KEPSGFINLTSFSLHVLSKI

SEQ ID NO: 37412 - protein, 20 aa, Homo sapiens
AGNEKEEGETADTVGCCSLR

SEQ ID NO: 37413 - protein, 10 aa, Homo sapiens
AVAILCNHQR

SEQ ID NO: 37414 - protein, 7 aa, Homo sapiens
ITVAWCK

SEQ ID NO: 37415 - protein, 17 aa, Homo sapiens
KEMTNEEKNIITNLSKC

SEQ ID NO: 37416 - protein, 24 aa, Homo sapiens
VEHINLHPELDGQEYVVEFDFLGK

SEQ ID NO: 37417 - protein, 10 aa, Homo sapiens
AQVACDHCLK

SEQ ID NO: 37418 - protein, 17 aa, Homo sapiens
ASAPSPNAQVACDHCLK

SEQ ID NO: 37419 - protein, 20 aa, Homo sapiens
EFFCPEHSECICHICLVEHK

SEQ ID NO: 37420 - protein, 14 aa, Homo sapiens
FTYCSQVLGLHCYK

SEQ ID NO: 37421 - protein, 10 aa, Homo sapiens
GIHQSTIDLK

SEQ ID NO: 37422 - protein, 17 aa, Homo sapiens
GISTKPVYIPEVELNHK

SEQ ID NO: 37423 - protein, 17 aa, Homo sapiens
KSEIQTLKEEIEQSLTK

SEQ ID NO: 37424 - protein, 13 aa, Homo sapiens
KVEQLQQEYTEMK

SEQ ID NO: 37425 - protein, 28 aa, Homo sapiens
MASFCQEHLQPHFDSPAFQDHPLQPPVR

SEQ ID NO: 37426 - protein, 18 aa, Homo sapiens
NTVLCNVVEQFLQADLAR

SEQ ID NO: 37427 - protein, 16 aa, Homo sapiens
SEIQTLKEEIEQSLTK

SEQ ID NO: 37428 - protein, 11 aa, Homo sapiens
SRPELLEYYIK

SEQ ID NO: 37429 - protein, 33 aa, Homo sapiens
TCLVCMASFCQEHLQPHFDSPAFQDHPLQPPVR

SEQ ID NO: 37430 - protein, 19 aa, Homo sapiens
TCSPASLSQASADLEATLR

SEQ ID NO: 37431 - protein, 19 aa, Homo sapiens
FSAACGPPVTPECEHCGQR

SEQ ID NO: 37432 - protein, 14 aa, Homo sapiens
GDQCCYSHSPPTPR

SEQ ID NO: 37433 - protein, 24 aa, Homo sapiens
TAAVGEICEEGLHVLEGLAASGLR

SEQ ID NO: 37434 - protein, 17 aa, Homo sapiens
MSATFIGNSTAIQELFK

SEQ ID NO: 37435 - protein, 20 aa, Homo sapiens
ALAPTWEQLALGLEHSETVK

SEQ ID NO: 37436 - protein, 23 aa, Homo sapiens
QGLYELSASNFELHVAQGDHFIK

SEQ ID NO: 37437 - protein, 16 aa, Homo sapiens
VDCTAHSDVCSAQGVR

SEQ ID NO: 37438 - protein, 16 aa, Homo sapiens
VDCTQHYELCSGNQVR

SEQ ID NO: 37439 - protein, 13 aa, Homo sapiens
IFVEFTSVFDCQK

SEQ ID NO: 37440 - protein, 21 aa, Homo sapiens
LGGLTQAPGNPVLAVQINQDK

SEQ ID NO: 37441 - protein, 33 aa, Homo sapiens
RPHDYQPLPGMSENPSVYVPGVVSTVVPDSAHK

SEQ ID NO: 37442 - protein, 18 aa, Homo sapiens
SIEIPRPVDGVEVPGCGK

SEQ ID NO: 37443 - protein, 9 aa, Homo sapiens
YCDPDSYHR

SEQ ID NO: 37444 - protein, 15 aa, Homo sapiens
LELFLPEEYPMAAPK

SEQ ID NO: 37445 - protein, 10 aa, Homo sapiens
LLAEPVPGIK

SEQ ID NO: 37446 - protein, 11 aa, Homo sapiens
TNEAQAIETAR

SEQ ID NO: 37447 - protein, 20 aa, Homo sapiens
YFHVVIAGPQDSPFEGGTFK

SEQ ID NO: 37448 - protein, 35 aa, Homo sapiens
RTLPLILILLALLSPGAADFNISSLSGLLSPALTE

SEQ ID NO: 37449 - protein, 19 aa, Homo sapiens
LQEINILWQELLEEQCLLK

SEQ ID NO: 37450 - protein, 34 aa, Homo sapiens
QFHCDLNDLTQWITEAEELLVDTCAPGGSLDLEK

SEQ ID NO: 37451 - protein, 22 aa, Homo sapiens
RIPRADELNQTGQILVEQMGKE

SEQ ID NO: 37452 - protein, 17 aa, Homo sapiens
IAAEHCIPLLTSLLEER

SEQ ID NO: 37453 - protein, 26 aa, Homo sapiens
IDVTAEEEQYQDLLLIMELLTNLLSK

SEQ ID NO: 37454 - protein, 27 aa, Homo sapiens
MSQSMGGDNLSSLDTNEAEIEPENMRE

SEQ ID NO: 37455 - protein, 18 aa, Homo sapiens
RNSSSFNVHIQIHTGIKP

SEQ ID NO: 37456 - protein, 20 aa, Homo sapiens
DPTLTDELLNILTELTQLSK

SEQ ID NO: 37457 - protein, 12 aa, Homo sapiens
NSVSNFLHSLER

SEQ ID NO: 37458 - protein, 22 aa, Homo sapiens
TLRDPSLPLLELQDIMTSVSGR

SEQ ID NO: 37459 - protein, 19 aa, Homo sapiens
VSALNSVHCEHVEDEGESR

SEQ ID NO: 37460 - protein, 12 aa, Homo sapiens
AKPVNSKPDSAY

SEQ ID NO: 37461 - protein, 13 aa, Homo sapiens
AKPVNSKPDSAYR

SEQ ID NO: 37462 - protein, 16 aa, Homo sapiens
GIIVHTMAAVEALGAK

SEQ ID NO: 37463 - protein, 17 aa, Homo sapiens
HIITVDGKPPTWSEFPK

SEQ ID NO: 37464 - protein, 15 aa, Homo sapiens
IGYSSPQTLADQSSK

SEQ ID NO: 37465 - protein, 18 aa, Homo sapiens
IPELGEEDVYIGYLPLAH

SEQ ID NO: 37466 - protein, 34 aa, Homo sapiens
IPELGEEDVYIGYLPLAHVLELSAELVCLSHGCR

SEQ ID NO: 37467 - protein, 15 aa, Homo sapiens
LLLCGGAPLSATTQR

SEQ ID NO: 37468 - protein, 18 aa, Homo sapiens
LSPEPWTPETGLVTDAFK

SEQ ID NO: 37469 - protein, 16 aa, Homo sapiens
NWEEGGYFNTDKPHPR

SEQ ID NO: 37470 - protein, 22 aa, Homo sapiens
SKPLPSDIAVIMYTSGSTGLPK

SEQ ID NO: 37471 - protein, 21 aa, Homo sapiens
SVNSLDGLASVLYPGCDTLDK

SEQ ID NO: 37472 - protein, 11 aa, Homo sapiens
VGAPLVCCEIK

SEQ ID NO: 37473 - protein, 16 aa, Homo sapiens
VLELSAELVCLSHGCR

SEQ ID NO: 37474 - protein, 17 aa, Homo sapiens
WLCTGDIGEFEPDGCLK

SEQ ID NO: 37475 - protein, 24 aa, Homo sapiens
MQAAVAVSVPFLLLCVLGTCPPAR

SEQ ID NO: 37476 - protein, 7 aa, Homo sapiens
QSIVPLR

SEQ ID NO: 37477 - protein, 24 aa, Homo sapiens
RLFEFSLDDLPSEFQQVNITPSKF

SEQ ID NO: 37478 - protein, 17 aa, Homo sapiens
SGGEDESRHDALDTRVR

SEQ ID NO: 37479 - protein, 14 aa, Homo sapiens
GETVNDCHAEIISR

SEQ ID NO: 37480 - protein, 9 aa, Homo sapiens
HPFIVNHPK

SEQ ID NO: 37481 - protein, 18 aa, Homo sapiens
ICDYLFNVSDSSALNLAK

SEQ ID NO: 37482 - protein, 23 aa, Homo sapiens
VENGEGTIPVESSDIVPTWDGIR

SEQ ID NO: 37483 - protein, 23 aa, Homo sapiens
KLSPGNSGNYSSGASSASASGSS

SEQ ID NO: 37484 - protein, 19 aa, Homo sapiens
KYPESNRTPVKPSSVEEED

SEQ ID NO: 37485 - protein, 12 aa, Homo sapiens
FLPSYQAVEYMR

SEQ ID NO: 37486 - protein, 7 aa, Homo sapiens
QDIPIHK

SEQ ID NO: 37487 - protein, 11 aa, Homo sapiens
RGEDPTIACQK

SEQ ID NO: 37488 - protein, 14 aa, Homo sapiens
TGHIAAGTSTNGIK

SEQ ID NO: 37489 - protein, 31 aa, Homo sapiens
VGDSPIPGAGAYADDTAGAAAATGNGDILMR

SEQ ID NO: 37490 - protein, 23 aa, Homo sapiens
KRTINSSQEPAPGMKPNWPRSRY

SEQ ID NO: 37491 - protein, 12 aa, Homo sapiens
EGQLGHGDVLPR

SEQ ID NO: 37492 - protein, 34 aa, Homo sapiens
KSFCTGKSDSRSESPEPGYVVTSSGLLLPVLLPR

SEQ ID NO: 37493 - protein, 8 aa, Homo sapiens
DLLSSVSR

SEQ ID NO: 37494 - protein, 16 aa, Homo sapiens
GFGTDEQAIVDVVANR

SEQ ID NO: 37495 - protein, 23 aa, Homo sapiens
KAMKGFGTDEQAIVDVVANRSND

SEQ ID NO: 37496 - protein, 19 aa, Homo sapiens
RDENQSINHQMAQEDAQRL

SEQ ID NO: 37497 - protein, 27 aa, Homo sapiens
SELSGNMEELILALFMPPTYYDAWSLR

SEQ ID NO: 37498 - protein, 16 aa, Homo sapiens
TILQCALNRPAFFAER

SEQ ID NO: 37499 - protein, 9 aa, Homo sapiens
VLIEILCTR

SEQ ID NO: 37500 - protein, 17 aa, Homo sapiens
APEVSQHVYQAYETILK

SEQ ID NO: 37501 - protein, 32 aa, Homo sapiens
IDNADELLESFLEGFHDESTQVQLQLLTAIVK

SEQ ID NO: 37502 - protein, 11 aa, Homo sapiens
ITEYLCEPLRK

SEQ ID NO: 37503 - protein, 26 aa, Homo sapiens
KPTETQELVQQVLSLATQDSDNPDLR

SEQ ID NO: 37504 - protein, 22 aa, Homo sapiens
KYESVIATLCENLDSLDEPEAR

SEQ ID NO: 37505 - protein, 21 aa, Homo sapiens
LAPPLVTLLSAEPELQYVALR

SEQ ID NO: 37506 - protein, 19 aa, Homo sapiens
LHDINAQLVEDQGFLDTLK

SEQ ID NO: 37507 - protein, 14 aa, Homo sapiens
LSHANSAVVLSAVK

SEQ ID NO: 37508 - protein, 21 aa, Homo sapiens
YESVIATLCENLDSLDEPEAR

SEQ ID NO: 37509 - protein, 16 aa, Homo sapiens
CLVGEFVSDVLLVPEK

SEQ ID NO: 37510 - protein, 11 aa, Homo sapiens
DVKEMIFNAER

SEQ ID NO: 37511 - protein, 12 aa, Homo sapiens
HYQHVLAVDPEK

SEQ ID NO: 37512 - protein, 7 aa, Homo sapiens
IIGSVSK

SEQ ID NO: 37513 - protein, 11 aa, Homo sapiens
LNMHVNIQTGK

SEQ ID NO: 37514 - protein, 20 aa, Homo sapiens
LNMHVNIQTGKWEPDPTGTK

SEQ ID NO: 37515 - protein, 15 aa, Homo sapiens
MEVCENHQHWHTVVK

SEQ ID NO: 37516 - protein, 13 aa, Homo sapiens
NKVDENMVIDETL

SEQ ID NO: 37517 - protein, 12 aa, Homo sapiens
RRNQSLSLLYKV

SEQ ID NO: 37518 - protein, 8 aa, Homo sapiens
VEAMLNDR

SEQ ID NO: 37519 - protein, 8 aa, Homo sapiens
VSIDNWCR

SEQ ID NO: 37520 - protein, 33 aa, Homo sapiens
DLLPDLGEGFILACLEYYHYDPEQVINNILEER

SEQ ID NO: 37521 - protein, 26 aa, Homo sapiens
DYDALFPVAEDISLLQQASSVLDETR

SEQ ID NO: 37522 - protein, 28 aa, Homo sapiens
RMIEQYHNHSDHYCLNLDSGMVIDSYRM

SEQ ID NO: 37523 - protein, 19 aa, Homo sapiens
KSLEDLIFESLPENASHKL

SEQ ID NO: 37524 - protein, 25 aa, Homo sapiens
RQYKDLWNMSDDKPFLCTAPGCGQR

SEQ ID NO: 37525 - protein, 10 aa, Homo sapiens
ACVVHGSDLK

SEQ ID NO: 37526 - protein, 16 aa, Homo sapiens
ADIGVAMGIAGSDVSK

SEQ ID NO: 37527 - protein, 17 aa, Homo sapiens
DGPNALTPPPTTPEWIK

SEQ ID NO: 37528 - protein, 25 aa, Homo sapiens
EQPLDEELKDAFQNAYLELGGLGER

SEQ ID NO: 37529 - protein, 18 aa, Homo sapiens
GVGIISEGNETVEDIAAR

SEQ ID NO: 37530 - protein, 7 aa, Homo sapiens
IAGLCNR

SEQ ID NO: 37531 - protein, 8 aa, Homo sapiens
IISANGCK

SEQ ID NO: 37532 - protein, 17 aa, Homo sapiens
KADIGVAMGIAGSDVSK

SEQ ID NO: 37533 - protein, 9 aa, Homo sapiens
LIIVEGCQR

SEQ ID NO: 37534 - protein, 8 aa, Homo sapiens
LSLDELHR

SEQ ID NO: 37535 - protein, 28 aa, Homo sapiens
MTVAHMWFDNQIHEADTTENQSGVSFDK

SEQ ID NO: 37536 - protein, 15 aa, Homo sapiens
NIAFFSTNCVEGTAR

SEQ ID NO: 37537 - protein, 18 aa, Homo sapiens
NLEAVETLGSTSTICSDK

SEQ ID NO: 37538 - protein, 14 aa, Homo sapiens
NPNTSEPQHLLVMK

SEQ ID NO: 37539 - protein, 23 aa, Homo sapiens
PLDEELKDAFQNAYLELGGLGER

SEQ ID NO: 37540 - protein, 23 aa, Homo sapiens
QAADMILLDDNFASIVTGVEEGR

SEQ ID NO: 37541 - protein, 19 aa, Homo sapiens
QGAIVAVTGDGVNDSPALK

SEQ ID NO: 37542 - protein, 13 aa, Homo sapiens
SPDFTNENPLETR

SEQ ID NO: 37543 - protein, 13 aa, Homo sapiens
VIMVTGDHPITAK

SEQ ID NO: 37544 - protein, 9 aa, Homo sapiens
YHTEIVFAR

SEQ ID NO: 37545 - protein, 7 aa, Homo sapiens
YQLSIHK

SEQ ID NO: 37546 - protein, 32 aa, Homo sapiens
KKGDGLQLPAADGAAASNAADSANASLVNGKM

SEQ ID NO: 37547 - protein, 30 aa, Homo sapiens
KQNSSPPSSLNKNNSAIDSGINLTTDTSKS

SEQ ID NO: 37548 - protein, 25 aa, Homo sapiens
HAATTQYANGTVLSGQTTNIVTHRA

SEQ ID NO: 37549 - protein, 16 aa, Homo sapiens
VPLINELESAIHQLYK

SEQ ID NO: 37550 - protein, 49 aa, Homo sapiens
WYGIFSNKTLQELSIDGLLNRYILMAFQNSEYGDDSIKKAQNVINCFPK

SEQ ID NO: 37551 - protein, 7 aa, Homo sapiens
AAVYHHF

SEQ ID NO: 37552 - protein, 9 aa, Homo sapiens
AAVYHHFIS

SEQ ID NO: 37553 - protein, 13 aa, Homo sapiens
AAVYHHFISDGVR

SEQ ID NO: 37554 - protein, 14 aa, Homo sapiens
AAVYHHFISDGVRK

SEQ ID NO: 37555 - protein, 17 aa, Homo sapiens
AAVYHHFISDGVRKSLK

SEQ ID NO: 37556 - protein, 11 aa, Homo sapiens
ACEPGVDYVYK

SEQ ID NO: 37557 - protein, 13 aa, Homo sapiens
ACEPGVDYVYKTR

SEQ ID NO: 37558 - protein, 11 aa, Homo sapiens
ADIGCTPGSGK

SEQ ID NO: 37559 - protein, 35 aa, Homo sapiens
ADIGCTPGSGKDYAGVFSDAGLTFTSSSGQQTAQR

SEQ ID NO: 37560 - protein, 7 aa, Homo sapiens
AEDLVGK

SEQ ID NO: 37561 - protein, 28 aa, Homo sapiens
AEDLVGKSLYVSATVILHSGSDMVQAER

SEQ ID NO: 37562 - protein, 10 aa, Homo sapiens
AELQCPQPAA

SEQ ID NO: 37563 - protein, 13 aa, Homo sapiens
AFVIFGIQDGEQR

SEQ ID NO: 37564 - protein, 14 aa, Homo sapiens
AGDFLEANYMNLQR

SEQ ID NO: 37565 - protein, 30 aa, Homo sapiens
AGDFLEANYMNLQRSYTVAIAGYALAQMGR

SEQ ID NO: 37566 - protein, 38 aa, Homo sapiens
AGDFLEANYMNLQRSYTVAIAGYALAQMGRLKGPLLNK

SEQ ID NO: 37567 - protein, 16 aa, Homo sapiens
AGLTFTSSSGQQTAQR

SEQ ID NO: 37568 - protein, 22 aa, Homo sapiens
AGVFSDAGLTFTSSSGQQTAQR

SEQ ID NO: 37569 - protein, 18 aa, Homo sapiens
AHEAKIRYYTYLIMNKGR

SEQ ID NO: 37570 - protein, 20 aa, Homo sapiens
AHEAKIRYYTYLIMNKGRLL

SEQ ID NO: 37571 - protein, 21 aa, Homo sapiens
AHEAKIRYYTYLIMNKGRLLK

SEQ ID NO: 37572 - protein, 9 aa, Homo sapiens
AKDQLTCNK

SEQ ID NO: 37573 - protein, 13 aa, Homo sapiens
AKDQLTCNKFDLK

SEQ ID NO: 37574 - protein, 9 aa, Homo sapiens
ALLALLQLK

SEQ ID NO: 37575 - protein, 18 aa, Homo sapiens
APDHQELNLDVSLQLPSR

SEQ ID NO: 37576 - protein, 12 aa, Homo sapiens
APSTWLTAYVVK

SEQ ID NO: 37577 - protein, 33 aa, Homo sapiens
APSTWLTAYVVKVFSLAVNLIAIDSQVLCGAVK

SEQ ID NO: 37578 - protein, 13 aa, Homo sapiens
APVIHQEMIGGLR

SEQ ID NO: 37579 - protein, 14 aa, Homo sapiens
AQMTEDAVDAERLK

SEQ ID NO: 37580 - protein, 8 aa, Homo sapiens
ASHLGLAR

SEQ ID NO: 37581 - protein, 24 aa, Homo sapiens
ASHLGLARSNLDEDIIAEENIVSR

SEQ ID NO: 37582 - protein, 10 aa, Homo sapiens
ATFGTQVVEK

SEQ ID NO: 37583 - protein, 16 aa, Homo sapiens
ATNHMGNVTFTIPANR

SEQ ID NO: 37584 - protein, 16 aa, Homo sapiens
ATVILHSGSDMVQAER

SEQ ID NO: 37585 - protein, 19 aa, Homo sapiens
AVDKGVFVLNKKNKLTQSK

SEQ ID NO: 37586 - protein, 13 aa, Homo sapiens
AVHYLDETEQWEK

SEQ ID NO: 37587 - protein, 7 aa, Homo sapiens
AVLYNYR

SEQ ID NO: 37588 - protein, 13 aa, Homo sapiens
AVLYNYRQNQELK

SEQ ID NO: 37589 - protein, 15 aa, Homo sapiens
AVLYNYRQNQELKVR

SEQ ID NO: 37590 - protein, 31 aa, Homo sapiens
AVLYNYRQNQELKVRVELLHNPAFCSLATTK

SEQ ID NO: 37591 - protein, 17 aa, Homo sapiens
AVNLIAIDSQVLCGAVK

SEQ ID NO: 37592 - protein, 12 aa, Homo sapiens
AVYHHFISDGVR

SEQ ID NO: 37593 - protein, 11 aa, Homo sapiens
AYYENSPQQVF

SEQ ID NO: 37594 - protein, 15 aa, Homo sapiens
AYYENSPQQVFSTEF

SEQ ID NO: 37595 - protein, 18 aa, Homo sapiens
AYYENSPQQVFSTEFEVK

SEQ ID NO: 37596 - protein, 34 aa, Homo sapiens
AYYENSPQQVFSTEFEVKEYVLPSFEVIVEPTEK

SEQ ID NO: 37597 - protein, 10 aa, Homo sapiens
CAEENCFIQK

SEQ ID NO: 37598 - protein, 7 aa, Homo sapiens
CCEDGMR

SEQ ID NO: 37599 - protein, 14 aa, Homo sapiens
CEEQVNSLPGSITK

SEQ ID NO: 37600 - protein, 17 aa, Homo sapiens
DAGLTFTSSSGQQTAQR

SEQ ID NO: 37601 - protein, 18 aa, Homo sapiens
DAPDHQELNLDVSLQLPS

SEQ ID NO: 37602 - protein, 19 aa, Homo sapiens
DAPDHQELNLDVSLQLPSR

SEQ ID NO: 37603 - protein, 14 aa, Homo sapiens
DAPVIHQEMIGGLR

SEQ ID NO: 37604 - protein, 18 aa, Homo sapiens
DAQGDVPVTVTVHDFPGK

SEQ ID NO: 37605 - protein, 14 aa, Homo sapiens
DFDEYIMAIEQTIK

SEQ ID NO: 37606 - protein, 6 aa, Homo sapiens
DFDFVP

SEQ ID NO: 37607 - protein, 10 aa, Homo sapiens
DFDFVPPVVR

SEQ ID NO: 37608 - protein, 12 aa, Homo sapiens
DFLEANYMNLQR

SEQ ID NO: 37609 - protein, 16 aa, Homo sapiens
DICEEQVNSLPGSITK

SEQ ID NO: 37610 - protein, 16 aa, Homo sapiens
DLMVFVTNPDGSPAYR

SEQ ID NO: 37611 - protein, 14 aa, Homo sapiens
DLSDQVPDTESETR

SEQ ID NO: 37612 - protein, 16 aa, Homo sapiens
DMALTAFVLISLQEAK

SEQ ID NO: 37613 - protein, 7 aa, Homo sapiens
DQLTCNK

SEQ ID NO: 37614 - protein, 11 aa, Homo sapiens
DQLTCNKFDLK

SEQ ID NO: 37615 - protein, 10 aa, Homo sapiens
DSCVGSLVVK

SEQ ID NO: 37616 - protein, 12 aa, Homo sapiens
DSITTWEILAVS

SEQ ID NO: 37617 - protein, 16 aa, Homo sapiens
DSITTWEILAVSMSDK

SEQ ID NO: 37618 - protein, 17 aa, Homo sapiens
DSITTWEILAVSMSDKK

SEQ ID NO: 37619 - protein, 20 aa, Homo sapiens
DTWVEHWPEEDECQDEENQK

SEQ ID NO: 37620 - protein, 14 aa, Homo sapiens
DVPVTVTVHDFPGK

SEQ ID NO: 37621 - protein, 11 aa, Homo sapiens
DYAGVFSDAGL

SEQ ID NO: 37622 - protein, 13 aa, Homo sapiens
DYAGVFSDAGLTF

SEQ ID NO: 37623 - protein, 14 aa, Homo sapiens
DYAGVFSDAGLTFT

SEQ ID NO: 37624 - protein, 20 aa, Homo sapiens
DYAGVFSDAGLTFTSSSGQQ

SEQ ID NO: 37625 - protein, 22 aa, Homo sapiens
DYAGVFSDAGLTFTSSSGQQTA

SEQ ID NO: 37626 - protein, 24 aa, Homo sapiens
DYAGVFSDAGLTFTSSSGQQTAQR

SEQ ID NO: 37627 - protein, 21 aa, Homo sapiens
EAHDAQGDVPVTVTVHDFPGK

SEQ ID NO: 37628 - protein, 8 aa, Homo sapiens
EALKLEEK

SEQ ID NO: 37629 - protein, 9 aa, Homo sapiens
EALKLEEKK

SEQ ID NO: 37630 - protein, 33 aa, Homo sapiens
EALKLEEKKHYLMWGLSSDFWGEKPNLSYIIGK

SEQ ID NO: 37631 - protein, 12 aa, Homo sapiens
EDIIAEENIVSR

SEQ ID NO: 37632 - protein, 10 aa, Homo sapiens
EDIPPADLSD

SEQ ID NO: 37633 - protein, 20 aa, Homo sapiens
EDIPPADLSDQVPDTESETR

SEQ ID NO: 37634 - protein, 15 aa, Homo sapiens
EDTVQSLTQGDGVAK

SEQ ID NO: 37635 - protein, 25 aa, Homo sapiens
EGVQKEDIPPADLSDQVPDTESETR

SEQ ID NO: 37636 - protein, 12 aa, Homo sapiens
ENEGFTVTAEGK

SEQ ID NO: 37637 - protein, 22 aa, Homo sapiens
EPGQDLVVLPLSITTDFIPSFR

SEQ ID NO: 37638 - protein, 36 aa, Homo sapiens
EPGQDLVVLPLSITTDFIPSFRLVAYYTLIGASGQR

SEQ ID NO: 37639 - protein, 7 aa, Homo sapiens
EVTITAR

SEQ ID NO: 37640 - protein, 12 aa, Homo sapiens
EVVADSVWVDVK

SEQ ID NO: 37641 - protein, 22 aa, Homo sapiens
EVVADSVWVDVKDSCVGSLVVK

SEQ ID NO: 37642 - protein, 11 aa, Homo sapiens
EYIMAIEQTIK

SEQ ID NO: 37643 - protein, 16 aa, Homo sapiens
EYVLPSFEVIVEPTEK

SEQ ID NO: 37644 - protein, 24 aa, Homo sapiens
EYVLPSFEVIVEPTEKFYYIYNEK

SEQ ID NO: 37645 - protein, 9 aa, Homo sapiens
FGIQDGEQR

SEQ ID NO: 37646 - protein, 8 aa, Homo sapiens
FGTQVVEK

SEQ ID NO: 37647 - protein, 9 aa, Homo sapiens
FISLGEACK

SEQ ID NO: 37648 - protein, 10 aa, Homo sapiens
FISLGEACKK

SEQ ID NO: 37649 - protein, 23 aa, Homo sapiens
FKPGMPFDLMVFVTNPDGSPAYR

SEQ ID NO: 37650 - protein, 6 aa, Homo sapiens
FLTTAK

SEQ ID NO: 37651 - protein, 23 aa, Homo sapiens
FLYGKKVEGTAFVIFGIQDGEQR

SEQ ID NO: 37652 - protein, 12 aa, Homo sapiens
FNVELIQPGAVK

SEQ ID NO: 37653 - protein, 13 aa, Homo sapiens
FPESWLWNVEDLK

SEQ ID NO: 37654 - protein, 17 aa, Homo sapiens
FPESWLWNVEDLKEPPK

SEQ ID NO: 37655 - protein, 28 aa, Homo sapiens
FQALAQYQKDAPDHQELNLDVSLQLPSR

SEQ ID NO: 37656 - protein, 17 aa, Homo sapiens
FQEDAPVIHQEMIGGLR

SEQ ID NO: 37657 - protein, 19 aa, Homo sapiens
FSDAGLTFTSSSGQQTAQR

SEQ ID NO: 37658 - protein, 12 aa, Homo sapiens
FVTNPDGSPAYR

SEQ ID NO: 37659 - protein, 15 aa, Homo sapiens
FVTVQATFGTQVVEK

SEQ ID NO: 37660 - protein, 44 aa, Homo sapiens
FVTVQATFGTQVVEKVVLVSLQSGYLFIQTDKTIYTPGSTVLYR

SEQ ID NO: 37661 - protein, 6 aa, Homo sapiens
FYHPEK

SEQ ID NO: 37662 - protein, 10 aa, Homo sapiens
FYHPEKEDGK

SEQ ID NO: 37663 - protein, 13 aa, Homo sapiens
FYHPEKEDGKLNK

SEQ ID NO: 37664 - protein, 16 aa, Homo sapiens
FYHPEKEDGKLNKLCR

SEQ ID NO: 37665 - protein, 21 aa, Homo sapiens
FYHPEKEDGKLNKLCRDELCR

SEQ ID NO: 37666 - protein, 8 aa, Homo sapiens
FYYIYNEK

SEQ ID NO: 37667 - protein, 26 aa, Homo sapiens
GDQDATMSILDISMMTGFAPDTDDLK

SEQ ID NO: 37668 - protein, 15 aa, Homo sapiens
GDVPVTVTVHDFPGK

SEQ ID NO: 37669 - protein, 22 aa, Homo sapiens
GGGYGSTQATFMVFQALAQYQK

SEQ ID NO: 37670 - protein, 21 aa, Homo sapiens
GICVADPFEVTVMQDFFIDLR

SEQ ID NO: 37671 - protein, 9 aa, Homo sapiens
GLEVTITAR

SEQ ID NO: 37672 - protein, 19 aa, Homo sapiens
GLSSDFWGEKPNLSYIIGK

SEQ ID NO: 37673 - protein, 15 aa, Homo sapiens
GLTFTSSSGQQTAQR

SEQ ID NO: 37674 - protein, 20 aa, Homo sapiens
GMTPTVIAVHYLDETEQWEK

SEQ ID NO: 37675 - protein, 13 aa, Homo sapiens
GNSNNYLHLSVLR

SEQ ID NO: 37676 - protein, 11 aa, Homo sapiens
GNVTFTIPANR

SEQ ID NO: 37677 - protein, 6 aa, Homo sapiens
GPLLNK

SEQ ID NO: 37678 - protein, 12 aa, Homo sapiens
GPLLNKFLTTAK

SEQ ID NO: 37679 - protein, 20 aa, Homo sapiens
GQDLVVLPLSITTDFIPSFR

SEQ ID NO: 37680 - protein, 11 aa, Homo sapiens
GQGTLSVVTMY

SEQ ID NO: 37681 - protein, 12 aa, Homo sapiens
GQGTLSVVTMYH

SEQ ID NO: 37682 - protein, 14 aa, Homo sapiens
GQGTLSVVTMYHAK

SEQ ID NO: 37683 - protein, 19 aa, Homo sapiens
GSDEVQVGQQRTFISPIKC

SEQ ID NO: 37684 - protein, 9 aa, Homo sapiens
GSGEVVLSR

SEQ ID NO: 37685 - protein, 12 aa, Homo sapiens
GTLSVVTMYHAK

SEQ ID NO: 37686 - protein, 18 aa, Homo sapiens
GTPVAQMTEDAVDAERLK

SEQ ID NO: 37687 - protein, 19 aa, Homo sapiens
GVFQEDAPVIHQEMIGGLR

SEQ ID NO: 37688 - protein, 7 aa, Homo sapiens
GVFVLNK

SEQ ID NO: 37689 - protein, 8 aa, Homo sapiens
GVFVLNKK

SEQ ID NO: 37690 - protein, 19 aa, Homo sapiens
GVLPLSWDIPELVNMGQWK

SEQ ID NO: 37691 - protein, 9 aa, Homo sapiens
GYTQQLAFR

SEQ ID NO: 37692 - protein, 20 aa, Homo sapiens
GYTQQLAFRQPSSAFAAFVK

SEQ ID NO: 37693 - protein, 21 aa, Homo sapiens
GYTQQLAFRQPSSAFAAFVKR

SEQ ID NO: 37694 - protein, 19 aa, Homo sapiens
HDAQGDVPVTVTVHDFPGK

SEQ ID NO: 37695 - protein, 11 aa, Homo sapiens
HLIVTPSGCGE

SEQ ID NO: 37696 - protein, 17 aa, Homo sapiens
HLIVTPSGCGEQNMIGM

SEQ ID NO: 37697 - protein, 35 aa, Homo sapiens
HLIVTPSGCGEQNMIGMTPTVIAVHYLDETEQWEK

SEQ ID NO: 37698 - protein, 8 aa, Homo sapiens
HMGNVTFT

SEQ ID NO: 37699 - protein, 13 aa, Homo sapiens
HMGNVTFTIPANR

SEQ ID NO: 37700 - protein, 10 aa, Homo sapiens
HQQTVTIPPK

SEQ ID NO: 37701 - protein, 23 aa, Homo sapiens
HQQTVTIPPKSSLSVPYVIVPLK

SEQ ID NO: 37702 - protein, 32 aa, Homo sapiens
HQQTVTIPPKSSLSVPYVIVPLKTGLQEVEVK

SEQ ID NO: 37703 - protein, 15 aa, Homo sapiens
HQYFNVELIQPGAVK

SEQ ID NO: 37704 - protein, 10 aa, Homo sapiens
HSEDDCLAFK

SEQ ID NO: 37705 - protein, 9 aa, Homo sapiens
HWESASLLR

SEQ ID NO: 37706 - protein, 11 aa, Homo sapiens
HYLDETEQWEK

SEQ ID NO: 37707 - protein, 15 aa, Homo sapiens
HYLMWGLSSDFWGEK

SEQ ID NO: 37708 - protein, 17 aa, Homo sapiens
HYLMWGLSSDFWGEKPN

SEQ ID NO: 37709 - protein, 20 aa, Homo sapiens
HYLMWGLSSDFWGEKPNLSY

SEQ ID NO: 37710 - protein, 24 aa, Homo sapiens
HYLMWGLSSDFWGEKPNLSYIIGK

SEQ ID NO: 37711 - protein, 11 aa, Homo sapiens
IAGYALAQMGR

SEQ ID NO: 37712 - protein, 14 aa, Homo sapiens
IAVHYLDETEQWEK

SEQ ID NO: 37713 - protein, 12 aa, Homo sapiens
IEDGSGEVVLSR

SEQ ID NO: 37714 - protein, 8 aa, Homo sapiens
IEGDHGAR

SEQ ID NO: 37715 - protein, 24 aa, Homo sapiens
IEGDHGARVVLVAVDKGVFVLNKK

SEQ ID NO: 37716 - protein, 31 aa, Homo sapiens
IEGDHGARVVLVAVDKGVFVLNKKNKLTQSK

SEQ ID NO: 37717 - protein, 7 aa, Homo sapiens
IFTVNHK

SEQ ID NO: 37718 - protein, 13 aa, Homo sapiens
IFTVNHKLLPVGR

SEQ ID NO: 37719 - protein, 21 aa, Homo sapiens
IGMTPTVIAVHYLDETEQWEK

SEQ ID NO: 37720 - protein, 9 aa, Homo sapiens
IHWESASLL

SEQ ID NO: 37721 - protein, 10 aa, Homo sapiens
IHWESASLLR

SEQ ID NO: 37722 - protein, 10 aa, Homo sapiens
IIAEENIVSR

SEQ ID NO: 37723 - protein, 20 aa, Homo sapiens
ILLQGTPVAQMTEDAVDAER

SEQ ID NO: 37724 - protein, 22 aa, Homo sapiens
ILLQGTPVAQMTEDAVDAERLK

SEQ ID NO: 37725 - protein, 33 aa, Homo sapiens
ILRLESEETMVLEAHDAQGDVPVTVTVHDFPGK

SEQ ID NO: 37726 - protein, 34 aa, Homo sapiens
ILRLESEETMVLEAHDAQGDVPVTVTVHDFPGKK

SEQ ID NO: 37727 - protein, 15 aa, Homo sapiens
INTHPSQKPLSITVR

SEQ ID NO: 37728 - protein, 14 aa, Homo sapiens
IPIEDGSGEVVLSR

SEQ ID NO: 37729 - protein, 15 aa, Homo sapiens
IPIEDGSGEVVLSRK

SEQ ID NO: 37730 - protein, 14 aa, Homo sapiens
IPIVTSPYQIHFTK

SEQ ID NO: 37731 - protein, 18 aa, Homo sapiens
IPPADLSDQVPDTESETR

SEQ ID NO: 37732 - protein, 20 aa, Homo sapiens
IRAYYENSPQQVFSTEFEVK

SEQ ID NO: 37733 - protein, 11 aa, Homo sapiens
IRYYTYLIMNK

SEQ ID NO: 37734 - protein, 13 aa, Homo sapiens
IRYYTYLIMNKGR

SEQ ID NO: 37735 - protein, 8 aa, Homo sapiens
ISLPESLK

SEQ ID NO: 37736 - protein, 9 aa, Homo sapiens
ISLPESLKR

SEQ ID NO: 37737 - protein, 23 aa, Homo sapiens
ISLPESLKRIPIEDGSGEVVLSR

SEQ ID NO: 37738 - protein, 14 aa, Homo sapiens
ITHRIHWESASLLR

SEQ ID NO: 37739 - protein, 7 aa, Homo sapiens
IWDVVEK

SEQ ID NO: 37740 - protein, 18 aa, Homo sapiens
IWDVVEKADIGCTPGSGK

SEQ ID NO: 37741 - protein, 13 aa, Homo sapiens
KCCEDGMRENPMR

SEQ ID NO: 37742 - protein, 10 aa, Homo sapiens
KGYTQQLAFR

SEQ ID NO: 37743 - protein, 19 aa, Homo sapiens
KGYTQQLAFRQPSSAFAAF

SEQ ID NO: 37744 - protein, 21 aa, Homo sapiens
KGYTQQLAFRQPSSAFAAFVK

SEQ ID NO: 37745 - protein, 22 aa, Homo sapiens
KGYTQQLAFRQPSSAFAAFVKR

SEQ ID NO: 37746 - protein, 19 aa, Homo sapiens
KHYLMWGLSSDFWGEKPNL

SEQ ID NO: 37747 - protein, 25 aa, Homo sapiens
KHYLMWGLSSDFWGEKPNLSYIIGK

SEQ ID NO: 37748 - protein, 26 aa, Homo sapiens
KHYLMWGLSSDFWGEKPNLSYIIGKD

SEQ ID NO: 37749 - protein, 27 aa, Homo sapiens
KKHYLMWGLSSDFWGEKPNLSYIIGKD

SEQ ID NO: 37750 - protein, 8 aa, Homo sapiens
KLVLSSEK

SEQ ID NO: 37751 - protein, 29 aa, Homo sapiens
KLVLSSEKTVLTPATNHMGNVTFTIPANR

SEQ ID NO: 37752 - protein, 12 aa, Homo sapiens
KQELSEAEQATR

SEQ ID NO: 37753 - protein, 10 aa, Homo sapiens
KTGLQEVEVK

SEQ ID NO: 37754 - protein, 22 aa, Homo sapiens
KTVLTPATNHMGNVTFTIPANR

SEQ ID NO: 37755 - protein, 23 aa, Homo sapiens
KTVLTPATNHMGNVTFTIPANRE

SEQ ID NO: 37756 - protein, 18 aa, Homo sapiens
KVEGTAFVIFGIQDGEQR

SEQ ID NO: 37757 - protein, 26 aa, Homo sapiens
KVEGTAFVIFGIQDGEQRISLPESLK

SEQ ID NO: 37758 - protein, 14 aa, Homo sapiens
KVFLDCCNYITELR

SEQ ID NO: 37759 - protein, 11 aa, Homo sapiens
KVLLDGVQNLR

SEQ ID NO: 37760 - protein, 18 aa, Homo sapiens
KVLLDGVQNLRAEDLVGK

SEQ ID NO: 37761 - protein, 12 aa, Homo sapiens
KVVPEGIRMNKT

SEQ ID NO: 37762 - protein, 8 aa, Homo sapiens
LCRDELCR

SEQ ID NO: 37763 - protein, 14 aa, Homo sapiens
LDKACEPGVDYVYK

SEQ ID NO: 37764 - protein, 16 aa, Homo sapiens
LDKACEPGVDYVYKTR

SEQ ID NO: 37765 - protein, 22 aa, Homo sapiens
LEAHDAQGDVPVTVTVHDFPGK

SEQ ID NO: 37766 - protein, 23 aa, Homo sapiens
LEAHDAQGDVPVTVTVHDFPGKK

SEQ ID NO: 37767 - protein, 12 aa, Homo sapiens
LESEETMVLEAH

SEQ ID NO: 37768 - protein, 25 aa, Homo sapiens
LESEETMVLEAHDAQGDVPVTVTVH

SEQ ID NO: 37769 - protein, 30 aa, Homo sapiens
LESEETMVLEAHDAQGDVPVTVTVHDFPGK

SEQ ID NO: 37770 - protein, 31 aa, Homo sapiens
LESEETMVLEAHDAQGDVPVTVTVHDFPGKK

SEQ ID NO: 37771 - protein, 28 aa, Homo sapiens
LGREGVQKEDIPPADLSDQVPDTESETR

SEQ ID NO: 37772 - protein, 20 aa, Homo sapiens
LGVLPLSWDIPELVNMGQWK

SEQ ID NO: 37773 - protein, 14 aa, Homo sapiens
LIAIDSQVLCGAVK

SEQ ID NO: 37774 - protein, 8 aa, Homo sapiens
LKGPLLNK

SEQ ID NO: 37775 - protein, 14 aa, Homo sapiens
LKGPLLNKFLTTAK

SEQ ID NO: 37776 - protein, 16 aa, Homo sapiens
LKGPLLNKFLTTAKDK

SEQ ID NO: 37777 - protein, 13 aa, Homo sapiens
LKHLIVTPSGCGE

SEQ ID NO: 37778 - protein, 6 aa, Homo sapiens
LLPVGR

SEQ ID NO: 37779 - protein, 7 aa, Homo sapiens
LMNIFLK

SEQ ID NO: 37780 - protein, 24 aa, Homo sapiens
LMNIFLKDSITTWEILAVSMSDKK

SEQ ID NO: 37781 - protein, 14 aa, Homo sapiens
LPLSITTDFIPSFR

SEQ ID NO: 37782 - protein, 17 aa, Homo sapiens
LPLSWDIPELVNMGQWK

SEQ ID NO: 37783 - protein, 13 aa, Homo sapiens
LPSFEVIVEPTEK

SEQ ID NO: 37784 - protein, 7 aa, Homo sapiens
LPYSVVR

SEQ ID NO: 37785 - protein, 14 aa, Homo sapiens
LPYSVVRNEQVEIR

SEQ ID NO: 37786 - protein, 20 aa, Homo sapiens
LQGTPVAQMTEDAVDAERLK

SEQ ID NO: 37787 - protein, 33 aa, Homo sapiens
LRLESEETMVLEAHDAQGDVPVTVTVHDFPGKK

SEQ ID NO: 37788 - protein, 14 aa, Homo sapiens
LRPGETLNVNFLLR

SEQ ID NO: 37789 - protein, 13 aa, Homo sapiens
LSDQVPDTESETR

SEQ ID NO: 37790 - protein, 9 aa, Homo sapiens
LSEAEQATR

SEQ ID NO: 37791 - protein, 10 aa, Homo sapiens
LSINTHPSQK

SEQ ID NO: 37792 - protein, 12 aa, Homo sapiens
LSINTHPSQKPL

SEQ ID NO: 37793 - protein, 17 aa, Homo sapiens
LSINTHPSQKPLSITVR

SEQ ID NO: 37794 - protein, 19 aa, Homo sapiens
LSINTHPSQKPLSITVRTK

SEQ ID NO: 37795 - protein, 31 aa, Homo sapiens
LSINTHPSQKPLSITVRTKKQELSEAEQATR

SEQ ID NO: 37796 - protein, 18 aa, Homo sapiens
LSSEKTVLTPATNHMGNV

SEQ ID NO: 37797 - protein, 19 aa, Homo sapiens
LTPATNHMGNVTFTIPANR

SEQ ID NO: 37798 - protein, 14 aa, Homo sapiens
LVAVDKGVFVLNKK

SEQ ID NO: 37799 - protein, 14 aa, Homo sapiens
LVAYYTLIGASGQR

SEQ ID NO: 37800 - protein, 7 aa, Homo sapiens
LVLSSEK

SEQ ID NO: 37801 - protein, 28 aa, Homo sapiens
LVLSSEKTVLTPATNHMGNVTFTIPANR

SEQ ID NO: 37802 - protein, 17 aa, Homo sapiens
LVVLPLSITTDFIPSFR

SEQ ID NO: 37803 - protein, 11 aa, Homo sapiens
LYNYRQNQELK

SEQ ID NO: 37804 - protein, 9 aa, Homo sapiens
MDKVGKYPK

SEQ ID NO: 37805 - protein, 12 aa, Homo sapiens
MDKVGKYPKELR

SEQ ID NO: 37806 - protein, 13 aa, Homo sapiens
MDKVGKYPKELRK

SEQ ID NO: 37807 - protein, 21 aa, Homo sapiens
MDRAHEAKIRYYTYLIMNKGR

SEQ ID NO: 37808 - protein, 22 aa, Homo sapiens
MIGMTPTVIAVHYLDETEQWEK

SEQ ID NO: 37809 - protein, 20 aa, Homo sapiens
MSILDISMMTGFAPDTDDLK

SEQ ID NO: 37810 - protein, 10 aa, Homo sapiens
MTEDAVDAER

SEQ ID NO: 37811 - protein, 12 aa, Homo sapiens
MTGFAPDTDDLK

SEQ ID NO: 37812 - protein, 11 aa, Homo sapiens
MVFQALAQYQK

SEQ ID NO: 37813 - protein, 14 aa, Homo sapiens
MVFVTNPDGSPAYR

SEQ ID NO: 37814 - protein, 24 aa, Homo sapiens
MVLEAHDAQGDVPVTVTVHDFPGK

SEQ ID NO: 37815 - protein, 7 aa, Homo sapiens
NEQVEIR

SEQ ID NO: 37816 - protein, 20 aa, Homo sapiens
NEQVEIRAVLYNYRQNQELK

SEQ ID NO: 37817 - protein, 14 aa, Homo sapiens
NHMGNVTFTIPANR

SEQ ID NO: 37818 - protein, 17 aa, Homo sapiens
NKFVTVQATFGTQVVEK

SEQ ID NO: 37819 - protein, 14 aa, Homo sapiens
NKLTQSKIWDVVEK

SEQ ID NO: 37820 - protein, 15 aa, Homo sapiens
NNNEKDMALTAFVLI

SEQ ID NO: 37821 - protein, 21 aa, Homo sapiens
NNNEKDMALTAFVLISLQEAK

SEQ ID NO: 37822 - protein, 37 aa, Homo sapiens
NNNEKDMALTAFVLISLQEAKDICEEQVNSLPGSITK

SEQ ID NO: 37823 - protein, 10 aa, Homo sapiens
NNYLHLSVLR

SEQ ID NO: 37824 - protein, 11 aa, Homo sapiens
NPAFCSLATTK

SEQ ID NO: 37825 - protein, 8 aa, Homo sapiens
NPEGIPVK

SEQ ID NO: 37826 - protein, 27 aa, Homo sapiens
NRWEDPGKQLYNVEATSYALLALLQLK

SEQ ID NO: 37827 - protein, 12 aa, Homo sapiens
NSNNYLHLSVLR

SEQ ID NO: 37828 - protein, 9 aa, Homo sapiens
NTLIIYLDK

SEQ ID NO: 37829 - protein, 21 aa, Homo sapiens
NTLIIYLDKVSHSEDDCLAFK

SEQ ID NO: 37830 - protein, 10 aa, Homo sapiens
NTMILEICTR

SEQ ID NO: 37831 - protein, 16 aa, Homo sapiens
NVEATSYALLALLQLK

SEQ ID NO: 37832 - protein, 11 aa, Homo sapiens
NVELIQPGAVK

SEQ ID NO: 37833 - protein, 16 aa, Homo sapiens
PADLSDQVPDTESETR

SEQ ID NO: 37834 - protein, 10 aa, Homo sapiens
PAFCSLATTK

SEQ ID NO: 37835 - protein, 13 aa, Homo sapiens
PAPETEKRPQDAK

SEQ ID NO: 37836 - protein, 17 aa, Homo sapiens
PATNHMGNVTFTIPANR

SEQ ID NO: 37837 - protein, 30 aa, Homo sapiens
PDGSPAYRVPVAVQGEDTVQSLTQGDGVAK

SEQ ID NO: 37838 - protein, 21 aa, Homo sapiens
PDGVFQEDAPVIHQEMIGGLR

SEQ ID NO: 37839 - protein, 8 aa, Homo sapiens
PDTESETR

SEQ ID NO: 37840 - protein, 13 aa, Homo sapiens
PEKEDGKLNKLCR

SEQ ID NO: 37841 - protein, 10 aa, Homo sapiens
PELVNMGQWK

SEQ ID NO: 37842 - protein, 20 aa, Homo sapiens
PESLKRIPIEDGSGEVVLSR

SEQ ID NO: 37843 - protein, 12 aa, Homo sapiens
PESWLWNVEDLK

SEQ ID NO: 37844 - protein, 16 aa, Homo sapiens
PESWLWNVEDLKEPPK

SEQ ID NO: 37845 - protein, 12 aa, Homo sapiens
PGETLNVNFLLR

SEQ ID NO: 37846 - protein, 21 aa, Homo sapiens
PGMPFDLMVFVTNPDGSPAYR

SEQ ID NO: 37847 - protein, 21 aa, Homo sapiens
PGQDLVVLPLSITTDFIPSFR

SEQ ID NO: 37848 - protein, 8 aa, Homo sapiens
PGQQMTLK

SEQ ID NO: 37849 - protein, 8 aa, Homo sapiens
PGSTVLYR

SEQ ID NO: 37850 - protein, 13 aa, Homo sapiens
PIEDGSGEVVLSR

SEQ ID NO: 37851 - protein, 13 aa, Homo sapiens
PIVTSPYQIHFTK

SEQ ID NO: 37852 - protein, 16 aa, Homo sapiens
PIVTSPYQIHFTKTPK

SEQ ID NO: 37853 - protein, 13 aa, Homo sapiens
PLSITTDFIPSFR

SEQ ID NO: 37854 - protein, 7 aa, Homo sapiens
PLSITVR

SEQ ID NO: 37855 - protein, 16 aa, Homo sapiens
PLSWDIPELVNMGQWK

SEQ ID NO: 37856 - protein, 12 aa, Homo sapiens
PMYSIITPNILR

SEQ ID NO: 37857 - protein, 9 aa, Homo sapiens
PNLSYIIGK

SEQ ID NO: 37858 - protein, 17 aa, Homo sapiens
PPADLSDQVPDTESETR

SEQ ID NO: 37859 - protein, 12 aa, Homo sapiens
PSFEVIVEPTEK

SEQ ID NO: 37860 - protein, 19 aa, Homo sapiens
PSGCGEQNMIGMTPTVIAV

SEQ ID NO: 37861 - protein, 11 aa, Homo sapiens
PSQKPLSITVR

SEQ ID NO: 37862 - protein, 17 aa, Homo sapiens
PTVIAVHYLDETEQWEK

SEQ ID NO: 37863 - protein, 14 aa, Homo sapiens
PVAQMTEDAVDAER

SEQ ID NO: 37864 - protein, 16 aa, Homo sapiens
PVAQMTEDAVDAERLK

SEQ ID NO: 37865 - protein, 12 aa, Homo sapiens
PVIHQEMIGGLR

SEQ ID NO: 37866 - protein, 12 aa, Homo sapiens
PVTVTVHDFPGK

SEQ ID NO: 37867 - protein, 13 aa, Homo sapiens
PVTVTVHDFPGKK

SEQ ID NO: 37868 - protein, 11 aa, Homo sapiens
PYQIHFTKTPK

SEQ ID NO: 37869 - protein, 18 aa, Homo sapiens
PYSTVGNSNNYLHLSVLR

SEQ ID NO: 37870 - protein, 8 aa, Homo sapiens
PYVIVPLK

SEQ ID NO: 37871 - protein, 17 aa, Homo sapiens
PYVIVPLKTGLQEVEVK

SEQ ID NO: 37872 - protein, 8 aa, Homo sapiens
QALAQYQK

SEQ ID NO: 37873 - protein, 19 aa, Homo sapiens
QCQDLGAFTESMVVFGCPN

SEQ ID NO: 37874 - protein, 10 aa, Homo sapiens
QDSLSSQNQL

SEQ ID NO: 37875 - protein, 12 aa, Homo sapiens
QDSLSSQNQLGV

SEQ ID NO: 37876 - protein, 15 aa, Homo sapiens
QDSLSSQNQLGVLPL

SEQ ID NO: 37877 - protein, 24 aa, Homo sapiens
QDSLSSQNQLGVLPLSWDIPELVN

SEQ ID NO: 37878 - protein, 29 aa, Homo sapiens
QDSLSSQNQLGVLPLSWDIPELVNMGQWK

SEQ ID NO: 37879 - protein, 11 aa, Homo sapiens
QELSEAEQATR

SEQ ID NO: 37880 - protein, 8 aa, Homo sapiens
QGALELIK

SEQ ID NO: 37881 - protein, 9 aa, Homo sapiens
QGALELIKK

SEQ ID NO: 37882 - protein, 17 aa, Homo sapiens
QKPDGVFQEDAPVIHQE

SEQ ID NO: 37883 - protein, 18 aa, Homo sapiens
QKPDGVFQEDAPVIHQEM

SEQ ID NO: 37884 - protein, 23 aa, Homo sapiens
QKPDGVFQEDAPVIHQEMIGGLR

SEQ ID NO: 37885 - protein, 8 aa, Homo sapiens
QLANGVDR

SEQ ID NO: 37886 - protein, 21 aa, Homo sapiens
QLGVLPLSWDIPELVNMGQWK

SEQ ID NO: 37887 - protein, 10 aa, Homo sapiens
QLYNVEATSY

SEQ ID NO: 37888 - protein, 12 aa, Homo sapiens
QLYNVEATSYAL

SEQ ID NO: 37889 - protein, 13 aa, Homo sapiens
QLYNVEATSYALL

SEQ ID NO: 37890 - protein, 15 aa, Homo sapiens
QLYNVEATSYALLAL

SEQ ID NO: 37891 - protein, 19 aa, Homo sapiens
QLYNVEATSYALLALLQLK

SEQ ID NO: 37892 - protein, 29 aa, Homo sapiens
QLYNVEATSYALLALLQLKDFDFVPPVVR

SEQ ID NO: 37893 - protein, 24 aa, Homo sapiens
QNMIGMTPTVIAVHYLDETEQWEK

SEQ ID NO: 37894 - protein, 11 aa, Homo sapiens
QPSSAFAAFVK

SEQ ID NO: 37895 - protein, 12 aa, Homo sapiens
QPSSAFAAFVKR

SEQ ID NO: 37896 - protein, 11 aa, Homo sapiens
QPVPGQQMTLK

SEQ ID NO: 37897 - protein, 11 aa, Homo sapiens
QSGYLFIQTDK

SEQ ID NO: 37898 - protein, 25 aa, Homo sapiens
QVREPGQDLVVLPLSITTDFIPSFR

SEQ ID NO: 37899 - protein, 13 aa, Homo sapiens
RAPSTWLTAYVVK

SEQ ID NO: 37900 - protein, 11 aa, Homo sapiens
RHQQTVTIPPK

SEQ ID NO: 37901 - protein, 15 aa, Homo sapiens
RIPIEDGSGEVVLSR

SEQ ID NO: 37902 - protein, 16 aa, Homo sapiens
RIPIEDGSGEVVLSRK

SEQ ID NO: 37903 - protein, 10 aa, Homo sapiens
RMDKVGKYPK

SEQ ID NO: 37904 - protein, 13 aa, Homo sapiens
RMDKVGKYPKELR

SEQ ID NO: 37905 - protein, 10 aa, Homo sapiens
RMNKTVAVRT

SEQ ID NO: 37906 - protein, 9 aa, Homo sapiens
RQGALELIK

SEQ ID NO: 37907 - protein, 10 aa, Homo sapiens
RQGALELIKK

SEQ ID NO: 37908 - protein, 31 aa, Homo sapiens
RQGALELIKKGYTQQLAFRQPSSAFAAFVKR

SEQ ID NO: 37909 - protein, 12 aa, Homo sapiens
RQPSSAFAAFVK

SEQ ID NO: 37910 - protein, 17 aa, Homo sapiens
SATVILHSGSDMVQAER

SEQ ID NO: 37911 - protein, 18 aa, Homo sapiens
SDAGLTFTSSSGQQTAQR

SEQ ID NO: 37912 - protein, 10 aa, Homo sapiens
SDDKVTLEER

SEQ ID NO: 37913 - protein, 13 aa, Homo sapiens
SDDKVTLEERLDK

SEQ ID NO: 37914 - protein, 24 aa, Homo sapiens
SDDKVTLEERLDKACEPGVDYVYK

SEQ ID NO: 37915 - protein, 10 aa, Homo sapiens
SDEVQVGQQR

SEQ ID NO: 37916 - protein, 9 aa, Homo sapiens
SEDDCLAFK

SEQ ID NO: 37917 - protein, 15 aa, Homo sapiens
SEDRQPVPGQQMTLK

SEQ ID NO: 37918 - protein, 17 aa, Homo sapiens
SEETKENEGFTVTAEGK

SEQ ID NO: 37919 - protein, 28 aa, Homo sapiens
SEETMVLEAHDAQGDVPVTVTVHDFPGK

SEQ ID NO: 37920 - protein, 15 aa, Homo sapiens
SEFPESWLWNVEDLK

SEQ ID NO: 37921 - protein, 19 aa, Homo sapiens
SEFPESWLWNVEDLKEPPK

SEQ ID NO: 37922 - protein, 25 aa, Homo sapiens
SEFPESWLWNVEDLKEPPKNGISTK

SEQ ID NO: 37923 - protein, 10 aa, Homo sapiens
SGIPIVTSPY

SEQ ID NO: 37924 - protein, 13 aa, Homo sapiens
SGIPIVTSPYQIH

SEQ ID NO: 37925 - protein, 14 aa, Homo sapiens
SGIPIVTSPYQIHF

SEQ ID NO: 37926 - protein, 16 aa, Homo sapiens
SGIPIVTSPYQIHFTK

SEQ ID NO: 37927 - protein, 19 aa, Homo sapiens
SGIPIVTSPYQIHFTKTPK

SEQ ID NO: 37928 - protein, 7 aa, Homo sapiens
SGQSEDR

SEQ ID NO: 37929 - protein, 18 aa, Homo sapiens
SGQSEDRQPVPGQQMTLK

SEQ ID NO: 37930 - protein, 26 aa, Homo sapiens
SGQSEDRQPVPGQQMTLKIEGDHGAR

SEQ ID NO: 37931 - protein, 12 aa, Homo sapiens
SGSDEVQVGQQR

SEQ ID NO: 37932 - protein, 10 aa, Homo sapiens
SGSDMVQAER

SEQ ID NO: 37933 - protein, 11 aa, Homo sapiens
SHSEDDCLAFK

SEQ ID NO: 37934 - protein, 16 aa, Homo sapiens
SINTHPSQKPLSITVR

SEQ ID NO: 37935 - protein, 11 aa, Homo sapiens
SITTDFIPSFR

SEQ ID NO: 37936 - protein, 16 aa, Homo sapiens
SKITHRIHWESASLLR

SEQ ID NO: 37937 - protein, 19 aa, Homo sapiens
SLAVNLIAIDSQVLCGAVK

SEQ ID NO: 37938 - protein, 10 aa, Homo sapiens
SLKVVPEGIR

SEQ ID NO: 37939 - protein, 18 aa, Homo sapiens
SLKVVPEGIRMNKTVAVR

SEQ ID NO: 37940 - protein, 11 aa, Homo sapiens
SLYVSATVILH

SEQ ID NO: 37941 - protein, 21 aa, Homo sapiens
SLYVSATVILHSGSDMVQAER

SEQ ID NO: 37942 - protein, 16 aa, Homo sapiens
SNDFDEYIMAIEQTIK

SEQ ID NO: 37943 - protein, 12 aa, Homo sapiens
SNLDEDIIAEEN

SEQ ID NO: 37944 - protein, 16 aa, Homo sapiens
SNLDEDIIAEENIVSR

SEQ ID NO: 37945 - protein, 17 aa, Homo sapiens
SNLDEDIIAEENIVSRS

SEQ ID NO: 37946 - protein, 11 aa, Homo sapiens
SNNYLHLSVLR

SEQ ID NO: 37947 - protein, 10 aa, Homo sapiens
SPMYSIITPN

SEQ ID NO: 37948 - protein, 13 aa, Homo sapiens
SPMYSIITPNILR

SEQ ID NO: 37949 - protein, 13 aa, Homo sapiens
SPQQVFSTEFEVK

SEQ ID NO: 37950 - protein, 9 aa, Homo sapiens
SPYQIHFTK

SEQ ID NO: 37951 - protein, 17 aa, Homo sapiens
SSDFWGEKPNLSYIIGK

SEQ ID NO: 37952 - protein, 17 aa, Homo sapiens
SSKITHRIHWESASLLR

SEQ ID NO: 37953 - protein, 13 aa, Homo sapiens
SSLSVPYVIVPLK

SEQ ID NO: 37954 - protein, 22 aa, Homo sapiens
SSLSVPYVIVPLKTGLQEVEVK

SEQ ID NO: 37955 - protein, 25 aa, Homo sapiens
SSQNQLGVLPLSWDIPELVNMGQWK

SEQ ID NO: 37956 - protein, 7 aa, Homo sapiens
STEFEVK

SEQ ID NO: 37957 - protein, 16 aa, Homo sapiens
STVGNSNNYLHLSVLR

SEQ ID NO: 37958 - protein, 19 aa, Homo sapiens
STVLYRIFTVNHKLLPVGR

SEQ ID NO: 37959 - protein, 19 aa, Homo sapiens
SVPYVIVPLKTGLQEVEVK

SEQ ID NO: 37960 - protein, 7 aa, Homo sapiens
SVQLTEK

SEQ ID NO: 37961 - protein, 8 aa, Homo sapiens
SVQLTEKR

SEQ ID NO: 37962 - protein, 11 aa, Homo sapiens
SVQLTEKRMDK

SEQ ID NO: 37963 - protein, 20 aa, Homo sapiens
SVQLTEKRMDKVGKYPKELR

SEQ ID NO: 37964 - protein, 21 aa, Homo sapiens
SVQLTEKRMDKVGKYPKELRK

SEQ ID NO: 37965 - protein, 14 aa, Homo sapiens
SWDIPELVNMGQWK

SEQ ID NO: 37966 - protein, 11 aa, Homo sapiens
SYALLALLQLK

SEQ ID NO: 37967 - protein, 11 aa, Homo sapiens
SYTVAIAGYAL

SEQ ID NO: 37968 - protein, 13 aa, Homo sapiens
SYTVAIAGYALAQ

SEQ ID NO: 37969 - protein, 16 aa, Homo sapiens
SYTVAIAGYALAQMGR

SEQ ID NO: 37970 - protein, 18 aa, Homo sapiens
SYTVAIAGYALAQMGRLK

SEQ ID NO: 37971 - protein, 30 aa, Homo sapiens
SYTVAIAGYALAQMGRLKGPLLNKFLTTAK

SEQ ID NO: 37972 - protein, 14 aa, Homo sapiens
TAFVIFGIQDGEQR

SEQ ID NO: 37973 - protein, 10 aa, Homo sapiens
TELRPGETLN

SEQ ID NO: 37974 - protein, 12 aa, Homo sapiens
TELRPGETLNVN

SEQ ID NO: 37975 - protein, 13 aa, Homo sapiens
TELRPGETLNVNF

SEQ ID NO: 37976 - protein, 14 aa, Homo sapiens
TELRPGETLNVNFL

SEQ ID NO: 37977 - protein, 15 aa, Homo sapiens
TELRPGETLNVNFLL

SEQ ID NO: 37978 - protein, 16 aa, Homo sapiens
TELRPGETLNVNFLLR

SEQ ID NO: 37979 - protein, 7 aa, Homo sapiens
TFISPIK

SEQ ID NO: 37980 - protein, 9 aa, Homo sapiens
TFISPIKCR

SEQ ID NO: 37981 - protein, 13 aa, Homo sapiens
TFTSSSGQQTAQR

SEQ ID NO: 37982 - protein, 11 aa, Homo sapiens
TGFAPDTDDLK

SEQ ID NO: 37983 - protein, 9 aa, Homo sapiens
TGLQEVEVK

SEQ ID NO: 37984 - protein, 13 aa, Homo sapiens
THPSQKPLSITVR

SEQ ID NO: 37985 - protein, 11 aa, Homo sapiens
TIYTPGSTVLY

SEQ ID NO: 37986 - protein, 12 aa, Homo sapiens
TIYTPGSTVLYR

SEQ ID NO: 37987 - protein, 25 aa, Homo sapiens
TIYTPGSTVLYRIFTVNHKLLPVGR

SEQ ID NO: 37988 - protein, 14 aa, Homo sapiens
TKKQELSEAEQATR

SEQ ID NO: 37989 - protein, 6 aa, Homo sapiens
TLDPER

SEQ ID NO: 37990 - protein, 34 aa, Homo sapiens
TLDPERLGREGVQKEDIPPADLSDQVPDTESETR

SEQ ID NO: 37991 - protein, 19 aa, Homo sapiens
TMQALPYSTVGNSNNYLHL

SEQ ID NO: 37992 - protein, 23 aa, Homo sapiens
TMQALPYSTVGNSNNYLHLSVLR

SEQ ID NO: 37993 - protein, 21 aa, Homo sapiens
TMSILDISMMTGFAPDTDDLK

SEQ ID NO: 37994 - protein, 25 aa, Homo sapiens
TMVLEAHDAQGDVPVTVTVHDFPGK

SEQ ID NO: 37995 - protein, 15 aa, Homo sapiens
TNHMGNVTFTIPANR

SEQ ID NO: 37996 - protein, 18 aa, Homo sapiens
TPATNHMGNVTFTIPANR

SEQ ID NO: 37997 - protein, 9 aa, Homo sapiens
TPGSTVLYR

SEQ ID NO: 37998 - protein, 22 aa, Homo sapiens
TPGSTVLYRIFTVNHKLLPVGR

SEQ ID NO: 37999 - protein, 27 aa, Homo sapiens
TPKYFKPGMPFDLMVFVTNPDGSPAYR

SEQ ID NO: 38000 - protein, 18 aa, Homo sapiens
TPTVIAVHYLDETEQWEK

SEQ ID NO: 38001 - protein, 15 aa, Homo sapiens
TPVAQMTEDAVDAER

SEQ ID NO: 38002 - protein, 17 aa, Homo sapiens
TPVAQMTEDAVDAERLK

SEQ ID NO: 38003 - protein, 9 aa, Homo sapiens
TRFISLGEA

SEQ ID NO: 38004 - protein, 11 aa, Homo sapiens
TRFISLGEACK

SEQ ID NO: 38005 - protein, 12 aa, Homo sapiens
TRFISLGEACKK

SEQ ID NO: 38006 - protein, 12 aa, Homo sapiens
TSYALLALLQLK

SEQ ID NO: 38007 - protein, 9 aa, Homo sapiens
TTDFIPSFR

SEQ ID NO: 38008 - protein, 15 aa, Homo sapiens
TVGNSNNYLHLSVLR

SEQ ID NO: 38009 - protein, 15 aa, Homo sapiens
TVILHSGSDMVQAER

SEQ ID NO: 38010 - protein, 15 aa, Homo sapiens
TVLTPATNHMGNVTF

SEQ ID NO: 38011 - protein, 20 aa, Homo sapiens
TVLTPATNHMGNVTFTIPAN

SEQ ID NO: 38012 - protein, 21 aa, Homo sapiens
TVLTPATNHMGNVTFTIPANR

SEQ ID NO: 38013 - protein, 23 aa, Homo sapiens
TVLTPATNHMGNVTFTIPANREF

SEQ ID NO: 38014 - protein, 24 aa, Homo sapiens
TVLTPATNHMGNVTFTIPANREFK

SEQ ID NO: 38015 - protein, 15 aa, Homo sapiens
TVMVNIENPEGIPVK

SEQ ID NO: 38016 - protein, 44 aa, Homo sapiens
TVMVNIENPEGIPVKQDSLSSQNQLGVLPLSWDIPELVNMGQWK

SEQ ID NO: 38017 - protein, 13 aa, Homo sapiens
TVQSLTQGDGVAK

SEQ ID NO: 38018 - protein, 18 aa, Homo sapiens
VADPFEVTVMQDFFIDLR

SEQ ID NO: 38019 - protein, 10 aa, Homo sapiens
VADSVWVDVK

SEQ ID NO: 38020 - protein, 20 aa, Homo sapiens
VAVQGEDTVQSLTQGDGVAK

SEQ ID NO: 38021 - protein, 14 aa, Homo sapiens
VDVKDSCVGSLVVK

SEQ ID NO: 38022 - protein, 17 aa, Homo sapiens
VEGTAFVIFGIQDGEQR

SEQ ID NO: 38023 - protein, 9 aa, Homo sapiens
VELLHNPAF

SEQ ID NO: 38024 - protein, 10 aa, Homo sapiens
VELLHNPAFC

SEQ ID NO: 38025 - protein, 13 aa, Homo sapiens
VELLHNPAFCSLA

SEQ ID NO: 38026 - protein, 16 aa, Homo sapiens
VELLHNPAFCSLATTK

SEQ ID NO: 38027 - protein, 17 aa, Homo sapiens
VELLHNPAFCSLATTKR

SEQ ID NO: 38028 - protein, 13 aa, Homo sapiens
VFLDCCNYITELR

SEQ ID NO: 38029 - protein, 10 aa, Homo sapiens
VFQALAQYQK

SEQ ID NO: 38030 - protein, 21 aa, Homo sapiens
VFSLAVNLIAIDSQVLCGAVK

SEQ ID NO: 38031 - protein, 13 aa, Homo sapiens
VFVTNPDGSPAYR

SEQ ID NO: 38032 - protein, 6 aa, Homo sapiens
VGKYPK

SEQ ID NO: 38033 - protein, 9 aa, Homo sapiens
VGKYPKELR

SEQ ID NO: 38034 - protein, 10 aa, Homo sapiens
VGKYPKELRK

SEQ ID NO: 38035 - protein, 14 aa, Homo sapiens
VGNSNNYLHLSVLR

SEQ ID NO: 38036 - protein, 12 aa, Homo sapiens
VHQYFNVELIQP

SEQ ID NO: 38037 - protein, 16 aa, Homo sapiens
VHQYFNVELIQPGAVK

SEQ ID NO: 38038 - protein, 15 aa, Homo sapiens
VIAVHYLDETEQWEK

SEQ ID NO: 38039 - protein, 11 aa, Homo sapiens
VIFGIQDGEQR

SEQ ID NO: 38040 - protein, 14 aa, Homo sapiens
VILHSGSDMVQAER

SEQ ID NO: 38041 - protein, 15 aa, Homo sapiens
VIVPLKTGLQEVEVK

SEQ ID NO: 38042 - protein, 23 aa, Homo sapiens
VLEAHDAQGDVPVTVTVHDFPGK

SEQ ID NO: 38043 - protein, 24 aa, Homo sapiens
VLEAHDAQGDVPVTVTVHDFPGKK

SEQ ID NO: 38044 - protein, 9 aa, Homo sapiens
VLISLQEAK

SEQ ID NO: 38045 - protein, 10 aa, Homo sapiens
VLLDGVQNLR

SEQ ID NO: 38046 - protein, 17 aa, Homo sapiens
VLLDGVQNLRAEDLVGK

SEQ ID NO: 38047 - protein, 15 aa, Homo sapiens
VLPLSITTDFIPSFR

SEQ ID NO: 38048 - protein, 14 aa, Homo sapiens
VLPSFEVIVEPTEK

SEQ ID NO: 38049 - protein, 15 aa, Homo sapiens
VLVAVDKGVFVLNKK

SEQ ID NO: 38050 - protein, 9 aa, Homo sapiens
VPGQQMTLK

SEQ ID NO: 38051 - protein, 9 aa, Homo sapiens
VPVAVQGED

SEQ ID NO: 38052 - protein, 12 aa, Homo sapiens
VPVAVQGEDTVQ

SEQ ID NO: 38053 - protein, 14 aa, Homo sapiens
VPVAVQGEDTVQSL

SEQ ID NO: 38054 - protein, 18 aa, Homo sapiens
VPVAVQGEDTVQSLTQGD

SEQ ID NO: 38055 - protein, 22 aa, Homo sapiens
VPVAVQGEDTVQSLTQGDGVAK

SEQ ID NO: 38056 - protein, 23 aa, Homo sapiens
VPVAVQGEDTVQSLTQGDGVAKL

SEQ ID NO: 38057 - protein, 32 aa, Homo sapiens
VPVAVQGEDTVQSLTQGDGVAKLSINTHPSQK

SEQ ID NO: 38058 - protein, 13 aa, Homo sapiens
VPVTVTVHDFPGK

SEQ ID NO: 38059 - protein, 19 aa, Homo sapiens
VQLSNDFDEYIMAIEQTIK

SEQ ID NO: 38060 - protein, 31 aa, Homo sapiens
VQLSNDFDEYIMAIEQTIKSGSDEVQVGQQR

SEQ ID NO: 38061 - protein, 18 aa, Homo sapiens
VRVELLHNPAFCSLATTK

SEQ ID NO: 38062 - protein, 19 aa, Homo sapiens
VRVELLHNPAFCSLATTKR

SEQ ID NO: 38063 - protein, 18 aa, Homo sapiens
VSATVILHSGSDMVQAER

SEQ ID NO: 38064 - protein, 12 aa, Homo sapiens
VSHSEDDCLAFK

SEQ ID NO: 38065 - protein, 14 aa, Homo sapiens
VSLQSGYLFIQTDK

SEQ ID NO: 38066 - protein, 9 aa, Homo sapiens
VTFTIPANR

SEQ ID NO: 38067 - protein, 11 aa, Homo sapiens
VTIKPAPETEK

SEQ ID NO: 38068 - protein, 17 aa, Homo sapiens
VTIKPAPETEKRPQDAK

SEQ ID NO: 38069 - protein, 27 aa, Homo sapiens
VTIKPAPETEKRPQDAKNTMILEICTR

SEQ ID NO: 38070 - protein, 6 aa, Homo sapiens
VTLEER

SEQ ID NO: 38071 - protein, 11 aa, Homo sapiens
VTNPDGSPAYR

SEQ ID NO: 38072 - protein, 11 aa, Homo sapiens
VTSPYQIHFTK

SEQ ID NO: 38073 - protein, 8 aa, Homo sapiens
VVLVAVDK

SEQ ID NO: 38074 - protein, 15 aa, Homo sapiens
VVLVAVDKGVFVLNK

SEQ ID NO: 38075 - protein, 16 aa, Homo sapiens
VVLVAVDKGVFVLNKK

SEQ ID NO: 38076 - protein, 17 aa, Homo sapiens
VVLVAVDKGVFVLNKKN

SEQ ID NO: 38077 - protein, 18 aa, Homo sapiens
VVLVAVDKGVFVLNKKNK

SEQ ID NO: 38078 - protein, 19 aa, Homo sapiens
VVLVAVDKGVFVLNKKNKL

SEQ ID NO: 38079 - protein, 22 aa, Homo sapiens
VVLVAVDKGVFVLNKKNKLTQS

SEQ ID NO: 38080 - protein, 23 aa, Homo sapiens
VVLVAVDKGVFVLNKKNKLTQSK

SEQ ID NO: 38081 - protein, 10 aa, Homo sapiens
VVLVSLQSGY

SEQ ID NO: 38082 - protein, 11 aa, Homo sapiens
VVLVSLQSGYL

SEQ ID NO: 38083 - protein, 12 aa, Homo sapiens
VVLVSLQSGYLF

SEQ ID NO: 38084 - protein, 17 aa, Homo sapiens
VVLVSLQSGYLFIQTDK

SEQ ID NO: 38085 - protein, 7 aa, Homo sapiens
VVPEGIR

SEQ ID NO: 38086 - protein, 10 aa, Homo sapiens
VVPEGIRMNK

SEQ ID NO: 38087 - protein, 6 aa, Homo sapiens
VYAYYN

SEQ ID NO: 38088 - protein, 10 aa, Homo sapiens
VYAYYNLEES

SEQ ID NO: 38089 - protein, 11 aa, Homo sapiens
VYAYYNLEESC

SEQ ID NO: 38090 - protein, 13 aa, Homo sapiens
VYAYYNLEESCTR

SEQ ID NO: 38091 - protein, 11 aa, Homo sapiens
VYHHFISDGVR

SEQ ID NO: 38092 - protein, 12 aa, Homo sapiens
VYHHFISDGVRK

SEQ ID NO: 38093 - protein, 6 aa, Homo sapiens
WEDPGK

SEQ ID NO: 38094 - protein, 35 aa, Homo sapiens
WEDPGKQLYNVEATSYALLALLQLKDFDFVPPVVR

SEQ ID NO: 38095 - protein, 13 aa, Homo sapiens
WGEKPNLSYIIGK

SEQ ID NO: 38096 - protein, 20 aa, Homo sapiens
WGLSSDFWGEKPNLSYIIGK

SEQ ID NO: 38097 - protein, 6 aa, Homo sapiens
WLILEK

SEQ ID NO: 38098 - protein, 6 aa, Homo sapiens
WLNEQR

SEQ ID NO: 38099 - protein, 23 aa, Homo sapiens
YAGVFSDAGLTFTSSSGQQTAQR

SEQ ID NO: 38100 - protein, 10 aa, Homo sapiens
YELDKAFSDR

SEQ ID NO: 38101 - protein, 8 aa, Homo sapiens
YFKPGMPF

SEQ ID NO: 38102 - protein, 11 aa, Homo sapiens
YFKPGMPFDLM

SEQ ID NO: 38103 - protein, 13 aa, Homo sapiens
YFKPGMPFDLMVF

SEQ ID NO: 38104 - protein, 22 aa, Homo sapiens
YFKPGMPFDLMVFVTNPDGSPA

SEQ ID NO: 38105 - protein, 24 aa, Homo sapiens
YFKPGMPFDLMVFVTNPDGSPAYR

SEQ ID NO: 38106 - protein, 10 aa, Homo sapiens
YHHFISDGVR

SEQ ID NO: 38107 - protein, 11 aa, Homo sapiens
YHHFISDGVRK

SEQ ID NO: 38108 - protein, 9 aa, Homo sapiens
YISKYELDK

SEQ ID NO: 38109 - protein, 14 aa, Homo sapiens
YISKYELDKAFSDR

SEQ ID NO: 38110 - protein, 10 aa, Homo sapiens
YLDETEQWEK

SEQ ID NO: 38111 - protein, 28 aa, Homo sapiens
YRGDQDATMSILDISMMTGFAPDTDDLK

SEQ ID NO: 38112 - protein, 10 aa, Homo sapiens
YSIITPNILR

SEQ ID NO: 38113 - protein, 10 aa, Homo sapiens
YTLIGASGQR

SEQ ID NO: 38114 - protein, 19 aa, Homo sapiens
YVSATVILHSGSDMVQAER

SEQ ID NO: 38115 - protein, 17 aa, Homo sapiens
YYENSPQQVFSTEFEVK

SEQ ID NO: 38116 - protein, 13 aa, Homo sapiens
YYGGGYGSTQATF

SEQ ID NO: 38117 - protein, 16 aa, Homo sapiens
YYGGGYGSTQATFMVF

SEQ ID NO: 38118 - protein, 24 aa, Homo sapiens
YYGGGYGSTQATFMVFQALAQYQK

SEQ ID NO: 38119 - protein, 9 aa, Homo sapiens
YYTYLIMNK

SEQ ID NO: 38120 - protein, 11 aa, Homo sapiens
YYTYLIMNKGR

SEQ ID NO: 38121 - protein, 29 aa, Homo sapiens
KMGNSTDPGPMLAIPAMATNPQNAASRRT

SEQ ID NO: 38122 - protein, 23 aa, Homo sapiens
RRRGRPRGNNLSTISDTSPMKRS

SEQ ID NO: 38123 - protein, 14 aa, Homo sapiens
KRSHNASIIDMGEE

SEQ ID NO: 38124 - protein, 30 aa, Homo sapiens
GKDEAMAIGGHWSPSLDGPDPEKDPSVLIK

SEQ ID NO: 38125 - protein, 23 aa, Homo sapiens
TVPAHVETVVLFFPDVWHCLPTR

SEQ ID NO: 38126 - protein, 25 aa, Homo sapiens
RETNAIHNITVLAMESQNPSQVGRG

SEQ ID NO: 38127 - protein, 14 aa, Homo sapiens
ADTEKWAEGGGHSR

SEQ ID NO: 38128 - protein, 13 aa, Homo sapiens
ASEEEPEYGEEIK

SEQ ID NO: 38129 - protein, 28 aa, Homo sapiens
ASEEEPEYGEEIKGYPGVQAPEDLEWER

SEQ ID NO: 38130 - protein, 30 aa, Homo sapiens
ASEEEPEYGEEIKGYPGVQAPEDLEWERYR

SEQ ID NO: 38131 - protein, 15 aa, Homo sapiens
DKETTENENTKFEVR

SEQ ID NO: 38132 - protein, 21 aa, Homo sapiens
DNMNDNFLEGEEENELTLNEK

SEQ ID NO: 38133 - protein, 35 aa, Homo sapiens
DPADASEAHESSSRGEAGAPGEEDIQGPTKADTEK

SEQ ID NO: 38134 - protein, 18 aa, Homo sapiens
DVKDKETTENENTKFEVR

SEQ ID NO: 38135 - protein, 20 aa, Homo sapiens
EKSSQESGEEAGSQENHPQE

SEQ ID NO: 38136 - protein, 26 aa, Homo sapiens
EKSSQESGEEAGSQENHPQESKGQPR

SEQ ID NO: 38137 - protein, 28 aa, Homo sapiens
ELDRNYLNYGEEGAPGKWQQQGDLQDTK

SEQ ID NO: 38138 - protein, 14 aa, Homo sapiens
ELENLAAMDLELQK

SEQ ID NO: 38139 - protein, 22 aa, Homo sapiens
ERADEPQWSLYPSDSQVSEEVK

SEQ ID NO: 38140 - protein, 23 aa, Homo sapiens
ERADEPQWSLYPSDSQVSEEVKT

SEQ ID NO: 38141 - protein, 24 aa, Homo sapiens
ERADEPQWSLYPSDSQVSEEVKTR

SEQ ID NO: 38142 - protein, 22 aa, Homo sapiens
EYGEEIKGYPGVQAPEDLEWER

SEQ ID NO: 38143 - protein, 13 aa, Homo sapiens
FQDKQYSSHHTAE

SEQ ID NO: 38144 - protein, 16 aa, Homo sapiens
GEAGAPGEEDIQGPTK

SEQ ID NO: 38145 - protein, 21 aa, Homo sapiens
GEAGAPGEEDIQGPTKADTEK

SEQ ID NO: 38146 - protein, 30 aa, Homo sapiens
GEAGAPGEEDIQGPTKADTEKWAEGGGHSR

SEQ ID NO: 38147 - protein, 24 aa, Homo sapiens
GEDSSEEKHLEEPGETQNAFLNER

SEQ ID NO: 38148 - protein, 25 aa, Homo sapiens
GEDSSEEKHLEEPGETQNAFLNERK

SEQ ID NO: 38149 - protein, 22 aa, Homo sapiens
HSEKSQREDEEEEEGENYQKGE

SEQ ID NO: 38150 - protein, 8 aa, Homo sapiens
IAEKFSQR

SEQ ID NO: 38151 - protein, 19 aa, Homo sapiens
KDVKDKETTENENTKFEVR

SEQ ID NO: 38152 - protein, 22 aa, Homo sapiens
KGHPQEESEESNVSMASLGEKR

SEQ ID NO: 38153 - protein, 14 aa, Homo sapiens
KQASAIKKEELVAR

SEQ ID NO: 38154 - protein, 26 aa, Homo sapiens
KQASAIKKEELVARSETHAAGHSQEK

SEQ ID NO: 38155 - protein, 21 aa, Homo sapiens
MAHGYGEESEEERGLEPGKGR

SEQ ID NO: 38156 - protein, 15 aa, Homo sapiens
MPVDNRNHNEGMVTR

SEQ ID NO: 38157 - protein, 30 aa, Homo sapiens
NYPSLELDKMAHGYGEESEEERGLEPGKGR

SEQ ID NO: 38158 - protein, 33 aa, Homo sapiens
NYPSLELDKMAHGYGEESEEERGLEPGKGRHHR

SEQ ID NO: 38159 - protein, 23 aa, Homo sapiens
PEYGEEIKGYPGVQAPEDLEWER

SEQ ID NO: 38160 - protein, 13 aa, Homo sapiens
PSDSQVSEEVKTR

SEQ ID NO: 38161 - protein, 13 aa, Homo sapiens
QASAIKKEELVAR

SEQ ID NO: 38162 - protein, 20 aa, Homo sapiens
SQEESEEGEEDATSEVDKRR

SEQ ID NO: 38163 - protein, 20 aa, Homo sapiens
SSQESGEEAGSQENHPQESK

SEQ ID NO: 38164 - protein, 24 aa, Homo sapiens
SSQESGEEAGSQENHPQESKGQPR

SEQ ID NO: 38165 - protein, 22 aa, Homo sapiens
TSRKDVKDKETTENENTKFEVR

SEQ ID NO: 38166 - protein, 11 aa, Homo sapiens
VAQLDQLLHYR

SEQ ID NO: 38167 - protein, 10 aa, Homo sapiens
VQENQMDKAR

SEQ ID NO: 38168 - protein, 23 aa, Homo sapiens
YLNYGEEGAPGKWQQQGDLQDTK

SEQ ID NO: 38169 - protein, 15 aa, Homo sapiens
KTNVTHEEHTAVEKI

SEQ ID NO: 38170 - protein, 15 aa, Homo sapiens
ARDSNVTLAPSGPKG

SEQ ID NO: 38171 - protein, 21 aa, Homo sapiens
DTQSNELIEINPQSEGKVYTR

SEQ ID NO: 38172 - protein, 13 aa, Homo sapiens
GAMPMEQQYPPMK

SEQ ID NO: 38173 - protein, 17 aa, Homo sapiens
QPGYPGATGPPGLPGIK

SEQ ID NO: 38174 - protein, 34 aa, Homo sapiens
ASHIQLDSLPEVPLLVDVPCLSAQLDDSILNIVK

SEQ ID NO: 38175 - protein, 25 aa, Homo sapiens
HGTVASRPPVQIEELIEKPGGIIVR

SEQ ID NO: 38176 - protein, 24 aa, Homo sapiens
LVTLLQEVDTIEQETIKPLDDCQK

SEQ ID NO: 38177 - protein, 29 aa, Homo sapiens
KYQLLHHSANQLSITVPNVTLQDEGVYKC

SEQ ID NO: 38178 - protein, 21 aa, Homo sapiens
LSSLSSQTEPTSAGDQYDCSR

SEQ ID NO: 38179 - protein, 16 aa, Homo sapiens
MPGLVGQEVGSGEGPR

SEQ ID NO: 38180 - protein, 10 aa, Homo sapiens
HECGAAFTSK

SEQ ID NO: 38181 - protein, 17 aa, Homo sapiens
KLNSSSSSSSNSSNERE

SEQ ID NO: 38182 - protein, 11 aa, Homo sapiens
RPNKPAELIAK

SEQ ID NO: 38183 - protein, 19 aa, Homo sapiens
SLLSMLSDLQIYQDSFEQR

SEQ ID NO: 38184 - protein, 16 aa, Homo sapiens
TLSHNLLVSEVYNQLK

SEQ ID NO: 38185 - protein, 11 aa, Homo sapiens
VDHIIDICFLK

SEQ ID NO: 38186 - protein, 17 aa, Homo sapiens
YNLEELYQAVENLCSYK

SEQ ID NO: 38187 - protein, 20 aa, Homo sapiens
REQLSSANHSLQLASQIQKA

SEQ ID NO: 38188 - protein, 16 aa, Homo sapiens
SAPPPSNSSSSSAPRR

SEQ ID NO: 38189 - protein, 8 aa, Homo sapiens
ADLIAYLK

SEQ ID NO: 38190 - protein, 17 aa, Homo sapiens
GIIWGEDTLMEYLENPK

SEQ ID NO: 38191 - protein, 18 aa, Homo sapiens
GIIWGEDTLMEYLENPKK

SEQ ID NO: 38192 - protein, 10 aa, Homo sapiens
GPNLHGLFGR

SEQ ID NO: 38193 - protein, 15 aa, Homo sapiens
KTGQAPGYSYTAANK

SEQ ID NO: 38194 - protein, 17 aa, Homo sapiens
KTGQAPGYSYTAANKNK

SEQ ID NO: 38195 - protein, 7 aa, Homo sapiens
MIFVGIK

SEQ ID NO: 38196 - protein, 11 aa, Homo sapiens
TGPNLHGLFGR

SEQ ID NO: 38197 - protein, 14 aa, Homo sapiens
TGQAPGYSYTAANK

SEQ ID NO: 38198 - protein, 16 aa, Homo sapiens
TGQAPGYSYTAANKNK

SEQ ID NO: 38199 - protein, 21 aa, Homo sapiens
KNITLLPATAATTFTVTPSGQ

SEQ ID NO: 38200 - protein, 14 aa, Homo sapiens
LWSLGQDDMAIPSK

SEQ ID NO: 38201 - protein, 11 aa, Homo sapiens
VSTTTGDGVAR

SEQ ID NO: 38202 - protein, 22 aa, Homo sapiens
ELVNLIDNHQVTVISGETGCGK

SEQ ID NO: 38203 - protein, 16 aa, Homo sapiens
GQFAEHLLGAGFVSSR

SEQ ID NO: 38204 - protein, 13 aa, Homo sapiens
IESPHPVDWNDTK

SEQ ID NO: 38205 - protein, 14 aa, Homo sapiens
VQPGHCYHLYNGLR

SEQ ID NO: 38206 - protein, 12 aa, Homo sapiens
FGSCVPHTTRPK

SEQ ID NO: 38207 - protein, 20 aa, Homo sapiens
FIEAGQYNNHLYGTSVQSVR

SEQ ID NO: 38208 - protein, 12 aa, Homo sapiens
HCILDVSGNAIK

SEQ ID NO: 38209 - protein, 22 aa, Homo sapiens
LLAVNNVCLEEVTHEEAVTALK

SEQ ID NO: 38210 - protein, 15 aa, Homo sapiens
MMNSSISSGSGSLRT

SEQ ID NO: 38211 - protein, 31 aa, Homo sapiens
YQDEDTPPQEHISPQITNEVIGPELVHVSEK

SEQ ID NO: 38212 - protein, 35 aa, Homo sapiens
RLPNTYPNSSSPGPGGLGGSVHYATMARSAVRPAS

SEQ ID NO: 38213 - protein, 22 aa, Homo sapiens
KHFMQNFACSNVSQVQLITSKG

SEQ ID NO: 38214 - protein, 15 aa, Homo sapiens
RLINLYIIQNNSFSQ

SEQ ID NO: 38215 - protein, 19 aa, Homo sapiens
RENALNNLDPNTELNVSRL

SEQ ID NO: 38216 - protein, 27 aa, Homo sapiens
WNLNNDTEVPTASVAIEGASALNRVRW

SEQ ID NO: 38217 - protein, 8 aa, Homo sapiens
ELEGYIQK

SEQ ID NO: 38218 - protein, 14 aa, Homo sapiens
MTFLHVYSAISSSK

SEQ ID NO: 38219 - protein, 18 aa, Homo sapiens
KYEDICPSTHNMDVPNIK

SEQ ID NO: 38220 - protein, 27 aa, Homo sapiens
NDYQLICIQDGYLSLLTETGEVREDLK

SEQ ID NO: 38221 - protein, 12 aa, Homo sapiens
VHLVGIDIFTGK

SEQ ID NO: 38222 - protein, 17 aa, Homo sapiens
YEDICPSTHNMDVPNIK

SEQ ID NO: 38223 - protein, 20 aa, Homo sapiens
DPEAPIFQVADYGIVADLFK

SEQ ID NO: 38224 - protein, 16 aa, Homo sapiens
GLLPEELTPLILATQK

SEQ ID NO: 38225 - protein, 23 aa, Homo sapiens
IVAPELYIAVGISGAIQHLAGMK

SEQ ID NO: 38226 - protein, 13 aa, Homo sapiens
LGGEVSCLVAGTK

SEQ ID NO: 38227 - protein, 17 aa, Homo sapiens
LLYDLADQLHAAVGASR

SEQ ID NO: 38228 - protein, 16 aa, Homo sapiens
QFNYTHICAGASAFGK

SEQ ID NO: 38229 - protein, 27 aa, Homo sapiens
TIVAINKDPEAPIFQVADYGIVADLFK

SEQ ID NO: 38230 - protein, 12 aa, Homo sapiens
TIYAGNALCTVK

SEQ ID NO: 38231 - protein, 10 aa, Homo sapiens
VLVAQHDVYK

SEQ ID NO: 38232 - protein, 29 aa, Homo sapiens
MGVYGQESGGFSGPGENRSMSGPDNRGRG

SEQ ID NO: 38233 - protein, 11 aa, Homo sapiens
DLPSWSSVDWK

SEQ ID NO: 38234 - protein, 14 aa, Homo sapiens
FNILILYSTTRKER

SEQ ID NO: 38235 - protein, 9 aa, Homo sapiens
SLPDLEILK

SEQ ID NO: 38236 - protein, 17 aa, Homo sapiens
AAVYQPQPHPQPPPYGH

SEQ ID NO: 38237 - protein, 34 aa, Homo sapiens
AAVYQPQPHPQPPPYGHCVTDSGVVYSVGMQWLK

SEQ ID NO: 38238 - protein, 18 aa, Homo sapiens
APPDPTVDQVDDTSIVVR

SEQ ID NO: 38239 - protein, 18 aa, Homo sapiens
APTNLQFVNETDSTVLVR

SEQ ID NO: 38240 - protein, 7 aa, Homo sapiens
AQITGYR

SEQ ID NO: 38241 - protein, 12 aa, Homo sapiens
ASTAIDAPSNLR

SEQ ID NO: 38242 - protein, 35 aa, Homo sapiens
ATGVFTTLQPGSSIPPYNTEVTETTIVITWTPAPR

SEQ ID NO: 38243 - protein, 22 aa, Homo sapiens
AVEENQESTPVVIQQETTGTPR

SEQ ID NO: 38244 - protein, 8 aa, Homo sapiens
AVGDEWER

SEQ ID NO: 38245 - protein, 13 aa, Homo sapiens
CDPHEATCYDDGK

SEQ ID NO: 38246 - protein, 23 aa, Homo sapiens
CDPHEATCYDDGKTYHVGEQWQK

SEQ ID NO: 38247 - protein, 24 aa, Homo sapiens
CDPVDQCQDSETGTFYQIGDSWEK

SEQ ID NO: 38248 - protein, 18 aa, Homo sapiens
CFDHAAGTSYVVGETWEK

SEQ ID NO: 38249 - protein, 9 aa, Homo sapiens
CHEGGQSYK

SEQ ID NO: 38250 - protein, 16 aa, Homo sapiens
CIVDDITYNVNDTFHK

SEQ ID NO: 38251 - protein, 8 aa, Homo sapiens
CTCVGNGR

SEQ ID NO: 38252 - protein, 7 aa, Homo sapiens
DAPIVNK

SEQ ID NO: 38253 - protein, 13 aa, Homo sapiens
DDITYNVNDTFHK

SEQ ID NO: 38254 - protein, 23 aa, Homo sapiens
DDKESVPISDTIIPAVPPPTDLR

SEQ ID NO: 38255 - protein, 12 aa, Homo sapiens
DGQERDAPIVNK

SEQ ID NO: 38256 - protein, 12 aa, Homo sapiens
DITYNVNDTFHK

SEQ ID NO: 38257 - protein, 12 aa, Homo sapiens
DLEVVAATPTSL

SEQ ID NO: 38258 - protein, 24 aa, Homo sapiens
DLEVVAATPTSLLISWDAPAVTVR

SEQ ID NO: 38259 - protein, 11 aa, Homo sapiens
DLQFVEVTDVK

SEQ ID NO: 38260 - protein, 17 aa, Homo sapiens
DNMKWCGTTQNYDADQK

SEQ ID NO: 38261 - protein, 18 aa, Homo sapiens
DQCIVDDITYNVNDTFHK

SEQ ID NO: 38262 - protein, 19 aa, Homo sapiens
DQCIVDDITYNVNDTFHKR

SEQ ID NO: 38263 - protein, 14 aa, Homo sapiens
DSMIWDCTCIGAGR

SEQ ID NO: 38264 - protein, 22 aa, Homo sapiens
DTLTSRPAQGVVTTLENVSPPR

SEQ ID NO: 38265 - protein, 23 aa, Homo sapiens
DTLTSRPAQGVVTTLENVSPPRR

SEQ ID NO: 38266 - protein, 11 aa, Homo sapiens
EATIPGHLNSY

SEQ ID NO: 38267 - protein, 14 aa, Homo sapiens
EATIPGHLNSYTIK

SEQ ID NO: 38268 - protein, 8 aa, Homo sapiens
EDRVPHSR

SEQ ID NO: 38269 - protein, 18 aa, Homo sapiens
EESPLLIGQQSTVSDVPR

SEQ ID NO: 38270 - protein, 31 aa, Homo sapiens
EEVVTVGNSVNEGLNQPTDDSCFDPYTVSHY

SEQ ID NO: 38271 - protein, 16 aa, Homo sapiens
EINLAPDSSSVVVSGL

SEQ ID NO: 38272 - protein, 21 aa, Homo sapiens
EINLAPDSSSVVVSGLMVATK

SEQ ID NO: 38273 - protein, 23 aa, Homo sapiens
EPQYLDLPSTATSVNIPDLLPGR

SEQ ID NO: 38274 - protein, 12 aa, Homo sapiens
ESKPLTAQQTTK

SEQ ID NO: 38275 - protein, 32 aa, Homo sapiens
ESKPLTAQQTTKLDAPTNLQFVNETDSTVLVR

SEQ ID NO: 38276 - protein, 20 aa, Homo sapiens
ESVPISDTIIPAVPPPTDLR

SEQ ID NO: 38277 - protein, 22 aa, Homo sapiens
EVTSDSGSIVVSGLTPGVEYVY

SEQ ID NO: 38278 - protein, 25 aa, Homo sapiens
EVTSDSGSIVVSGLTPGVEYVYTIQ

SEQ ID NO: 38279 - protein, 28 aa, Homo sapiens
EVTSDSGSIVVSGLTPGVEYVYTIQVLR

SEQ ID NO: 38280 - protein, 32 aa, Homo sapiens
EVVPRPRPGVTEATITGLEPGTEYTIYVIALK

SEQ ID NO: 38281 - protein, 16 aa, Homo sapiens
EYLGAICSCTCFGGQR

SEQ ID NO: 38282 - protein, 15 aa, Homo sapiens
FDFTTTSTSTPVTSN

SEQ ID NO: 38283 - protein, 24 aa, Homo sapiens
FDFTTTSTSTPVTSNTVTGETTPF

SEQ ID NO: 38284 - protein, 27 aa, Homo sapiens
FDFTTTSTSTPVTSNTVTGETTPFSPL

SEQ ID NO: 38285 - protein, 22 aa, Homo sapiens
FGFCPMAAHEEICTTNEGVMYR

SEQ ID NO: 38286 - protein, 17 aa, Homo sapiens
FLATTPNSLLVSWQPPR

SEQ ID NO: 38287 - protein, 19 aa, Homo sapiens
FLATTPNSLLVSWQPPRAR

SEQ ID NO: 38288 - protein, 17 aa, Homo sapiens
FLYNNHNYTDCTSEGRR

SEQ ID NO: 38289 - protein, 10 aa, Homo sapiens
FTNIGPDTMR

SEQ ID NO: 38290 - protein, 19 aa, Homo sapiens
FTQVTPTSLSAQWTPPNVQ

SEQ ID NO: 38291 - protein, 20 aa, Homo sapiens
FTQVTPTSLSAQWTPPNVQL

SEQ ID NO: 38292 - protein, 24 aa, Homo sapiens
FTQVTPTSLSAQWTPPNVQLTGYR

SEQ ID NO: 38293 - protein, 23 aa, Homo sapiens
GALCHFPFLYNNHNYTDCTSEGR

SEQ ID NO: 38294 - protein, 12 aa, Homo sapiens
GATYNIIVEALK

SEQ ID NO: 38295 - protein, 16 aa, Homo sapiens
GATYNIIVEALKDQQR

SEQ ID NO: 38296 - protein, 15 aa, Homo sapiens
GDQWDKQHDMGHMMR

SEQ ID NO: 38297 - protein, 13 aa, Homo sapiens
GDSPASSKPISIN

SEQ ID NO: 38298 - protein, 15 aa, Homo sapiens
GDSPASSKPISINYR

SEQ ID NO: 38299 - protein, 12 aa, Homo sapiens
GEWTCIAYSQLR

SEQ ID NO: 38300 - protein, 11 aa, Homo sapiens
GEWTCKPIAEK

SEQ ID NO: 38301 - protein, 17 aa, Homo sapiens
GFNCESKPEAEETCFDK

SEQ ID NO: 38302 - protein, 24 aa, Homo sapiens
GFNCESKPEAEETCFDKYTGNTYR

SEQ ID NO: 38303 - protein, 20 aa, Homo sapiens
GGEPSPEGTTGQSYNQYSQR

SEQ ID NO: 38304 - protein, 28 aa, Homo sapiens
GGNSNGALCHFPFLYNNHNYTDCTSEGR

SEQ ID NO: 38305 - protein, 29 aa, Homo sapiens
GGNSNGALCHFPFLYNNHNYTDCTSEGRR

SEQ ID NO: 38306 - protein, 13 aa, Homo sapiens
GLAFTDVDVDSIK

SEQ ID NO: 38307 - protein, 25 aa, Homo sapiens
GLAFTDVDVDSIKIAWESPQGQVSR

SEQ ID NO: 38308 - protein, 11 aa, Homo sapiens
GLKPGVVYEGQ

SEQ ID NO: 38309 - protein, 17 aa, Homo sapiens
GLKPGVVYEGQLISIQQ

SEQ ID NO: 38310 - protein, 18 aa, Homo sapiens
GLKPGVVYEGQLISIQQY

SEQ ID NO: 38311 - protein, 20 aa, Homo sapiens
GLKPGVVYEGQLISIQQYGH

SEQ ID NO: 38312 - protein, 25 aa, Homo sapiens
GLKPGVVYEGQLISIQQYGHQEVTR

SEQ ID NO: 38313 - protein, 13 aa, Homo sapiens
GNLLQCICTGNGR

SEQ ID NO: 38314 - protein, 17 aa, Homo sapiens
GNLLQCICTGNGRGEWK

SEQ ID NO: 38315 - protein, 7 aa, Homo sapiens
GNQESPK

SEQ ID NO: 38316 - protein, 16 aa, Homo sapiens
GQLISIQQYGHQEVTR

SEQ ID NO: 38317 - protein, 23 aa, Homo sapiens
GQPRQYNVGPSVSKYPLRNLQPA

SEQ ID NO: 38318 - protein, 10 aa, Homo sapiens
GRISCTIANR

SEQ ID NO: 38319 - protein, 13 aa, Homo sapiens
GTSTSATLTGLTR

SEQ ID NO: 38320 - protein, 12 aa, Homo sapiens
GVRPSQGGEAPR

SEQ ID NO: 38321 - protein, 16 aa, Homo sapiens
HEEGHMLNCTCFGQGR

SEQ ID NO: 38322 - protein, 11 aa, Homo sapiens
HHPEHFSGRPR

SEQ ID NO: 38323 - protein, 13 aa, Homo sapiens
HTSVQTTSSGSGP

SEQ ID NO: 38324 - protein, 14 aa, Homo sapiens
HTSVQTTSSGSGPF

SEQ ID NO: 38325 - protein, 15 aa, Homo sapiens
HTSVQTTSSGSGPFT

SEQ ID NO: 38326 - protein, 17 aa, Homo sapiens
HTSVQTTSSGSGPFTDV

SEQ ID NO: 38327 - protein, 18 aa, Homo sapiens
HTSVQTTSSGSGPFTDVR

SEQ ID NO: 38328 - protein, 10 aa, Homo sapiens
HYAVGDEWER

SEQ ID NO: 38329 - protein, 10 aa, Homo sapiens
HYQINQQWER

SEQ ID NO: 38330 - protein, 12 aa, Homo sapiens
IAWESPQGQVSR

SEQ ID NO: 38331 - protein, 8 aa, Homo sapiens
IFEEHGFR

SEQ ID NO: 38332 - protein, 7 aa, Homo sapiens
IGDQWDK

SEQ ID NO: 38333 - protein, 16 aa, Homo sapiens
IGDQWDKQHDMGHMMR

SEQ ID NO: 38334 - protein, 6 aa, Homo sapiens
IGDTWR

SEQ ID NO: 38335 - protein, 7 aa, Homo sapiens
IGDTWSK

SEQ ID NO: 38336 - protein, 11 aa, Homo sapiens
IGDTWSKKDNR

SEQ ID NO: 38337 - protein, 7 aa, Homo sapiens
IGEKWDR

SEQ ID NO: 38338 - protein, 17 aa, Homo sapiens
IISCHPVGTDEEPLQFR

SEQ ID NO: 38339 - protein, 12 aa, Homo sapiens
IPVNLPGEHGQR

SEQ ID NO: 38340 - protein, 13 aa, Homo sapiens
IRHHPEHFSGRPR

SEQ ID NO: 38341 - protein, 8 aa, Homo sapiens
ISCTIANR

SEQ ID NO: 38342 - protein, 13 aa, Homo sapiens
ISIQQYGHQEVTR

SEQ ID NO: 38343 - protein, 6 aa, Homo sapiens
ITCTSR

SEQ ID NO: 38344 - protein, 25 aa, Homo sapiens
ITETPSQPNSHPIQWNAPQPSHISK

SEQ ID NO: 38345 - protein, 18 aa, Homo sapiens
ITGLEPGTEYTIYVIALK

SEQ ID NO: 38346 - protein, 7 aa, Homo sapiens
ITGYIIK

SEQ ID NO: 38347 - protein, 16 aa, Homo sapiens
ITGYIIKYEKPGSPPR

SEQ ID NO: 38348 - protein, 12 aa, Homo sapiens
ITTTPTNGQQGN

SEQ ID NO: 38349 - protein, 19 aa, Homo sapiens
ITTTPTNGQQGNSLEEVVH

SEQ ID NO: 38350 - protein, 24 aa, Homo sapiens
ITTTPTNGQQGNSLEEVVHADQSS

SEQ ID NO: 38351 - protein, 15 aa, Homo sapiens
ITYGETGGNSPVQEF

SEQ ID NO: 38352 - protein, 21 aa, Homo sapiens
ITYGETGGNSPVQEFTVPGSK

SEQ ID NO: 38353 - protein, 21 aa, Homo sapiens
IVYSPSVEGSSTELNLPETAN

SEQ ID NO: 38354 - protein, 11 aa, Homo sapiens
IYLYTLNDNAR

SEQ ID NO: 38355 - protein, 25 aa, Homo sapiens
KCDPVDQCQDSETGTFYQIGDSWEK

SEQ ID NO: 38356 - protein, 31 aa, Homo sapiens
KKTDELPQLVTLPHPNLHGPEILDVPSTVQK

SEQ ID NO: 38357 - protein, 22 aa, Homo sapiens
KLDAPTNLQFVNETDSTVLVRW

SEQ ID NO: 38358 - protein, 18 aa, Homo sapiens
KPSQMQVTDVQDNSISVK

SEQ ID NO: 38359 - protein, 30 aa, Homo sapiens
KTDELPQLVTLPHPNLHGPEILDVPSTVQK

SEQ ID NO: 38360 - protein, 20 aa, Homo sapiens
LDAPTNLQFVNETDSTVLVR

SEQ ID NO: 38361 - protein, 9 aa, Homo sapiens
LGFGSGHFR

SEQ ID NO: 38362 - protein, 13 aa, Homo sapiens
LGVRPSQGGEAPR

SEQ ID NO: 38363 - protein, 15 aa, Homo sapiens
LHGPEILDVPSTVQK

SEQ ID NO: 38364 - protein, 13 aa, Homo sapiens
LIGQQSTVSDVPR

SEQ ID NO: 38365 - protein, 14 aa, Homo sapiens
LISIQQYGHQEVTR

SEQ ID NO: 38366 - protein, 12 aa, Homo sapiens
LISWDAPAVTVR

SEQ ID NO: 38367 - protein, 14 aa, Homo sapiens
LLCQCLGFGSGHFR

SEQ ID NO: 38368 - protein, 24 aa, Homo sapiens
LLPGTEYVVSVSSVYEQHESTPLR

SEQ ID NO: 38369 - protein, 24 aa, Homo sapiens
LNLPETANSVTLSDLQPGVQYNIT

SEQ ID NO: 38370 - protein, 23 aa, Homo sapiens
LPGTEYVVSVSSVYEQHESTPLR

SEQ ID NO: 38371 - protein, 15 aa, Homo sapiens
LQPASEYTVSLVAIK

SEQ ID NO: 38372 - protein, 17 aa, Homo sapiens
LTPGTEYVVSIVALNGR

SEQ ID NO: 38373 - protein, 7 aa, Homo sapiens
LTVGLTR

SEQ ID NO: 38374 - protein, 7 aa, Homo sapiens
MSESGFK

SEQ ID NO: 38375 - protein, 24 aa, Homo sapiens
NGALCHFPFLYNNHNYTDCTSEGR

SEQ ID NO: 38376 - protein, 7 aa, Homo sapiens
NGPGPTK

SEQ ID NO: 38377 - protein, 16 aa, Homo sapiens
NLQPASEYTVSLVAIK

SEQ ID NO: 38378 - protein, 23 aa, Homo sapiens
NLQPASEYTVSLVAIKGNQESPK

SEQ ID NO: 38379 - protein, 21 aa, Homo sapiens
NSITLTNLTPGTEYVVSIVAL

SEQ ID NO: 38380 - protein, 24 aa, Homo sapiens
NSITLTNLTPGTEYVVSIVALNGR

SEQ ID NO: 38381 - protein, 15 aa, Homo sapiens
NTFAEVTGLSPGVTY

SEQ ID NO: 38382 - protein, 16 aa, Homo sapiens
NTFAEVTGLSPGVTYY

SEQ ID NO: 38383 - protein, 18 aa, Homo sapiens
NTFAEVTGLSPGVTYYFK

SEQ ID NO: 38384 - protein, 16 aa, Homo sapiens
PAQGVVTTLENVSPPR

SEQ ID NO: 38385 - protein, 12 aa, Homo sapiens
PASSKPISINYR

SEQ ID NO: 38386 - protein, 20 aa, Homo sapiens
PDAPPDPTVDQVDDTSIVVR

SEQ ID NO: 38387 - protein, 15 aa, Homo sapiens
PEGTTGQSYNQYSQR

SEQ ID NO: 38388 - protein, 17 aa, Homo sapiens
PFLYNNHNYTDCTSEGR

SEQ ID NO: 38389 - protein, 25 aa, Homo sapiens
PFQDTSEYIISCHPVGTDEEPLQFR

SEQ ID NO: 38390 - protein, 8 aa, Homo sapiens
PGCYDNGK

SEQ ID NO: 38391 - protein, 21 aa, Homo sapiens
PGGEPSPEGTTGQSYNQYSQR

SEQ ID NO: 38392 - protein, 10 aa, Homo sapiens
PGHLNSYTIK

SEQ ID NO: 38393 - protein, 22 aa, Homo sapiens
PGTEYVVSVSSVYEQHESTPLR

SEQ ID NO: 38394 - protein, 14 aa, Homo sapiens
PGTSTSATLTGLTR

SEQ ID NO: 38395 - protein, 25 aa, Homo sapiens
PGVTEATITGLEPGTEYTIYVIALK

SEQ ID NO: 38396 - protein, 22 aa, Homo sapiens
PGVVYEGQLISIQQYGHQEVTR

SEQ ID NO: 38397 - protein, 7 aa, Homo sapiens
PISINYR

SEQ ID NO: 38398 - protein, 25 aa, Homo sapiens
PLSPPTNLHLEANPDTGVLTVSWER

SEQ ID NO: 38399 - protein, 9 aa, Homo sapiens
PLTAQQTTK

SEQ ID NO: 38400 - protein, 17 aa, Homo sapiens
PPDPTVDQVDDTSIVVR

SEQ ID NO: 38401 - protein, 10 aa, Homo sapiens
PPNVQLTGYR

SEQ ID NO: 38402 - protein, 13 aa, Homo sapiens
PPPSIDLTNFLVR

SEQ ID NO: 38403 - protein, 12 aa, Homo sapiens
PPSIDLTNFLVR

SEQ ID NO: 38404 - protein, 22 aa, Homo sapiens
PPTNLHLEANPDTGVLTVSWER

SEQ ID NO: 38405 - protein, 9 aa, Homo sapiens
PPTTATPIR

SEQ ID NO: 38406 - protein, 9 aa, Homo sapiens
PQAPITGYR

SEQ ID NO: 38407 - protein, 25 aa, Homo sapiens
PQLVTLPHPNLHGPEILDVPSTVQK

SEQ ID NO: 38408 - protein, 19 aa, Homo sapiens
PQSPVAVSQSKPGCYDNGK

SEQ ID NO: 38409 - protein, 27 aa, Homo sapiens
PRPGVTEATITGLEPGTEYTIYVIALK

SEQ ID NO: 38410 - protein, 20 aa, Homo sapiens
PSGESQPLVQTAVTNIDRPK

SEQ ID NO: 38411 - protein, 9 aa, Homo sapiens
PSQGGEAPR

SEQ ID NO: 38412 - protein, 17 aa, Homo sapiens
PSQMQVTDVQDNSISVK

SEQ ID NO: 38413 - protein, 16 aa, Homo sapiens
PSTATSVNIPDLLPGR

SEQ ID NO: 38414 - protein, 17 aa, Homo sapiens
PTNLQFVNETDSTVLVR

SEQ ID NO: 38415 - protein, 14 aa, Homo sapiens
PTVDQVDDTSIVVR

SEQ ID NO: 38416 - protein, 11 aa, Homo sapiens
PVNLPGEHGQR

SEQ ID NO: 38417 - protein, 19 aa, Homo sapiens
PYQGWMMVDCTCLGEGSGR

SEQ ID NO: 38418 - protein, 15 aa, Homo sapiens
PYTVSHYAVGDEWER

SEQ ID NO: 38419 - protein, 18 aa, Homo sapiens
QAQQMVQPQSPVAVSQSK

SEQ ID NO: 38420 - protein, 26 aa, Homo sapiens
QAQQMVQPQSPVAVSQSKPGCYDNGK

SEQ ID NO: 38421 - protein, 18 aa, Homo sapiens
QDGHLWCSTTSNYEQDQK

SEQ ID NO: 38422 - protein, 17 aa, Homo sapiens
QESTPVVIQQETTGTPR

SEQ ID NO: 38423 - protein, 17 aa, Homo sapiens
QGENGQMMSCTCLGNGK

SEQ ID NO: 38424 - protein, 9 aa, Homo sapiens
QHDMGHMMR

SEQ ID NO: 38425 - protein, 39 aa, Homo sapiens
QISEDGEQSLILSTSQTTAPDAPPDPTVDQVDDTSIVVR

SEQ ID NO: 38426 - protein, 15 aa, Homo sapiens
QVDAVPANGQTPIQR

SEQ ID NO: 38427 - protein, 13 aa, Homo sapiens
QVTDVQDNSISVK

SEQ ID NO: 38428 - protein, 10 aa, Homo sapiens
QYNVGPSVSK

SEQ ID NO: 38429 - protein, 14 aa, Homo sapiens
QYNVGPSVSKYPLR

SEQ ID NO: 38430 - protein, 20 aa, Homo sapiens
RDQCIVDDITYNVNDTFHKR

SEQ ID NO: 38431 - protein, 17 aa, Homo sapiens
RHEEGHMLNCTCFGQGR

SEQ ID NO: 38432 - protein, 18 aa, Homo sapiens
RHEEGHMLNCTCFGQGRG

SEQ ID NO: 38433 - protein, 46 aa, Homo sapiens
RITTTPTNGQQGNSLEEVVHADQSSCTFDNLSPGLEYNVSVYTVKD

SEQ ID NO: 38434 - protein, 14 aa, Homo sapiens
RPGGEPSPEGTTGQ

SEQ ID NO: 38435 - protein, 16 aa, Homo sapiens
RPGGEPSPEGTTGQSY

SEQ ID NO: 38436 - protein, 17 aa, Homo sapiens
RPGGEPSPEGTTGQSYN

SEQ ID NO: 38437 - protein, 19 aa, Homo sapiens
RPGGEPSPEGTTGQSYNQY

SEQ ID NO: 38438 - protein, 22 aa, Homo sapiens
RPGGEPSPEGTTGQSYNQYSQR

SEQ ID NO: 38439 - protein, 26 aa, Homo sapiens
RPGGEPSPEGTTGQSYNQYSQRYHQR

SEQ ID NO: 38440 - protein, 8 aa, Homo sapiens
RPHETGGY

SEQ ID NO: 38441 - protein, 19 aa, Homo sapiens
RPHETGGYMLECVCLGNGK

SEQ ID NO: 38442 - protein, 30 aa, Homo sapiens
RPHETGGYMLECVCLGNGKGEWTCKPIAEK

SEQ ID NO: 38443 - protein, 19 aa, Homo sapiens
RQAQQMVQPQSPVAVSQSK

SEQ ID NO: 38444 - protein, 15 aa, Homo sapiens
SAQWTPPNVQLTGYR

SEQ ID NO: 38445 - protein, 8 aa, Homo sapiens
SDTVPSPR

SEQ ID NO: 38446 - protein, 7 aa, Homo sapiens
SEPLIGR

SEQ ID NO: 38447 - protein, 17 aa, Homo sapiens
SFVVSWVSASDTVSGFR

SEQ ID NO: 38448 - protein, 16 aa, Homo sapiens
SHPIQWNAPQPSHISK

SEQ ID NO: 38449 - protein, 12 aa, Homo sapiens
SIQQYGHQEVTR

SEQ ID NO: 38450 - protein, 14 aa, Homo sapiens
SLLISWDAPAVTVR

SEQ ID NO: 38451 - protein, 10 aa, Homo sapiens
SLLVSWQPPR

SEQ ID NO: 38452 - protein, 17 aa, Homo sapiens
SLSAQWTPPNVQLTGYR

SEQ ID NO: 38453 - protein, 25 aa, Homo sapiens
SNGALCHFPFLYNNHNYTDCTSEGR

SEQ ID NO: 38454 - protein, 13 aa, Homo sapiens
SPASSKPISINYR

SEQ ID NO: 38455 - protein, 16 aa, Homo sapiens
SPLLIGQQSTVSDVPR

SEQ ID NO: 38456 - protein, 33 aa, Homo sapiens
SPLVATSESVTEITASSFVVSWVSASDTVSGFR

SEQ ID NO: 38457 - protein, 23 aa, Homo sapiens
SPPTNLHLEANPDTGVLTVSWER

SEQ ID NO: 38458 - protein, 12 aa, Homo sapiens
SPVQEFTVPGSK

SEQ ID NO: 38459 - protein, 33 aa, Homo sapiens
SSGPVEVFITETPSQPNSHPIQWNAPQPSHISK

SEQ ID NO: 38460 - protein, 11 aa, Homo sapiens
SSGSGPFTDVR

SEQ ID NO: 38461 - protein, 19 aa, Homo sapiens
SSPVVIDASTAIDAPSNLR

SEQ ID NO: 38462 - protein, 9 aa, Homo sapiens
STATISGLK

SEQ ID NO: 38463 - protein, 14 aa, Homo sapiens
STATISGLKPGVDY

SEQ ID NO: 38464 - protein, 19 aa, Homo sapiens
STATISGLKPGVDYTITVY

SEQ ID NO: 38465 - protein, 24 aa, Homo sapiens
STATISGLKPGVDYTITVYAVTGR

SEQ ID NO: 38466 - protein, 27 aa, Homo sapiens
STSQTTAPDAPPDPTVDQVDDTSIVVR

SEQ ID NO: 38467 - protein, 10 aa, Homo sapiens
STTPDITGYR

SEQ ID NO: 38468 - protein, 11 aa, Homo sapiens
STTSNYEQDQK

SEQ ID NO: 38469 - protein, 11 aa, Homo sapiens
SVNIPDLLPGR

SEQ ID NO: 38470 - protein, 16 aa, Homo sapiens
SVQTTSSGSGPFTDVR

SEQ ID NO: 38471 - protein, 12 aa, Homo sapiens
SVYEQHESTPLR

SEQ ID NO: 38472 - protein, 14 aa, Homo sapiens
SYTITGLQPGTDYK

SEQ ID NO: 38473 - protein, 25 aa, Homo sapiens
SYTITGLQPGTDYKIYLYTLNDNAR

SEQ ID NO: 38474 - protein, 20 aa, Homo sapiens
TCLGNGVSCQETAVTQTYGG

SEQ ID NO: 38475 - protein, 14 aa, Homo sapiens
TDELPQLVTLPHPN

SEQ ID NO: 38476 - protein, 29 aa, Homo sapiens
TDELPQLVTLPHPNLHGPEILDVPSTVQK

SEQ ID NO: 38477 - protein, 17 aa, Homo sapiens
TEIDKPSQMQVTDVQDN

SEQ ID NO: 38478 - protein, 22 aa, Homo sapiens
TEIDKPSQMQVTDVQDNSISVK

SEQ ID NO: 38479 - protein, 22 aa, Homo sapiens
TETITGFQVDAVPANGQTPIQR

SEQ ID NO: 38480 - protein, 10 aa, Homo sapiens
TFYSCTTEGR

SEQ ID NO: 38481 - protein, 17 aa, Homo sapiens
TGLDSPTGIDFSDITAN

SEQ ID NO: 38482 - protein, 19 aa, Homo sapiens
TGLDSPTGIDFSDITANSF

SEQ ID NO: 38483 - protein, 22 aa, Homo sapiens
TGLDSPTGIDFSDITANSFTVH

SEQ ID NO: 38484 - protein, 27 aa, Homo sapiens
TGLDSPTGIDFSDITANSFTVHWIAPR

SEQ ID NO: 38485 - protein, 26 aa, Homo sapiens
TGPMKEINLAPDSSSVVVSGLMVATK

SEQ ID NO: 38486 - protein, 15 aa, Homo sapiens
TGYIIKYEKPGSPPR

SEQ ID NO: 38487 - protein, 7 aa, Homo sapiens
TIKPDVR

SEQ ID NO: 38488 - protein, 9 aa, Homo sapiens
TKTETITGF

SEQ ID NO: 38489 - protein, 24 aa, Homo sapiens
TKTETITGFQVDAVPANGQTPIQR

SEQ ID NO: 38490 - protein, 26 aa, Homo sapiens
TNLLPGTEYVVSVSSVYEQHESTPLR

SEQ ID NO: 38491 - protein, 21 aa, Homo sapiens
TNTNVNCPIECFMPLDVQADR

SEQ ID NO: 38492 - protein, 26 aa, Homo sapiens
TPFVTHPGYDTGNGIQLPGTSGQQPS

SEQ ID NO: 38493 - protein, 30 aa, Homo sapiens
TPFVTHPGYDTGNGIQLPGTSGQQPSVGQQ

SEQ ID NO: 38494 - protein, 40 aa, Homo sapiens
TPFVTHPGYDTGNGIQLPGTSGQQPSVGQQMIFEEHGFRR

SEQ ID NO: 38495 - protein, 14 aa, Homo sapiens
TPGVEYVYTIQVLR

SEQ ID NO: 38496 - protein, 26 aa, Homo sapiens
TPLSPPTNLHLEANPDTGVLTVSWER

SEQ ID NO: 38497 - protein, 20 aa, Homo sapiens
TSGQQPSVGQQMIFEEHGFR

SEQ ID NO: 38498 - protein, 15 aa, Homo sapiens
TSYRIGDTWSKKDNR

SEQ ID NO: 38499 - protein, 30 aa, Homo sapiens
TTLQPGSSIPPYNTEVTETTIVITWTPAPR

SEQ ID NO: 38500 - protein, 11 aa, Homo sapiens
TTPPTTATPIR

SEQ ID NO: 38501 - protein, 13 aa, Homo sapiens
TTSSGSGPFTDVR

SEQ ID NO: 38502 - protein, 13 aa, Homo sapiens
TVSHYAVGDEWER

SEQ ID NO: 38503 - protein, 10 aa, Homo sapiens
TYHVGEQWQK

SEQ ID NO: 38504 - protein, 16 aa, Homo sapiens
TYLGNALVCTCYGGSR

SEQ ID NO: 38505 - protein, 10 aa, Homo sapiens
TYNVNDTFHK

SEQ ID NO: 38506 - protein, 30 aa, Homo sapiens
VATSESVTEITASSFVVSWVSASDTVSGFR

SEQ ID NO: 38507 - protein, 14 aa, Homo sapiens
VDDITYNVNDTFHK

SEQ ID NO: 38508 - protein, 15 aa, Homo sapiens
VDDITYNVNDTFHKR

SEQ ID NO: 38509 - protein, 15 aa, Homo sapiens
VDVIPVNLPGEHGQR

SEQ ID NO: 38510 - protein, 22 aa, Homo sapiens
VEYELSEEGDEPQYLDLPSTAT

SEQ ID NO: 38511 - protein, 33 aa, Homo sapiens
VEYELSEEGDEPQYLDLPSTATSVNIPDLLPGR

SEQ ID NO: 38512 - protein, 34 aa, Homo sapiens
VEYELSEEGDEPQYLDLPSTATSVNIPDLLPGRK

SEQ ID NO: 38513 - protein, 8 aa, Homo sapiens
VFAVSHGR

SEQ ID NO: 38514 - protein, 9 aa, Homo sapiens
VGDTYERPK

SEQ ID NO: 38515 - protein, 15 aa, Homo sapiens
VPGTSTSATLTGLTR

SEQ ID NO: 38516 - protein, 16 aa, Homo sapiens
VREEVVTVGNSVNEGL

SEQ ID NO: 38517 - protein, 14 aa, Homo sapiens
VTDATETTITISWR

SEQ ID NO: 38518 - protein, 16 aa, Homo sapiens
VTIMWTPPESAVTGYR

SEQ ID NO: 38519 - protein, 6 aa, Homo sapiens
VTTTPK

SEQ ID NO: 38520 - protein, 13 aa, Homo sapiens
VTTTPKNGPGPTK

SEQ ID NO: 38521 - protein, 15 aa, Homo sapiens
VTTTPKNGPGPTKTK

SEQ ID NO: 38522 - protein, 13 aa, Homo sapiens
VTWAPPPSIDLTN

SEQ ID NO: 38523 - protein, 17 aa, Homo sapiens
VTWAPPPSIDLTNFLVR

SEQ ID NO: 38524 - protein, 10 aa, Homo sapiens
VVSIVALNGR

SEQ ID NO: 38525 - protein, 17 aa, Homo sapiens
VVSVSSVYEQHESTPLR

SEQ ID NO: 38526 - protein, 15 aa, Homo sapiens
VVSWVSASDTVSGFR

SEQ ID NO: 38527 - protein, 28 aa, Homo sapiens
VVTPLSPPTNLHLEANPDTGVLTVSWER

SEQ ID NO: 38528 - protein, 17 aa, Homo sapiens
VVTVGNSVNEGLNQPTD

SEQ ID NO: 38529 - protein, 13 aa, Homo sapiens
WCGTTQNYDADQK

SEQ ID NO: 38530 - protein, 10 aa, Homo sapiens
WCHDNGVNYK

SEQ ID NO: 38531 - protein, 26 aa, Homo sapiens
WKCDPVDQCQDSETGTFYQIGDSWEK

SEQ ID NO: 38532 - protein, 16 aa, Homo sapiens
WKEATIPGHLNSYTIK

SEQ ID NO: 38533 - protein, 12 aa, Homo sapiens
WLPSSSPVTGYR

SEQ ID NO: 38534 - protein, 18 aa, Homo sapiens
WLPSSSPVTGYRVTTTPK

SEQ ID NO: 38535 - protein, 12 aa, Homo sapiens
WSRPQAPITGYR

SEQ ID NO: 38536 - protein, 12 aa, Homo sapiens
WTPPRAQITGYR

SEQ ID NO: 38537 - protein, 12 aa, Homo sapiens
WVSASDTVSGFR

SEQ ID NO: 38538 - protein, 9 aa, Homo sapiens
YAVGDEWER

SEQ ID NO: 38539 - protein, 9 aa, Homo sapiens
YEKPGSPPR

SEQ ID NO: 38540 - protein, 9 aa, Homo sapiens
YEVSVYALK

SEQ ID NO: 38541 - protein, 8 aa, Homo sapiens
YQCYCYGR

SEQ ID NO: 38542 - protein, 14 aa, Homo sapiens
YSFCTDHTVLVQTR

SEQ ID NO: 38543 - protein, 7 aa, Homo sapiens
YTGNTYR

SEQ ID NO: 38544 - protein, 24 aa, Homo sapiens
YYRITYGETGGNSPVQEFTVPGSK

SEQ ID NO: 38545 - protein, 21 aa, Homo sapiens
CTFDNLSPGLEYNVSVYTVKD

SEQ ID NO: 38546 - protein, 34 aa, Homo sapiens
QPGVQYNITIYAVEENQESTPVVIQQETTGTPRS

SEQ ID NO: 38547 - protein, 15 aa, Homo sapiens
RWTPLNSSTIIGYRI

SEQ ID NO: 38548 - protein, 15 aa, Homo sapiens
SPGLEYNVSVYTVKD

SEQ ID NO: 38549 - protein, 26 aa, Homo sapiens
AQNPSGESQPLVQTAVTTIPAPTDLK

SEQ ID NO: 38550 - protein, 10 aa, Homo sapiens
EDVDYHLYPH

SEQ ID NO: 38551 - protein, 21 aa, Homo sapiens
HRPRPYPPNVGEEIQIGHIPR

SEQ ID NO: 38552 - protein, 51 aa, Homo sapiens
TAGPDQTEMTIEGLQPTVEYVVSVYAQNPSGESQPLVQTAVTTIPAPTDLK

SEQ ID NO: 38553 - protein, 15 aa, Homo sapiens
VQTAVTTIPAPTDLK

SEQ ID NO: 38554 - protein, 27 aa, Homo sapiens
YAQNPSGESQPLVQTAVTTIPAPTDLK

SEQ ID NO: 38555 - protein, 10 aa, Homo sapiens
AGAHLQGGAK

SEQ ID NO: 38556 - protein, 11 aa, Homo sapiens
AGAHLQGGAKR

SEQ ID NO: 38557 - protein, 24 aa, Homo sapiens
AINDPFIDLNYMVYMFQYDSTHGK

SEQ ID NO: 38558 - protein, 13 aa, Homo sapiens
ASCTTNCLAPLAK

SEQ ID NO: 38559 - protein, 22 aa, Homo sapiens
DGRGALQNIIPASTGAAKAVGK

SEQ ID NO: 38560 - protein, 21 aa, Homo sapiens
DPFIDLNYMVYMFQYDSTHGK

SEQ ID NO: 38561 - protein, 15 aa, Homo sapiens
GALQNIIPASTGAAK

SEQ ID NO: 38562 - protein, 10 aa, Homo sapiens
IISNASCTTN

SEQ ID NO: 38563 - protein, 17 aa, Homo sapiens
IISNASCTTNCLAPLAK

SEQ ID NO: 38564 - protein, 16 aa, Homo sapiens
KVIPELNGKLTGMAFR

SEQ ID NO: 38565 - protein, 12 aa, Homo sapiens
LEKPAKYDDIKK

SEQ ID NO: 38566 - protein, 14 aa, Homo sapiens
LISWYDNEFGYSNR

SEQ ID NO: 38567 - protein, 7 aa, Homo sapiens
LTGMAFR

SEQ ID NO: 38568 - protein, 14 aa, Homo sapiens
LVINGNPITIFQER

SEQ ID NO: 38569 - protein, 18 aa, Homo sapiens
LVINGNPITIFQERDPSK

SEQ ID NO: 38570 - protein, 10 aa, Homo sapiens
MFQYDSTHGK

SEQ ID NO: 38571 - protein, 22 aa, Homo sapiens
NDPFIDLNYMVYMFQYDSTHGK

SEQ ID NO: 38572 - protein, 20 aa, Homo sapiens
PFIDLNYMVYMFQYDSTHGK

SEQ ID NO: 38573 - protein, 16 aa, Homo sapiens
PSADAPMFVMGVNHEK

SEQ ID NO: 38574 - protein, 13 aa, Homo sapiens
PTANVSVVDLTCR

SEQ ID NO: 38575 - protein, 30 aa, Homo sapiens
QVVSSDFNSDTHSSTFDAGAGIALNDHFVK

SEQ ID NO: 38576 - protein, 22 aa, Homo sapiens
RVIISAPSADAPMFVMGVNHEK

SEQ ID NO: 38577 - protein, 15 aa, Homo sapiens
RVPTANVSVVDLTCR

SEQ ID NO: 38578 - protein, 18 aa, Homo sapiens
SSTFDAGAGIALNDHFVK

SEQ ID NO: 38579 - protein, 12 aa, Homo sapiens
TANVSVVDLTCR

SEQ ID NO: 38580 - protein, 33 aa, Homo sapiens
TEHQVVSSDFNSDTHSSTFDAGAGIALNDHFVK

SEQ ID NO: 38581 - protein, 11 aa, Homo sapiens
TTVHAITATQK

SEQ ID NO: 38582 - protein, 11 aa, Homo sapiens
TVDGPSGKLWR

SEQ ID NO: 38583 - protein, 28 aa, Homo sapiens
VDIVAINDPFIDLNYMVYMFQYDSTHGK

SEQ ID NO: 38584 - protein, 8 aa, Homo sapiens
VGVNGFGR

SEQ ID NO: 38585 - protein, 17 aa, Homo sapiens
VIHDNFGIVEGLMTTVH

SEQ ID NO: 38586 - protein, 24 aa, Homo sapiens
VIHDNFGIVEGLMTTVHAITATQK

SEQ ID NO: 38587 - protein, 21 aa, Homo sapiens
VIISAPSADAPMFVMGVNHEK

SEQ ID NO: 38588 - protein, 27 aa, Homo sapiens
VIISAPSADAPMFVMGVNHEKYDNSLK

SEQ ID NO: 38589 - protein, 14 aa, Homo sapiens
VPTANVSVVDLTCR

SEQ ID NO: 38590 - protein, 9 aa, Homo sapiens
VSVVDLTCR

SEQ ID NO: 38591 - protein, 11 aa, Homo sapiens
VVDLMAHMASK

SEQ ID NO: 38592 - protein, 12 aa, Homo sapiens
VVDLMAHMASKE

SEQ ID NO: 38593 - protein, 21 aa, Homo sapiens
WGDAGAEYVVESTGVFTTMEK

SEQ ID NO: 38594 - protein, 18 aa, Homo sapiens
LIITSAEASPAECCQHAK

SEQ ID NO: 38595 - protein, 20 aa, Homo sapiens
LQELESCSGLGSTSDDTDVR

SEQ ID NO: 38596 - protein, 31 aa, Homo sapiens
LGNTKDFIISFDLKFLTNGSVSVVLETTEKN

SEQ ID NO: 38597 - protein, 16 aa, Homo sapiens
RTLLPNTTLTYDTQKI

SEQ ID NO: 38598 - protein, 11 aa, Homo sapiens
RYSGVNMTGFR

SEQ ID NO: 38599 - protein, 19 aa, Homo sapiens
KLQESIEYEDLGKNNSVKT

SEQ ID NO: 38600 - protein, 30 aa, Homo sapiens
KMKYAENVPHNMTEKEFWTRFFQSHYFHRD

SEQ ID NO: 38601 - protein, 17 aa, Homo sapiens
RLNVNATDSSSTSNHKQ

SEQ ID NO: 38602 - protein, 22 aa, Homo sapiens
ALFESFPEDFYVEGLPEGVPFR

SEQ ID NO: 38603 - protein, 20 aa, Homo sapiens
FEAHPNDLYVEGLPENIPFR

SEQ ID NO: 38604 - protein, 29 aa, Homo sapiens
GPVTIPYPLFQSHVEDLYVEGLPEGIPFR

SEQ ID NO: 38605 - protein, 11 aa, Homo sapiens
HPENYDLATLK

SEQ ID NO: 38606 - protein, 39 aa, Homo sapiens
KSPPRKINSSPNVNTTASGVEDLNIIQVTIPDDDNERLS

SEQ ID NO: 38607 - protein, 16 aa, Homo sapiens
RPELLTHSTTEVTQPR

SEQ ID NO: 38608 - protein, 22 aa, Homo sapiens
VPEIEVTVEGPNNNNPQTSAVR

SEQ ID NO: 38609 - protein, 25 aa, Homo sapiens
VPYPVFESNPEFLYVEGLPEGIPFR

SEQ ID NO: 38610 - protein, 22 aa, Homo sapiens
AASADSTTEGTPADGFTVLSTK

SEQ ID NO: 38611 - protein, 12 aa, Homo sapiens
AEILELAGNAAR

SEQ ID NO: 38612 - protein, 14 aa, Homo sapiens
FVIHCNSPVWGADK

SEQ ID NO: 38613 - protein, 21 aa, Homo sapiens
FVIHCNSPVWGADKCEELLEK

SEQ ID NO: 38614 - protein, 20 aa, Homo sapiens
GVTIASGGVLPNIHPELLAK

SEQ ID NO: 38615 - protein, 17 aa, Homo sapiens
HILLAVANDEELNQLLK

SEQ ID NO: 38616 - protein, 29 aa, Homo sapiens
IGVGAPVYMAAVLEYLTAEILELAGNAAR

SEQ ID NO: 38617 - protein, 14 aa, Homo sapiens
LTAEILELAGNAAR

SEQ ID NO: 38618 - protein, 20 aa, Homo sapiens
NGPLEVAGAAVSAGHGLPAK

SEQ ID NO: 38619 - protein, 22 aa, Homo sapiens
DYQFTILDVRPALDSLSAVWDR

SEQ ID NO: 38620 - protein, 17 aa, Homo sapiens
WEALHAAECPCGPSLIR

SEQ ID NO: 38621 - protein, 37 aa, Homo sapiens
MPIASEFAPDVVLVSSGFDAVEGHPTPLGGYNLSARC

SEQ ID NO: 38622 - protein, 14 aa, Homo sapiens
FMEQFTKLKDLFYR

SEQ ID NO: 38623 - protein, 14 aa, Homo sapiens
LHSCLPADTLQGHR

SEQ ID NO: 38624 - protein, 14 aa, Homo sapiens
VTSLKVYNWFANRR

SEQ ID NO: 38625 - protein, 6 aa, Homo sapiens
WYQLEK

SEQ ID NO: 38626 - protein, 19 aa, Homo sapiens
EYFGAFGEIENIELPMDTK

SEQ ID NO: 38627 - protein, 10 aa, Homo sapiens
FGEVVDCTIK

SEQ ID NO: 38628 - protein, 15 aa, Homo sapiens
GFCFITYTDEEPVKK

SEQ ID NO: 38629 - protein, 16 aa, Homo sapiens
VFVGGLSPDTSEEQIK

SEQ ID NO: 38630 - protein, 35 aa, Homo sapiens
VFVGGLSPDTSEEQIKEYFGAFGEIENIELPMDTK

SEQ ID NO: 38631 - protein, 9 aa, Homo sapiens
ALLPHVLCK

SEQ ID NO: 38632 - protein, 13 aa, Homo sapiens
DLLVQQASQCLSK

SEQ ID NO: 38633 - protein, 13 aa, Homo sapiens
DWQSYYYHHPQDR

SEQ ID NO: 38634 - protein, 22 aa, Homo sapiens
EEPFFPPPEEFVFIHAVPVEER

SEQ ID NO: 38635 - protein, 11 aa, Homo sapiens
NCVVELNFGQK

SEQ ID NO: 38636 - protein, 15 aa, Homo sapiens
NFILDQCNVYNSGQR

SEQ ID NO: 38637 - protein, 17 aa, Homo sapiens
PPPEEFVFIHAVPVEER

SEQ ID NO: 38638 - protein, 54 aa, Homo sapiens
SELQRRGLDSRGLKVDLAQRLQEALDAEMLEDEAGGGGAGPGGACKAEPRPVAA

SEQ ID NO: 38639 - protein, 14 aa, Homo sapiens
KPTLDKPSPETFVK

SEQ ID NO: 38640 - protein, 15 aa, Homo sapiens
TFVDFFSQCLHEEYR

SEQ ID NO: 38641 - protein, 7 aa, Homo sapiens
ALLFVPR

SEQ ID NO: 38642 - protein, 9 aa, Homo sapiens
APFDLFENR

SEQ ID NO: 38643 - protein, 11 aa, Homo sapiens
DNSTMGYMAAK

SEQ ID NO: 38644 - protein, 11 aa, Homo sapiens
DQVANSAFVER

SEQ ID NO: 38645 - protein, 18 aa, Homo sapiens
EGLELPEDEEEKKKQEEK

SEQ ID NO: 38646 - protein, 10 aa, Homo sapiens
ELHINLIPNK

SEQ ID NO: 38647 - protein, 12 aa, Homo sapiens
ELISNSSDALDK

SEQ ID NO: 38648 - protein, 14 aa, Homo sapiens
ELISNSSDALDKIR

SEQ ID NO: 38649 - protein, 7 aa, Homo sapiens
FYEQFSK

SEQ ID NO: 38650 - protein, 10 aa, Homo sapiens
HIYYITGETK

SEQ ID NO: 38651 - protein, 15 aa, Homo sapiens
HLEINPDHSIIETLR

SEQ ID NO: 38652 - protein, 15 aa, Homo sapiens
HSQFIGYPITLFVEK

SEQ ID NO: 38653 - protein, 17 aa, Homo sapiens
HSQFIGYPITLFVEKER

SEQ ID NO: 38654 - protein, 16 aa, Homo sapiens
KHLEINPDHSIIETLR

SEQ ID NO: 38655 - protein, 10 aa, Homo sapiens
LGIHEDSQNR

SEQ ID NO: 38656 - protein, 21 aa, Homo sapiens
LVTSPCCIVTSTYGWTANMER

SEQ ID NO: 38657 - protein, 15 aa, Homo sapiens
NPDDITNEEYGEFYK

SEQ ID NO: 38658 - protein, 10 aa, Homo sapiens
RAPFDLFENR

SEQ ID NO: 38659 - protein, 13 aa, Homo sapiens
TLTIVDTGIGMTK

SEQ ID NO: 38660 - protein, 15 aa, Homo sapiens
FRDLEEDPYLPGNPR

SEQ ID NO: 38661 - protein, 9 aa, Homo sapiens
LYDFNSYWR

SEQ ID NO: 38662 - protein, 12 aa, Homo sapiens
QSTEQAIQLLEK

SEQ ID NO: 38663 - protein, 23 aa, Homo sapiens
REDVQALNISVPYGPIPVDFQRK

SEQ ID NO: 38664 - protein, 16 aa, Homo sapiens
RVHAGNFSTIPQYFKE

SEQ ID NO: 38665 - protein, 10 aa, Homo sapiens
TASLPEAGEK

SEQ ID NO: 38666 - protein, 18 aa, Homo sapiens
EEHEVAVLGAPPSTILPR

SEQ ID NO: 38667 - protein, 17 aa, Homo sapiens
KMVGDVTGAQAYASTAK

SEQ ID NO: 38668 - protein, 21 aa, Homo sapiens
MHKEEHEVAVLGAPPSTILPR

SEQ ID NO: 38669 - protein, 16 aa, Homo sapiens
MVGDVTGAQAYASTAK

SEQ ID NO: 38670 - protein, 23 aa, Homo sapiens
ALTGGIGFIHHNCTPEFQANEVR

SEQ ID NO: 38671 - protein, 20 aa, Homo sapiens
DIDFLKEEEHDCFLEEIMTK

SEQ ID NO: 38672 - protein, 20 aa, Homo sapiens
DKYPNLQVIGGNVVTAAQAK

SEQ ID NO: 38673 - protein, 13 aa, Homo sapiens
EDLVVAPAGITLK

SEQ ID NO: 38674 - protein, 19 aa, Homo sapiens
FGVPVIADGGIQNVGHIAK

SEQ ID NO: 38675 - protein, 19 aa, Homo sapiens
FVPYLIAGIQHSCQDIGAK

SEQ ID NO: 38676 - protein, 13 aa, Homo sapiens
HGFCGIPITDTGR

SEQ ID NO: 38677 - protein, 15 aa, Homo sapiens
IHHNCTPEFQANEVR

SEQ ID NO: 38678 - protein, 19 aa, Homo sapiens
IKVAQGVSGAVQDKGSIHK

SEQ ID NO: 38679 - protein, 18 aa, Homo sapiens
KQLLCGAAIGTHEDDKYR

SEQ ID NO: 38680 - protein, 16 aa, Homo sapiens
KYEQGFITDPVVLSPK

SEQ ID NO: 38681 - protein, 15 aa, Homo sapiens
LIAGIQHSCQDIGAK

SEQ ID NO: 38682 - protein, 16 aa, Homo sapiens
LPIVNEDDELVAIIAR

SEQ ID NO: 38683 - protein, 11 aa, Homo sapiens
NLIDAGVDALR

SEQ ID NO: 38684 - protein, 16 aa, Homo sapiens
PVIADGGIQNVGHIAK

SEQ ID NO: 38685 - protein, 17 aa, Homo sapiens
QLLCGAAIGTHEDDKYR

SEQ ID NO: 38686 - protein, 14 aa, Homo sapiens
REDLVVAPAGITLK

SEQ ID NO: 38687 - protein, 21 aa, Homo sapiens
TGGIGFIHHNCTPEFQANEVR

SEQ ID NO: 38688 - protein, 18 aa, Homo sapiens
TSSAQVEGGVHSLHSYEK

SEQ ID NO: 38689 - protein, 12 aa, Homo sapiens
VAQGVSGAVQDK

SEQ ID NO: 38690 - protein, 27 aa, Homo sapiens
VGMGSGSICITQEVLACGRPQATAVYK

SEQ ID NO: 38691 - protein, 9 aa, Homo sapiens
DAFADAVQR

SEQ ID NO: 38692 - protein, 9 aa, Homo sapiens
HSVGVVIGR

SEQ ID NO: 38693 - protein, 22 aa, Homo sapiens
IGGDAATTVNNSTPDFGFGGQK

SEQ ID NO: 38694 - protein, 18 aa, Homo sapiens
IGQQPQQPGAPPQQDYTK

SEQ ID NO: 38695 - protein, 21 aa, Homo sapiens
KLASQGDSISSQLGPIHPPPR

SEQ ID NO: 38696 - protein, 20 aa, Homo sapiens
LASQGDSISSQLGPIHPPPR

SEQ ID NO: 38697 - protein, 18 aa, Homo sapiens
MILIQDGSQNTNVDKPLR

SEQ ID NO: 38698 - protein, 32 aa, Homo sapiens
PPPGPPPPAGGGGGAGGAGGGPPPGPPGAGDR

SEQ ID NO: 38699 - protein, 38 aa, Homo sapiens
YYQQPPGPVPGPAPAPAAPPAQGEPPQPPPTGQSDYTK

SEQ ID NO: 38700 - protein, 22 aa, Homo sapiens
KSPDTFMIPMALPNDNGSVSGV

SEQ ID NO: 38701 - protein, 38 aa, Homo sapiens
DDIGCGAPGCAACGGAHEGPALEPQPQDPASSVCPQPH

SEQ ID NO: 38702 - protein, 28 aa, Homo sapiens
ETETEVLLLEHDVPHQPFSQAVLSFLPK

SEQ ID NO: 38703 - protein, 16 aa, Homo sapiens
FHMDSETHDPIDLQTK

SEQ ID NO: 38704 - protein, 22 aa, Homo sapiens
HLCICSVDPPGCTDIDDALHCR

SEQ ID NO: 38705 - protein, 21 aa, Homo sapiens
FNEHMTNSTMSPGTVGQSLKS

SEQ ID NO: 38706 - protein, 25 aa, Homo sapiens
KQLNVQMNMSNVMGNTTWTTSGLKS

SEQ ID NO: 38707 - protein, 18 aa, Homo sapiens
KVNDSVPFHLGWNSTERS

SEQ ID NO: 38708 - protein, 15 aa, Homo sapiens
RVGYQSQNISCFFRL

SEQ ID NO: 38709 - protein, 14 aa, Homo sapiens
AGFGNNFTTVDNKS

SEQ ID NO: 38710 - protein, 20 aa, Homo sapiens
DWVCALGVVPDHPVLLSGCR

SEQ ID NO: 38711 - protein, 33 aa, Homo sapiens
TLTSSGQVTLGDACSASTSRTVAIPSGENQINQ

SEQ ID NO: 38712 - protein, 23 aa, Homo sapiens
RAGVVFMAGHVYAVGGFNGSLRV

SEQ ID NO: 38713 - protein, 12 aa, Homo sapiens
ADTLTDEINFLR

SEQ ID NO: 38714 - protein, 10 aa, Homo sapiens
AEAESWYQTK

SEQ ID NO: 38715 - protein, 17 aa, Homo sapiens
AIGGGLSSVGGGSSTIK

SEQ ID NO: 38716 - protein, 26 aa, Homo sapiens
AIGGGLSSVGGGSSTIKYTTTSSSSR

SEQ ID NO: 38717 - protein, 13 aa, Homo sapiens
ALYDAELSQMQTH

SEQ ID NO: 38718 - protein, 27 aa, Homo sapiens
ALYDAELSQMQTHISDTSVVLSMDNNR

SEQ ID NO: 38719 - protein, 9 aa, Homo sapiens
AQYEEIAQR

SEQ ID NO: 38720 - protein, 10 aa, Homo sapiens
DLDSIIAEVK

SEQ ID NO: 38721 - protein, 9 aa, Homo sapiens
DVDAAYMNK

SEQ ID NO: 38722 - protein, 7 aa, Homo sapiens
FASFIDK

SEQ ID NO: 38723 - protein, 9 aa, Homo sapiens
FASFIDKVR

SEQ ID NO: 38724 - protein, 10 aa, Homo sapiens
GMQDLVEDFK

SEQ ID NO: 38725 - protein, 17 aa, Homo sapiens
GSGGLGGACGGAGFGSR

SEQ ID NO: 38726 - protein, 14 aa, Homo sapiens
ISDTSVVLSMDNNR

SEQ ID NO: 38727 - protein, 17 aa, Homo sapiens
ISIGGGSCAISGGYGSR

SEQ ID NO: 38728 - protein, 16 aa, Homo sapiens
KQCANLQAAIADAEQR

SEQ ID NO: 38729 - protein, 8 aa, Homo sapiens
KYEDEINK

SEQ ID NO: 38730 - protein, 9 aa, Homo sapiens
KYEDEINKR

SEQ ID NO: 38731 - protein, 11 aa, Homo sapiens
LALDVEIATYR

SEQ ID NO: 38732 - protein, 10 aa, Homo sapiens
LEGLEDALQK

SEQ ID NO: 38733 - protein, 8 aa, Homo sapiens
LLEGEECR

SEQ ID NO: 38734 - protein, 12 aa, Homo sapiens
NKLEGLEDALQK

SEQ ID NO: 38735 - protein, 10 aa, Homo sapiens
NKYEDEINKR

SEQ ID NO: 38736 - protein, 12 aa, Homo sapiens
NLDLDSIIAEVK

SEQ ID NO: 38737 - protein, 21 aa, Homo sapiens
NLDLDSIIAEVKAQYEEIAQR

SEQ ID NO: 38738 - protein, 11 aa, Homo sapiens
PLFEQYINNLR

SEQ ID NO: 38739 - protein, 15 aa, Homo sapiens
QCANLQAAIADAEQR

SEQ ID NO: 38740 - protein, 9 aa, Homo sapiens
QLDSIVGER

SEQ ID NO: 38741 - protein, 15 aa, Homo sapiens
QNLEPLFEQYINNLR

SEQ ID NO: 38742 - protein, 17 aa, Homo sapiens
QSLLTPLNLQIDPTIQR

SEQ ID NO: 38743 - protein, 10 aa, Homo sapiens
SGFSSVSVSR

SEQ ID NO: 38744 - protein, 12 aa, Homo sapiens
SRAEAESWYQTK

SEQ ID NO: 38745 - protein, 22 aa, Homo sapiens
SRAEAESWYQTKYEELQVTAGR

SEQ ID NO: 38746 - protein, 19 aa, Homo sapiens
SRGSGGLGGACGGAGFGSR

SEQ ID NO: 38747 - protein, 18 aa, Homo sapiens
SYGSGLGVGGGFSSSSGR

SEQ ID NO: 38748 - protein, 11 aa, Homo sapiens
TAAENEFVTLK

SEQ ID NO: 38749 - protein, 12 aa, Homo sapiens
TAAENEFVTLKK

SEQ ID NO: 38750 - protein, 10 aa, Homo sapiens
WTLLQEQGTK

SEQ ID NO: 38751 - protein, 8 aa, Homo sapiens
YEDEINKR

SEQ ID NO: 38752 - protein, 10 aa, Homo sapiens
YEELQVTAGR

SEQ ID NO: 38753 - protein, 27 aa, Homo sapiens
AGQVLENLPPIGVFWDIENCSVPSGRS

SEQ ID NO: 38754 - protein, 12 aa, Homo sapiens
ETTLLLATSLGK

SEQ ID NO: 38755 - protein, 10 aa, Homo sapiens
HGFHIILVHK

SEQ ID NO: 38756 - protein, 18 aa, Homo sapiens
KLNVSDLYKLTDTVAIRE

SEQ ID NO: 38757 - protein, 25 aa, Homo sapiens
AGQMVTVWAAGAGVAHSPPSTLVWK

SEQ ID NO: 38758 - protein, 17 aa, Homo sapiens
DVMQQQLAEYQELLDVK

SEQ ID NO: 38759 - protein, 12 aa, Homo sapiens
KREGELTVAQGR

SEQ ID NO: 38760 - protein, 19 aa, Homo sapiens
CFPTLSDFLTEINSTVDKD

SEQ ID NO: 38761 - protein, 20 aa, Homo sapiens
CGQMTAVYLFSEALNAAQIF

SEQ ID NO: 38762 - protein, 20 aa, Homo sapiens
DSPVCPHFTTNGNENSSIEK

SEQ ID NO: 38763 - protein, 15 aa, Homo sapiens
HAEFESLCAQYSADK

SEQ ID NO: 38764 - protein, 16 aa, Homo sapiens
HAEFESLCAQYSADKR

SEQ ID NO: 38765 - protein, 17 aa, Homo sapiens
LINDCHGSVSEASSEQK

SEQ ID NO: 38766 - protein, 12 aa, Homo sapiens
TLEGPENCLKPK

SEQ ID NO: 38767 - protein, 30 aa, Homo sapiens
VEGSPTEEANLPTELQDNSLSPAASEAGEK

SEQ ID NO: 38768 - protein, 34 aa, Homo sapiens
WHNLPAHQGAVQDQPYQLPVEIDPLIASNTGMHR

SEQ ID NO: 38769 - protein, 15 aa, Homo sapiens
YLLQNTALEIFMANR

SEQ ID NO: 38770 - protein, 26 aa, Homo sapiens
DQPDGSSLSPAQSPSQSQPPAASSLR

SEQ ID NO: 38771 - protein, 18 aa, Homo sapiens
HVHPTTAPDVTSSLPEEK

SEQ ID NO: 38772 - protein, 22 aa, Homo sapiens
PIYGGWLLLAPDGTDFDNPVHR

SEQ ID NO: 38773 - protein, 20 aa, Homo sapiens
TLLTGDGGGEATGSPLAQGK

SEQ ID NO: 38774 - protein, 10 aa, Homo sapiens
ELAPLFEELR

SEQ ID NO: 38775 - protein, 16 aa, Homo sapiens
KLPSVEGLHAIVVSDR

SEQ ID NO: 38776 - protein, 15 aa, Homo sapiens
LPSVEGLHAIVVSDR

SEQ ID NO: 38777 - protein, 28 aa, Homo sapiens
VANDNAPEHALRPGFLSTFALATDQGSK

SEQ ID NO: 38778 - protein, 23 aa, Homo sapiens
KKNASSRPASAISGQNNNHSGNK

SEQ ID NO: 38779 - protein, 15 aa, Homo sapiens
AQIALEEASQQLAGK

SEQ ID NO: 38780 - protein, 10 aa, Homo sapiens
YIHSANVLHR

SEQ ID NO: 38781 - protein, 21 aa, Homo sapiens
KDTQNQNITLDCEGATNKMKS

SEQ ID NO: 38782 - protein, 28 aa, Homo sapiens
KEMNKSDLNTNNLLFKPPVESHIQKNKK

SEQ ID NO: 38783 - protein, 20 aa, Homo sapiens
RENMSDGDTSATESGDEVPV

SEQ ID NO: 38784 - protein, 19 aa, Homo sapiens
ADAEDLLDSFLSNILQDCR

SEQ ID NO: 38785 - protein, 15 aa, Homo sapiens
ETLPLLLQHLWQVNR

SEQ ID NO: 38786 - protein, 12 aa, Homo sapiens
FAEFLLPLLIEK

SEQ ID NO: 38787 - protein, 19 aa, Homo sapiens
HLCCLQALSAVSTHPSIVK

SEQ ID NO: 38788 - protein, 27 aa, Homo sapiens
KSGNYTVLQVVEALGSSLENPEPRTRA

SEQ ID NO: 38789 - protein, 23 aa, Homo sapiens
SGNYTVLQVVEALGSSLENPEPR

SEQ ID NO: 38790 - protein, 18 aa, Homo sapiens
VEAEGLAALHSLTACLSR

SEQ ID NO: 38791 - protein, 19 aa, Homo sapiens
AASPQDLAGGYTSSLACHR

SEQ ID NO: 38792 - protein, 7 aa, Homo sapiens
DKEVEIR

SEQ ID NO: 38793 - protein, 26 aa, Homo sapiens
EYNDFLEEVEEIVFNLTNNVDLDNTK

SEQ ID NO: 38794 - protein, 31 aa, Homo sapiens
ELYERPPHLFAIADAAYKAMKRRSKDTCIVI

SEQ ID NO: 38795 - protein, 17 aa, Homo sapiens
HLQVNVTNPVQCSLHGK

SEQ ID NO: 38796 - protein, 16 aa, Homo sapiens
SKDTCIVISGESGAGK

SEQ ID NO: 38797 - protein, 9 aa, Homo sapiens
YMDINFDFK

SEQ ID NO: 38798 - protein, 11 aa, Homo sapiens
AGEQDATIHLK

SEQ ID NO: 38799 - protein, 10 aa, Homo sapiens
AVGEEVWHSK

SEQ ID NO: 38800 - protein, 18 aa, Homo sapiens
CVVTGEDGSESEATVNVK

SEQ ID NO: 38801 - protein, 11 aa, Homo sapiens
FFLCQVAGDAK

SEQ ID NO: 38802 - protein, 12 aa, Homo sapiens
FIVLSNNYLQIR

SEQ ID NO: 38803 - protein, 12 aa, Homo sapiens
GLGEISAASEFK

SEQ ID NO: 38804 - protein, 35 aa, Homo sapiens
KITYVENQTAMELEEQVTLTCEASGDPIPSITWRT

SEQ ID NO: 38805 - protein, 32 aa, Homo sapiens
KIYNTPSASYLEVTPDSENDFGNYNCTAVNRI

SEQ ID NO: 38806 - protein, 18 aa, Homo sapiens
LEGQMGEDGNSIKVNLIK

SEQ ID NO: 38807 - protein, 16 aa, Homo sapiens
RDGQLLPSSNYSNIKI

SEQ ID NO: 38808 - protein, 34 aa, Homo sapiens
RQNIVNATANLGQSVTLVCDAEGFPEPTMSWTKD

SEQ ID NO: 38809 - protein, 11 aa, Homo sapiens
ALSSEWKPEIR

SEQ ID NO: 38810 - protein, 19 aa, Homo sapiens
ASWTRPEKQETLDGHMVVR

SEQ ID NO: 38811 - protein, 14 aa, Homo sapiens
DGQLLPSSNYSNIK

SEQ ID NO: 38812 - protein, 17 aa, Homo sapiens
KVDKNDEAEYICIAENK

SEQ ID NO: 38813 - protein, 28 aa, Homo sapiens
KVDKNDEAEYICIAENKAGEQDATIHLK

SEQ ID NO: 38814 - protein, 18 aa, Homo sapiens
LQVDIVPSQGEISVGESK

SEQ ID NO: 38815 - protein, 21 aa, Homo sapiens
SSTAQVQFDEPEATGGVPILK

SEQ ID NO: 38816 - protein, 13 aa, Homo sapiens
YIFSDDSSQLTIK

SEQ ID NO: 38817 - protein, 29 aa, Homo sapiens
MIPCVLQYLNFSTIIGVGVGAGAYILARY

SEQ ID NO: 38818 - protein, 22 aa, Homo sapiens
HISPSAKPFENGQYLDIYGITR

SEQ ID NO: 38819 - protein, 17 aa, Homo sapiens
KLFNGQQGIIIQNFSTR

SEQ ID NO: 38820 - protein, 18 aa, Homo sapiens
KLFNGQQGIIIQNFSTRS

SEQ ID NO: 38821 - protein, 34 aa, Homo sapiens
MMVRKGDTAVLRCYLEDGASKGAWLNRSSIIFAG

SEQ ID NO: 38822 - protein, 15 aa, Homo sapiens
PTIQEIKSGTVTPGR

SEQ ID NO: 38823 - protein, 25 aa, Homo sapiens
RSILTVTNVTQEHFGNYTCVAANKL

SEQ ID NO: 38824 - protein, 16 aa, Homo sapiens
SSIIFAGGDKWSVDPR

SEQ ID NO: 38825 - protein, 15 aa, Homo sapiens
VKVVVNFAPTIQEIK

SEQ ID NO: 38826 - protein, 23 aa, Homo sapiens
VKVVVNFAPTIQEIKSGTVTPGR

SEQ ID NO: 38827 - protein, 13 aa, Homo sapiens
VVVNFAPTIQEIK

SEQ ID NO: 38828 - protein, 15 aa, Homo sapiens
ARSGSAPQSPGASIR

SEQ ID NO: 38829 - protein, 27 aa, Homo sapiens
AYAASPTSITVTWETPVSGNGEIQNYK

SEQ ID NO: 38830 - protein, 7 aa, Homo sapiens
DVTVVSK

SEQ ID NO: 38831 - protein, 10 aa, Homo sapiens
DVVASLVSTR

SEQ ID NO: 38832 - protein, 11 aa, Homo sapiens
EHNLQVLGLVK

SEQ ID NO: 38833 - protein, 12 aa, Homo sapiens
GMGPMSEAVQFR

SEQ ID NO: 38834 - protein, 21 aa, Homo sapiens
GTDKEQDVDVSSHSYTINGLK

SEQ ID NO: 38835 - protein, 22 aa, Homo sapiens
GTDKEQDVDVSSHSYTINGLKK

SEQ ID NO: 38836 - protein, 17 aa, Homo sapiens
GYAIGYGIGSPHAQTIK

SEQ ID NO: 38837 - protein, 13 aa, Homo sapiens
HGPGVSTPDVAVR

SEQ ID NO: 38838 - protein, 11 aa, Homo sapiens
HGSGESSAPLR

SEQ ID NO: 38839 - protein, 28 aa, Homo sapiens
HGSGESSAPLRVETQPEVQLPGPAPNLR

SEQ ID NO: 38840 - protein, 10 aa, Homo sapiens
ITWADNSLPK

SEQ ID NO: 38841 - protein, 14 aa, Homo sapiens
IVKEHNLQVLGLVK

SEQ ID NO: 38842 - protein, 22 aa, Homo sapiens
KLPSGMLVISNATEGDGGLYRC

SEQ ID NO: 38843 - protein, 30 aa, Homo sapiens
KNANATTLSYLVTGLKPNTLYEFSVMVTKG

SEQ ID NO: 38844 - protein, 8 aa, Homo sapiens
LIVAGLPR

SEQ ID NO: 38845 - protein, 12 aa, Homo sapiens
NEEALDTESSER

SEQ ID NO: 38846 - protein, 12 aa, Homo sapiens
NGDMVIPSDYFK

SEQ ID NO: 38847 - protein, 17 aa, Homo sapiens
QLLPDGSLFISNVVHSK

SEQ ID NO: 38848 - protein, 8 aa, Homo sapiens
QPLLLDDR

SEQ ID NO: 38849 - protein, 30 aa, Homo sapiens
RERVENTSHPGEMQVTIQNLMPATVYIFRV

SEQ ID NO: 38850 - protein, 19 aa, Homo sapiens
RGSSVILNCSAYSEPSPKI

SEQ ID NO: 38851 - protein, 20 aa, Homo sapiens
RTLSDVPSAAPQNLSLEVRN

SEQ ID NO: 38852 - protein, 21 aa, Homo sapiens
RTPASDPHGDNLTYSVFYTKE

SEQ ID NO: 38853 - protein, 28 aa, Homo sapiens
RVENTSHPGEMQVTIQNLMPATVYIFRV

SEQ ID NO: 38854 - protein, 13 aa, Homo sapiens
SGSAPQSPGASIR

SEQ ID NO: 38855 - protein, 22 aa, Homo sapiens
SIMIHWQPPAPATQNGQITGYK

SEQ ID NO: 38856 - protein, 20 aa, Homo sapiens
SRPPMPVVVPSAPEVQETTR

SEQ ID NO: 38857 - protein, 15 aa, Homo sapiens
TIIVNWQPPSEANGK

SEQ ID NO: 38858 - protein, 18 aa, Homo sapiens
TLSDVPSAAPQNLSLEVR

SEQ ID NO: 38859 - protein, 17 aa, Homo sapiens
VETQPEVQLPGPAPNLR

SEQ ID NO: 38860 - protein, 21 aa, Homo sapiens
VIGQDVVLPCVASGLPTPTIK

SEQ ID NO: 38861 - protein, 15 aa, Homo sapiens
VLPDPEVISDLVFLK

SEQ ID NO: 38862 - protein, 13 aa, Homo sapiens
WEQNRQPLLLDDR

SEQ ID NO: 38863 - protein, 15 aa, Homo sapiens
WMKNEEALDTESSER

SEQ ID NO: 38864 - protein, 8 aa, Homo sapiens
YSDEVELK

SEQ ID NO: 38865 - protein, 7 aa, Homo sapiens
YTEYSFR

SEQ ID NO: 38866 - protein, 18 aa, Homo sapiens
YYTIENLDPSSHYVITLK

SEQ ID NO: 38867 - protein, 11 aa, Homo sapiens
ALMQVVDFLSR

SEQ ID NO: 38868 - protein, 18 aa, Homo sapiens
TEILSLEKPLLLHTGMGR

SEQ ID NO: 38869 - protein, 11 aa, Homo sapiens
ANHEEVLAAGK

SEQ ID NO: 38870 - protein, 15 aa, Homo sapiens
DHINLPGFSGQNPLR

SEQ ID NO: 38871 - protein, 10 aa, Homo sapiens
FEVGDIMLIR

SEQ ID NO: 38872 - protein, 14 aa, Homo sapiens
FGDRFPAMSDAYDR

SEQ ID NO: 38873 - protein, 11 aa, Homo sapiens
FHMYEGYPLWK

SEQ ID NO: 38874 - protein, 19 aa, Homo sapiens
HRPQVAIICGSGLGGLTDK

SEQ ID NO: 38875 - protein, 18 aa, Homo sapiens
LGADAVGMSTVPEVIVAR

SEQ ID NO: 38876 - protein, 9 aa, Homo sapiens
LVFGFLNGR

SEQ ID NO: 38877 - protein, 22 aa, Homo sapiens
MENGYTYEDYKNTAEWLLSHTK

SEQ ID NO: 38878 - protein, 11 aa, Homo sapiens
NTAEWLLSHTK

SEQ ID NO: 38879 - protein, 9 aa, Homo sapiens
STVPGHAGR

SEQ ID NO: 38880 - protein, 10 aa, Homo sapiens
VFGFSLITNK

SEQ ID NO: 38881 - protein, 22 aa, Homo sapiens
VFHLLGVDTLVVTNAAGGLNPK

SEQ ID NO: 38882 - protein, 10 aa, Homo sapiens
VIMDYESLEK

SEQ ID NO: 38883 - protein, 18 aa, Homo sapiens
VLAPQISFAPEIASEEER

SEQ ID NO: 38884 - protein, 14 aa, Homo sapiens
DCSQEDNNVEGLAH

SEQ ID NO: 38885 - protein, 17 aa, Homo sapiens
LPDLISDALFCNGQIER

SEQ ID NO: 38886 - protein, 14 aa, Homo sapiens
RNTTLFIDQVEAKW

SEQ ID NO: 38887 - protein, 17 aa, Homo sapiens
RVNSSQVLPVDSGEVKL

SEQ ID NO: 38888 - protein, 22 aa, Homo sapiens
KNRSTASIQPTSDDLVSSAECS

SEQ ID NO: 38889 - protein, 19 aa, Homo sapiens
ELFSPLHALNFGIGGDTTR

SEQ ID NO: 38890 - protein, 20 aa, Homo sapiens
ICKPLHELIMQLLEETPEEK

SEQ ID NO: 38891 - protein, 17 aa, Homo sapiens
PLHELIMQLLEETPEEK

SEQ ID NO: 38892 - protein, 20 aa, Homo sapiens
SVHCQAGDTVGEGDLLVELE

SEQ ID NO: 38893 - protein, 14 aa, Homo sapiens
YSSAGTVEFLVDSK

SEQ ID NO: 38894 - protein, 18 aa, Homo sapiens
FMGSSLGTGLGTLGNTIR

SEQ ID NO: 38895 - protein, 29 aa, Homo sapiens
GSHVHSGPTSAGSSSVPSPGQPGSPSVSK

SEQ ID NO: 38896 - protein, 11 aa, Homo sapiens
IPSDQVFPIAR

SEQ ID NO: 38897 - protein, 33 aa, Homo sapiens
KYRETKSQESEELVVTGGGGLRRFKTIELNSTI

SEQ ID NO: 38898 - protein, 9 aa, Homo sapiens
QPPSQGLPK

SEQ ID NO: 38899 - protein, 19 aa, Homo sapiens
AEDNADTLALVFEAPNQEK

SEQ ID NO: 38900 - protein, 15 aa, Homo sapiens
DLSHIGDAVVISCAK

SEQ ID NO: 38901 - protein, 21 aa, Homo sapiens
LMDLDVEQLGIPEQEYSCVVK

SEQ ID NO: 38902 - protein, 29 aa, Homo sapiens
LSQTSNVDKEEEAVTIEMNEPVQLTFALR

SEQ ID NO: 38903 - protein, 18 aa, Homo sapiens
RCDRNLAMGVNLTSMSKI

SEQ ID NO: 38904 - protein, 25 aa, Homo sapiens
KEMYQPEDDNNSDVTSDDDMTRNRR

SEQ ID NO: 38905 - protein, 16 aa, Homo sapiens
ADNFEYSDPVDGSISR

SEQ ID NO: 38906 - protein, 23 aa, Homo sapiens
AIGGIILTASHNPGGPNGDFGIK

SEQ ID NO: 38907 - protein, 8 aa, Homo sapiens
EAIQLIAR

SEQ ID NO: 38908 - protein, 10 aa, Homo sapiens
FFGNLMDASK

SEQ ID NO: 38909 - protein, 16 aa, Homo sapiens
FNISNGGPAPEAITDK

SEQ ID NO: 38910 - protein, 30 aa, Homo sapiens
HGFFVNPSDSVAVIAANIFSIPYFQQTGVR

SEQ ID NO: 38911 - protein, 9 aa, Homo sapiens
IAAANGIGR

SEQ ID NO: 38912 - protein, 11 aa, Homo sapiens
IALYETPTGWK

SEQ ID NO: 38913 - protein, 13 aa, Homo sapiens
IDAMHGVVGPYVK

SEQ ID NO: 38914 - protein, 18 aa, Homo sapiens
INQDPQVMLAPLISIALK

SEQ ID NO: 38915 - protein, 18 aa, Homo sapiens
KFNISNGGPAPEAITDKI

SEQ ID NO: 38916 - protein, 12 aa, Homo sapiens
LSGTGSAGATIR

SEQ ID NO: 38917 - protein, 17 aa, Homo sapiens
LSLCGEESFGTGSDHIR

SEQ ID NO: 38918 - protein, 19 aa, Homo sapiens
LVIGQNGILSTPAVSCIIR

SEQ ID NO: 38919 - protein, 12 aa, Homo sapiens
LYIDSYEKDVAK

SEQ ID NO: 38920 - protein, 12 aa, Homo sapiens
TIEEYAVCPDLK

SEQ ID NO: 38921 - protein, 15 aa, Homo sapiens
TQAYQDQKPGTSGLR

SEQ ID NO: 38922 - protein, 8 aa, Homo sapiens
VDLGVLGK

SEQ ID NO: 38923 - protein, 25 aa, Homo sapiens
VFQSSANYAENFIQSIISTVEPAQR

SEQ ID NO: 38924 - protein, 13 aa, Homo sapiens
YDYEEVEAEGANK

SEQ ID NO: 38925 - protein, 17 aa, Homo sapiens
RLYGLTMNPLIYNITRV

SEQ ID NO: 38926 - protein, 25 aa, Homo sapiens
AFSSLNTLPEELRPYVPLFCSVLTK

SEQ ID NO: 38927 - protein, 17 aa, Homo sapiens
EFQITCGPDSFATDPSK

SEQ ID NO: 38928 - protein, 14 aa, Homo sapiens
FFTYGNFPLEQHLK

SEQ ID NO: 38929 - protein, 14 aa, Homo sapiens
GMDHFLYGLSDEMK

SEQ ID NO: 38930 - protein, 21 aa, Homo sapiens
IHGFTVNQVTSVPELFLTAVK

SEQ ID NO: 38931 - protein, 16 aa, Homo sapiens
LEHENPSDPQTPLVFK

SEQ ID NO: 38932 - protein, 27 aa, Homo sapiens
LLPDHTYSVVSGGDPLCIPELTWEQLK

SEQ ID NO: 38933 - protein, 16 aa, Homo sapiens
SQQSKPQDASCLPALK

SEQ ID NO: 38934 - protein, 17 aa, Homo sapiens
THFLMPFPVNYVGECIR

SEQ ID NO: 38935 - protein, 24 aa, Homo sapiens
TVEKPVPSSSGGDAHVPHGSQVIR

SEQ ID NO: 38936 - protein, 12 aa, Homo sapiens
LKEQVQASREDK

SEQ ID NO: 38937 - protein, 30 aa, Homo sapiens
RCFLQLQPDNSTLTWVKPTTASPASSKAKL

SEQ ID NO: 38938 - protein, 10 aa, Homo sapiens
VHFEDLVFLR

SEQ ID NO: 38939 - protein, 31 aa, Homo sapiens
KERPISMINEASNYNVTSDYAVHPMSPVGRT

SEQ ID NO: 38940 - protein, 16 aa, Homo sapiens
TRPESICSVTPSTHDK

SEQ ID NO: 38941 - protein, 31 aa, Homo sapiens
YTLEQALLSASQEIEMHADNPAAIQTVVLQR

SEQ ID NO: 38942 - protein, 15 aa, Homo sapiens
DFSLTSSSQTPGATK

SEQ ID NO: 38943 - protein, 14 aa, Homo sapiens
GPQLLALVEEVLPR

SEQ ID NO: 38944 - protein, 20 aa, Homo sapiens
RSLEEIGIQNYSTTSSCQAR

SEQ ID NO: 38945 - protein, 19 aa, Homo sapiens
HWIASGQTLLQASQQDLEK

SEQ ID NO: 38946 - protein, 12 aa, Homo sapiens
IRDLEFCLEEHR

SEQ ID NO: 38947 - protein, 21 aa, Homo sapiens
IWDLNMENRPVETYQVHEYLR

SEQ ID NO: 38948 - protein, 14 aa, Homo sapiens
SFFSEIISSISDVK

SEQ ID NO: 38949 - protein, 36 aa, Homo sapiens
KLEALEQLQSHIEGWEGSNLTDICTQLLLQGTLLKI

SEQ ID NO: 38950 - protein, 22 aa, Homo sapiens
AITVFSPDGHLFQVEYAQEAVK

SEQ ID NO: 38951 - protein, 11 aa, Homo sapiens
ALLEVVQSGGK

SEQ ID NO: 38952 - protein, 11 aa, Homo sapiens
GRDIVVLGVEK

SEQ ID NO: 38953 - protein, 20 aa, Homo sapiens
ICALDDNVCMAFAGLTADAR

SEQ ID NO: 38954 - protein, 14 aa, Homo sapiens
LTVEDPVTVEYITR

SEQ ID NO: 38955 - protein, 14 aa, Homo sapiens
LYQTDPSGTYHAWK

SEQ ID NO: 38956 - protein, 8 aa, Homo sapiens
NIELAVMR

SEQ ID NO: 38957 - protein, 15 aa, Homo sapiens
NYTDEAIETDDLTIK

SEQ ID NO: 38958 - protein, 19 aa, Homo sapiens
RPFGISALIVGFDFDGTPR

SEQ ID NO: 38959 - protein, 19 aa, Homo sapiens
APFAAHGYGAFLTLSILDR

SEQ ID NO: 38960 - protein, 11 aa, Homo sapiens
FILNLPTFSVR

SEQ ID NO: 38961 - protein, 17 aa, Homo sapiens
IIDKNGIHDLDNISFPK

SEQ ID NO: 38962 - protein, 21 aa, Homo sapiens
ILLLCVGEAGDTVQFAEYIQK

SEQ ID NO: 38963 - protein, 17 aa, Homo sapiens
MRNGYELSPTAAANFTR

SEQ ID NO: 38964 - protein, 13 aa, Homo sapiens
NGIHDLDNISFPK

SEQ ID NO: 38965 - protein, 15 aa, Homo sapiens
NGYELSPTAAANFTR

SEQ ID NO: 38966 - protein, 8 aa, Homo sapiens
RNLADCLR

SEQ ID NO: 38967 - protein, 31 aa, Homo sapiens
TPYHVNLLLAGYDEHEGPALYYMDYLAALAK

SEQ ID NO: 38968 - protein, 10 aa, Homo sapiens
VAASNIVQMK

SEQ ID NO: 38969 - protein, 8 aa, Homo sapiens
YYTPTISR

SEQ ID NO: 38970 - protein, 19 aa, Homo sapiens
ATPQHTVSFTCESHGFSPR

SEQ ID NO: 38971 - protein, 22 aa, Homo sapiens
EDVHSQVICEVAHVTLQGDPLR

SEQ ID NO: 38972 - protein, 16 aa, Homo sapiens
IGNITPADAGTYYCVK

SEQ ID NO: 38973 - protein, 15 aa, Homo sapiens
LTCQVEHDGQPAVSK

SEQ ID NO: 38974 - protein, 14 aa, Homo sapiens
RAENQVNVTCQVRK

SEQ ID NO: 38975 - protein, 12 aa, Homo sapiens
RGTANLSETIRV

SEQ ID NO: 38976 - protein, 18 aa, Homo sapiens
RIGNITPADAGTYYCVKF

SEQ ID NO: 38977 - protein, 15 aa, Homo sapiens
RLQLTWLENGNVSRT

SEQ ID NO: 38978 - protein, 10 aa, Homo sapiens
VTTVSDLTKR

SEQ ID NO: 38979 - protein, 12 aa, Homo sapiens
EHASSLASSGLK

SEQ ID NO: 38980 - protein, 12 aa, Homo sapiens
KEECLKMESQLK

SEQ ID NO: 38981 - protein, 18 aa, Homo sapiens
LAEAEMHVHHLESLLEQK

SEQ ID NO: 38982 - protein, 10 aa, Homo sapiens
LEEKETMLNK

SEQ ID NO: 38983 - protein, 9 aa, Homo sapiens
QEEIDNYKK

SEQ ID NO: 38984 - protein, 11 aa, Homo sapiens
QTLNARDESIK

SEQ ID NO: 38985 - protein, 10 aa, Homo sapiens
TQEEVAALKR

SEQ ID NO: 38986 - protein, 12 aa, Homo sapiens
VEELLMAMEKVK

SEQ ID NO: 38987 - protein, 35 aa, Homo sapiens
DNAELQEFANAILQQIADHCPDILEQVVNALEESS

SEQ ID NO: 38988 - protein, 27 aa, Homo sapiens
SSHSNQTNHKPSPDQIIQPLLELDQNR

SEQ ID NO: 38989 - protein, 16 aa, Homo sapiens
TGEPCVAELTEENFQR

SEQ ID NO: 38990 - protein, 16 aa, Homo sapiens
RNFSSVAASSGNTTLN

SEQ ID NO: 38991 - protein, 13 aa, Homo sapiens
ALGNICYDSHEGR

SEQ ID NO: 38992 - protein, 18 aa, Homo sapiens
HVEDGNVTVQHAALSALR

SEQ ID NO: 38993 - protein, 19 aa, Homo sapiens
IPCVDAGLISPLVQLLNSK

SEQ ID NO: 38994 - protein, 32 aa, Homo sapiens
ITAVDKTEDSLEGCLDCLLQALAQNNTETSEK

SEQ ID NO: 38995 - protein, 19 aa, Homo sapiens
LQLVEAGLVECLLEIVQQK

SEQ ID NO: 38996 - protein, 26 aa, Homo sapiens
TEDSLEGCLDCLLQALAQNNTETSEK

SEQ ID NO: 38997 - protein, 17 aa, Homo sapiens
DLAALHEICVAHSDELR

SEQ ID NO: 38998 - protein, 18 aa, Homo sapiens
HFTNPYCNIYLNSVQVAK

SEQ ID NO: 38999 - protein, 21 aa, Homo sapiens
NEDVNTNLTHLLNILSELVEK

SEQ ID NO: 39000 - protein, 18 aa, Homo sapiens
NKEELACALVHILQSTGR

SEQ ID NO: 39001 - protein, 17 aa, Homo sapiens
NNYVGLVNIPTASVTGR

SEQ ID NO: 39002 - protein, 16 aa, Homo sapiens
RTKSQSKLDRNTSFRL

SEQ ID NO: 39003 - protein, 27 aa, Homo sapiens
RECFNIGNFNSMMAIISGMNLSPVARL

SEQ ID NO: 39004 - protein, 32 aa, Homo sapiens
RGPPSRGGHMDDGGYSMNFNMSSSRGPLPVKR

SEQ ID NO: 39005 - protein, 23 aa, Homo sapiens
KCNLCLAMNLQGRHKCIENVSRQ

SEQ ID NO: 39006 - protein, 8 aa, Homo sapiens
DLDLSHAR

SEQ ID NO: 39007 - protein, 16 aa, Homo sapiens
HDYILLPEDALTNTTR

SEQ ID NO: 39008 - protein, 20 aa, Homo sapiens
MVKNETFCAATPSAMIFGKS

SEQ ID NO: 39009 - protein, 17 aa, Homo sapiens
NPDFLKDDFEGQLESDR

SEQ ID NO: 39010 - protein, 21 aa, Homo sapiens
RAPSNVSTIIHILYLPEDAKG

SEQ ID NO: 39011 - protein, 19 aa, Homo sapiens
RELITTGLNTTTASVLQFS

SEQ ID NO: 39012 - protein, 18 aa, Homo sapiens
RHDYILLPEDALTNTTRL

SEQ ID NO: 39013 - protein, 10 aa, Homo sapiens
VSYNVPLEAR

SEQ ID NO: 39014 - protein, 15 aa, Homo sapiens
DYLHLPPEIVPATLR

SEQ ID NO: 39015 - protein, 15 aa, Homo sapiens
HFYWYLTNEGIQYLR

SEQ ID NO: 39016 - protein, 9 aa, Homo sapiens
IAIYELLFK

SEQ ID NO: 39017 - protein, 28 aa, Homo sapiens
KDPPSEANSIQSANATTKTSETNHTSRP

SEQ ID NO: 39018 - protein, 23 aa, Homo sapiens
KEHSEMSNNVSDPKGPPAKIARL

SEQ ID NO: 39019 - protein, 26 aa, Homo sapiens
RNGKPENNTMNINASIYDEIQQEMKR

SEQ ID NO: 39020 - protein, 23 aa, Homo sapiens
DVAWAPSIGLPTSTIASCSQDGR

SEQ ID NO: 39021 - protein, 15 aa, Homo sapiens
ESVDGQWVCISDVNK

SEQ ID NO: 39022 - protein, 11 aa, Homo sapiens
FASGGCDNLIK

SEQ ID NO: 39023 - protein, 33 aa, Homo sapiens
INNAHTIGCNAVSWAPAVVPGSLIDHPSGQKPN

SEQ ID NO: 39024 - protein, 36 aa, Homo sapiens
INNAHTIGCNAVSWAPAVVPGSLIDHPSGQKPNYIK

SEQ ID NO: 39025 - protein, 11 aa, Homo sapiens
NGGQILIADLR

SEQ ID NO: 39026 - protein, 17 aa, Homo sapiens
VFIWTCDDASSNTWSPK

SEQ ID NO: 39027 - protein, 22 aa, Homo sapiens
AVLSAEQLRDEEVHAGLGELLR

SEQ ID NO: 39028 - protein, 13 aa, Homo sapiens
DEEVHAGLGELLR

SEQ ID NO: 39029 - protein, 26 aa, Homo sapiens
DQAVENILVSPVVVASSLGLVSLGGK

SEQ ID NO: 39030 - protein, 11 aa, Homo sapiens
GVVEVTHDLQK

SEQ ID NO: 39031 - protein, 13 aa, Homo sapiens
HLAGLGLTEAIDK

SEQ ID NO: 39032 - protein, 13 aa, Homo sapiens
LFYADHPFIFLVR

SEQ ID NO: 39033 - protein, 17 aa, Homo sapiens
LSSLIILMPHHVEPLER

SEQ ID NO: 39034 - protein, 15 aa, Homo sapiens
LYGPSSVSFADDFVR

SEQ ID NO: 39035 - protein, 17 aa, Homo sapiens
SALQSINEWAAQTTDGK

SEQ ID NO: 39036 - protein, 19 aa, Homo sapiens
TDGALLVNAMFFKPHWDEK

SEQ ID NO: 39037 - protein, 18 aa, Homo sapiens
RLATIANFSALGLEPGRD

SEQ ID NO: 39038 - protein, 14 aa, Homo sapiens
RVPDAANLSSAWRN

SEQ ID NO: 39039 - protein, 21 aa, Homo sapiens
DLNPEDFWEIIGELGDGAFGK

SEQ ID NO: 39040 - protein, 11 aa, Homo sapiens
DLQLQCEANVR

SEQ ID NO: 39041 - protein, 21 aa, Homo sapiens
DVISNTSDVIGTCEAADVAQK

SEQ ID NO: 39042 - protein, 9 aa, Homo sapiens
ELHQLQNEK

SEQ ID NO: 39043 - protein, 36 aa, Homo sapiens
KDVISNTSDVIGTCEAADVAQKVDEDSAEDTQSNDG

SEQ ID NO: 39044 - protein, 22 aa, Homo sapiens
LENLPDTEDQETVDINSVSEGK

SEQ ID NO: 39045 - protein, 15 aa, Homo sapiens
LINKPMVGPEAGGTK

SEQ ID NO: 39046 - protein, 12 aa, Homo sapiens
RQYDQEIENLEK

SEQ ID NO: 39047 - protein, 22 aa, Homo sapiens
SEEIKDTILQTVDLVSQETGEK

SEQ ID NO: 39048 - protein, 21 aa, Homo sapiens
WTTSQLLQHPFVTVDSNKPIR

SEQ ID NO: 39049 - protein, 18 aa, Homo sapiens
KFTFSHSASAANGTNSKS

SEQ ID NO: 39050 - protein, 12 aa, Homo sapiens
KNNTICPGALRF

SEQ ID NO: 39051 - protein, 14 aa, Homo sapiens
HHNQPYCGIAPYIR

SEQ ID NO: 39052 - protein, 16 aa, Homo sapiens
MWDPHNDPNAQGDAFK

SEQ ID NO: 39053 - protein, 13 aa, Homo sapiens
YDERPGPSPLPHR

SEQ ID NO: 39054 - protein, 11 aa, Homo sapiens
EYVNGSNLITK

SEQ ID NO: 39055 - protein, 14 aa, Homo sapiens
TIIIHHEAIFPSPR

SEQ ID NO: 39056 - protein, 16 aa, Homo sapiens
APVPGTPDSLSSGSSR

SEQ ID NO: 39057 - protein, 21 aa, Homo sapiens
ASYGVEDPEYAVTQLAQTTMR

SEQ ID NO: 39058 - protein, 30 aa, Homo sapiens
DSNTILLPSNPGDVTSMVAQAMGVYGALTK

SEQ ID NO: 39059 - protein, 21 aa, Homo sapiens
ESLNASIVDAINQAADCWGIR

SEQ ID NO: 39060 - protein, 29 aa, Homo sapiens
ILAAALTQHNGDAAASLTVAEQYVSAFSK

SEQ ID NO: 39061 - protein, 15 aa, Homo sapiens
ILEPGLNILIPVLDR

SEQ ID NO: 39062 - protein, 17 aa, Homo sapiens
NTVVLFVPQQEAWVVER

SEQ ID NO: 39063 - protein, 15 aa, Homo sapiens
GGQTHLGLPVFNTVK

SEQ ID NO: 39064 - protein, 9 aa, Homo sapiens
IICQGFTGK

SEQ ID NO: 39065 - protein, 24 aa, Homo sapiens
ISALQSAGVVVSMSPAQLGTTIYK

SEQ ID NO: 39066 - protein, 16 aa, Homo sapiens
LIGPNCPGVINPGECK

SEQ ID NO: 39067 - protein, 12 aa, Homo sapiens
MGHAGAIIAGGK

SEQ ID NO: 39068 - protein, 34 aa, Homo sapiens
PPPFAAAAINEAIEAEIPLVVCITEGIPQQDMVR

SEQ ID NO: 39069 - protein, 24 aa, Homo sapiens
QHNSGPNSKPVVSFIAGLTAPPGR

SEQ ID NO: 39070 - protein, 15 aa, Homo sapiens
DIHNVSAILVSVGRC

SEQ ID NO: 39071 - protein, 16 aa, Homo sapiens
DIHNVSAILVSVGRCG

SEQ ID NO: 39072 - protein, 9 aa, Homo sapiens
DSEFETDCR

SEQ ID NO: 39073 - protein, 9 aa, Homo sapiens
EENIHSRMK

SEQ ID NO: 39074 - protein, 10 aa, Homo sapiens
EFAKPSKYIK

SEQ ID NO: 39075 - protein, 11 aa, Homo sapiens
ESKKLLTIILK

SEQ ID NO: 39076 - protein, 12 aa, Homo sapiens
FQFIIIEELENF

SEQ ID NO: 39077 - protein, 23 aa, Homo sapiens
IKPPLQMTSSAEKPSVSQTSENR

SEQ ID NO: 39078 - protein, 8 aa, Homo sapiens
KNTVKISK

SEQ ID NO: 39079 - protein, 18 aa, Homo sapiens
NICGNKIHSKWACWTPVT

SEQ ID NO: 39080 - protein, 14 aa, Homo sapiens
NSDKGNRNNSQLEK

SEQ ID NO: 39081 - protein, 23 aa, Homo sapiens
REGKELLLYFDASLEITNVTQKI

SEQ ID NO: 39082 - protein, 20 aa, Homo sapiens
RIYIEDNLSNSNEVEMEEKG

SEQ ID NO: 39083 - protein, 10 aa, Homo sapiens
SKPQLIDYSR

SEQ ID NO: 39084 - protein, 12 aa, Homo sapiens
AMMEEIAGFEDR

SEQ ID NO: 39085 - protein, 20 aa, Homo sapiens
ASLQDMSCQLLVNAEGTDCL

SEQ ID NO: 39086 - protein, 16 aa, Homo sapiens
CSLSQPGPSVSSPHSR

SEQ ID NO: 39087 - protein, 20 aa, Homo sapiens
EDVIPSGIPQAEDRALESLR

SEQ ID NO: 39088 - protein, 21 aa, Homo sapiens
FQGLESHMILTETLFRKIISF

SEQ ID NO: 39089 - protein, 13 aa, Homo sapiens
FQIQQTENIIRSK

SEQ ID NO: 39090 - protein, 6 aa, Homo sapiens
GEGEVK

SEQ ID NO: 39091 - protein, 10 aa, Homo sapiens
GQEILDALQK

SEQ ID NO: 39092 - protein, 7 aa, Homo sapiens
HIKELEK

SEQ ID NO: 39093 - protein, 33 aa, Homo sapiens
HYPDIHNASTDGQEDDEILPGFPSFANSVQNFK

SEQ ID NO: 39094 - protein, 26 aa, Homo sapiens
KGRSNRENLEDAFTIAETELGIPRLL

SEQ ID NO: 39095 - protein, 17 aa, Homo sapiens
LHDLQNILDSVSDGQSK

SEQ ID NO: 39096 - protein, 20 aa, Homo sapiens
LIAKSRELYEKTEDESFKDT

SEQ ID NO: 39097 - protein, 11 aa, Homo sapiens
LIHWLQSAKDR

SEQ ID NO: 39098 - protein, 7 aa, Homo sapiens
LMELDAA

SEQ ID NO: 39099 - protein, 9 aa, Homo sapiens
LPLNDKEIK

SEQ ID NO: 39100 - protein, 18 aa, Homo sapiens
LYDGVSATSTWLDDVEER

SEQ ID NO: 39101 - protein, 6 aa, Homo sapiens
MQNLNR

SEQ ID NO: 39102 - protein, 18 aa, Homo sapiens
QALQDCASELGSFEDQHR

SEQ ID NO: 39103 - protein, 11 aa, Homo sapiens
QNIEKMAEEQK

SEQ ID NO: 39104 - protein, 24 aa, Homo sapiens
RGLLQDALMQCQGFHEMSHGLLLM

SEQ ID NO: 39105 - protein, 20 aa, Homo sapiens
RVTIHLEDLAPHLDPLAYEK

SEQ ID NO: 39106 - protein, 13 aa, Homo sapiens
SGVAFHSVIHAIR

SEQ ID NO: 39107 - protein, 32 aa, Homo sapiens
SNRENLEDAFTIAETELGIPRLLDPEDVDVDK

SEQ ID NO: 39108 - protein, 20 aa, Homo sapiens
SPSPVANTDASVNQDIAYYQ

SEQ ID NO: 39109 - protein, 25 aa, Homo sapiens
TPRGKCSLSQPGPSVSSPHSRSTKG

SEQ ID NO: 39110 - protein, 16 aa, Homo sapiens
TPTGPELDTSYKGYMK

SEQ ID NO: 39111 - protein, 19 aa, Homo sapiens
TQFLMAVFQATSQIQQHER

SEQ ID NO: 39112 - protein, 26 aa, Homo sapiens
TWLAHIESELAKPIVYDSCNSEEIQR

SEQ ID NO: 39113 - protein, 16 aa, Homo sapiens
VLENASSVIVTRTTIK

SEQ ID NO: 39114 - protein, 16 aa, Homo sapiens
WLKSSERTAAFPSSSG

SEQ ID NO: 39115 - protein, 14 aa, Homo sapiens
WSDMSGDSSATQKK

SEQ ID NO: 39116 - protein, 11 aa, Homo sapiens
YSSLLETIEVK

SEQ ID NO: 39117 - protein, 18 aa, Homo sapiens
KSPSSFQFNWTEEDTDRT

SEQ ID NO: 39118 - protein, 27 aa, Homo sapiens
RSGTNHYSTSSCTPPANGTDSIMANRG

SEQ ID NO: 39119 - protein, 19 aa, Homo sapiens
ETKKHVLFGTVGVPEHTYR

SEQ ID NO: 39120 - protein, 15 aa, Homo sapiens
HVLFGTVGVPEHTYR

SEQ ID NO: 39121 - protein, 29 aa, Homo sapiens
KDEGTYTCALHHSGHSPPISSQNVTVLRD

SEQ ID NO: 39122 - protein, 16 aa, Homo sapiens
KHVLFGTVGVPEHTYR

SEQ ID NO: 39123 - protein, 19 aa, Homo sapiens
RHENTSSSPIQYEFSLTRE

SEQ ID NO: 39124 - protein, 10 aa, Homo sapiens
VLYLSAFTSK

SEQ ID NO: 39125 - protein, 14 aa, Homo sapiens
VTSLTACLVDQSLR

SEQ ID NO: 39126 - protein, 22 aa, Homo sapiens
KERIINYANSSDPTSGVSKRKS

SEQ ID NO: 39127 - protein, 16 aa, Homo sapiens
RIIIMCCANATGLHKL

SEQ ID NO: 39128 - protein, 12 aa, Homo sapiens
NRMYDVLQETIE

SEQ ID NO: 39129 - protein, 11 aa, Homo sapiens
QLYAYKMLMAK

SEQ ID NO: 39130 - protein, 17 aa, Homo sapiens
RSQQFSKMQNVSWYERN

SEQ ID NO: 39131 - protein, 21 aa, Homo sapiens
QPANSNNGTSTATSTNNNAKR

SEQ ID NO: 39132 - protein, 27 aa, Homo sapiens
RKTDNGTEAWGSSATQTFNSGACIDKT

SEQ ID NO: 39133 - protein, 16 aa, Homo sapiens
RNITIMASGNTGGEKD

SEQ ID NO: 39134 - protein, 31 aa, Homo sapiens
RVSTMNHPQMQAPSGMNGTSLSHLSNGESKS

SEQ ID NO: 39135 - protein, 22 aa, Homo sapiens
LKPDDSGVNIAEAAAQNVYCLR

SEQ ID NO: 39136 - protein, 20 aa, Homo sapiens
RDLNVSVTHLIAGEVGSKKY

SEQ ID NO: 39137 - protein, 23 aa, Homo sapiens
SLETEITNGINLNSDTAEHPGTR

SEQ ID NO: 39138 - protein, 25 aa, Homo sapiens
FGLAHLMALGLGPWLAVEIPDLIQK

SEQ ID NO: 39139 - protein, 13 aa, Homo sapiens
ICLTDHFKPLWAR

SEQ ID NO: 39140 - protein, 28 aa, Homo sapiens
YEFDIEFDIPITYPTTAPEIAVPELDGK

SEQ ID NO: 39141 - protein, 10 aa, Homo sapiens
AINTEFKNTR

SEQ ID NO: 39142 - protein, 16 aa, Homo sapiens
DGQVINETSQHHDDLE

SEQ ID NO: 39143 - protein, 21 aa, Homo sapiens
FLEQQNKILLAELEQLKGQGK

SEQ ID NO: 39144 - protein, 14 aa, Homo sapiens
ILLAELEQLKGQGK

SEQ ID NO: 39145 - protein, 13 aa, Homo sapiens
KVESLQEEIAFLK

SEQ ID NO: 39146 - protein, 12 aa, Homo sapiens
RQVDQLTNDKAR

SEQ ID NO: 39147 - protein, 12 aa, Homo sapiens
SLGSALRPSTSR

SEQ ID NO: 39148 - protein, 21 aa, Homo sapiens
TVETRDGQVINETSQHHDDLE

SEQ ID NO: 39149 - protein, 10 aa, Homo sapiens
CASGTMGSIK

SEQ ID NO: 39150 - protein, 9 aa, Homo sapiens
ICGDNLSTK

SEQ ID NO: 39151 - protein, 9 aa, Homo sapiens
LDVLEQELK

SEQ ID NO: 39152 - protein, 20 aa, Homo sapiens
WSEPFSVDHAGTFIRTIQYR

SEQ ID NO: 39153 - protein, 10 aa, Homo sapiens
AMDEIQPDLR

SEQ ID NO: 39154 - protein, 8 aa, Homo sapiens
ELMETMHR

SEQ ID NO: 39155 - protein, 10 aa, Homo sapiens
IKEDRPITIK

SEQ ID NO: 39156 - protein, 25 aa, Homo sapiens
MFHGIPATPGIGAPGNKPELYEEVK

SEQ ID NO: 39157 - protein, 15 aa, Homo sapiens
QMLFDLESAYNAFNR

SEQ ID NO: 39158 - protein, 15 aa, Homo sapiens
QVQGSEISSIDEFCR

SEQ ID NO: 39159 - protein, 12 aa, Homo sapiens
YDNMAELFAVVK

SEQ ID NO: 39160 - protein, 14 aa, Homo sapiens
RGLNSSFETSPKKV

SEQ ID NO: 39161 - protein, 12 aa, Homo sapiens
FCPHHLVNSESK

SEQ ID NO: 39162 - protein, 20 aa, Homo sapiens
LQHGLEGHTGCVNTLHFNQR

SEQ ID NO: 39163 - protein, 6 aa, Homo sapiens
VIKKNK

SEQ ID NO: 39164 - protein, 18 aa, Homo sapiens
AGAGPGGPPQKPAPSSQR

SEQ ID NO: 39165 - protein, 17 aa, Homo sapiens
LVHLPSCTVFSNFPVIK

SEQ ID NO: 39166 - protein, 14 aa, Homo sapiens
NCQHANAERPTVAR

SEQ ID NO: 39167 - protein, 10 aa, Homo sapiens
EVQLQAIVKK

SEQ ID NO: 39168 - protein, 10 aa, Homo sapiens
SKRTIQGTHK

SEQ ID NO: 39169 - protein, 16 aa, Homo sapiens
STAVMPKVSLATEATR

SEQ ID NO: 39170 - protein, 22 aa, Homo sapiens
DLCSTNGGFGHLAIFNSCLQTK

SEQ ID NO: 39171 - protein, 15 aa, Homo sapiens
TAHNLENVLIHFWER

SEQ ID NO: 39172 - protein, 14 aa, Homo sapiens
TLPSHLCTSALLSK

SEQ ID NO: 39173 - protein, 22 aa, Homo sapiens
RRAEMSQTNFTPDTLAQNEGKA

SEQ ID NO: 39174 - protein, 36 aa, Homo sapiens
TTERNETIPDIPVSVDNLQTHTVQTASVAEMGRRKW

SEQ ID NO: 39175 - protein, 12 aa, Homo sapiens
AIYTAMNTVLCK

SEQ ID NO: 39176 - protein, 11 aa, Homo sapiens
FLPLEADPEKK

SEQ ID NO: 39177 - protein, 17 aa, Homo sapiens
PPGTLLPSAHAIEREFR

SEQ ID NO: 39178 - protein, 18 aa, Homo sapiens
EDFATFDYILCMDESNLR

SEQ ID NO: 39179 - protein, 10 aa, Homo sapiens
HGIPMSHVAR

SEQ ID NO: 39180 - protein, 24 aa, Homo sapiens
QLIIEDPYYGNDSDFETVYQQCVR

SEQ ID NO: 39181 - protein, 18 aa, Homo sapiens
VDSAATSGYEIGNPPDYR

SEQ ID NO: 39182 - protein, 28 aa, Homo sapiens
RKLVTDQNISENWVIDSGAVSDWNVGRS

SEQ ID NO: 39183 - protein, 13 aa, Homo sapiens
AKPTSDKPGSPYR

SEQ ID NO: 39184 - protein, 21 aa, Homo sapiens
GVEGTWVDICNNPAMEAEILK

SEQ ID NO: 39185 - protein, 13 aa, Homo sapiens
GYDAPLCNLLLFK

SEQ ID NO: 39186 - protein, 21 aa, Homo sapiens
WFCTGDIGEFHPDGCLQIIDR

SEQ ID NO: 39187 - protein, 37 aa, Homo sapiens
KDISSSEMTNPSDTLNIETLLNGSVKRVSENNGNGKN

SEQ ID NO: 39188 - protein, 27 aa, Homo sapiens
EIFTSLEYGPVPESHACALAWLDTQDR

SEQ ID NO: 39189 - protein, 25 aa, Homo sapiens
ESGCSWHGGPDGLYEYLRPSGTPAR

SEQ ID NO: 39190 - protein, 33 aa, Homo sapiens
NSVPCQDPITGENLASCLQAQAEDVAAAVEAAR

SEQ ID NO: 39191 - protein, 7 aa, Homo sapiens
ADAETLR

SEQ ID NO: 39192 - protein, 8 aa, Homo sapiens
ADAETLRK

SEQ ID NO: 39193 - protein, 10 aa, Homo sapiens
ALLLLCGEDD

SEQ ID NO: 39194 - protein, 23 aa, Homo sapiens
DAGIDEAQVEQDAQALFQAGELK

SEQ ID NO: 39195 - protein, 7 aa, Homo sapiens
DLLDDLK

SEQ ID NO: 39196 - protein, 13 aa, Homo sapiens
DLLDDLKSELTGK

SEQ ID NO: 39197 - protein, 25 aa, Homo sapiens
DPDAGIDEAQVEQDAQALFQAGELK

SEQ ID NO: 39198 - protein, 15 aa, Homo sapiens
ETSGNLEQLLLAVVK

SEQ ID NO: 39199 - protein, 8 aa, Homo sapiens
FITIFGTR

SEQ ID NO: 39200 - protein, 11 aa, Homo sapiens
GAGTDDHTLIR

SEQ ID NO: 39201 - protein, 16 aa, Homo sapiens
GLGTDEESILTLLTSR

SEQ ID NO: 39202 - protein, 12 aa, Homo sapiens
GTVTDFPGFDER

SEQ ID NO: 39203 - protein, 19 aa, Homo sapiens
GTVTDFPGFDERADAETLR

SEQ ID NO: 39204 - protein, 12 aa, Homo sapiens
KNFATSLYSMIK

SEQ ID NO: 39205 - protein, 10 aa, Homo sapiens
LIVALMKPSR

SEQ ID NO: 39206 - protein, 8 aa, Homo sapiens
LYDAYELK

SEQ ID NO: 39207 - protein, 35 aa, Homo sapiens
MLVVLLQANRDPDAGIDEAQVEQDAQALFQAGELK

SEQ ID NO: 39208 - protein, 11 aa, Homo sapiens
NFATSLYSMIK

SEQ ID NO: 39209 - protein, 13 aa, Homo sapiens
PAYLAETLYYAMK

SEQ ID NO: 39210 - protein, 8 aa, Homo sapiens
QEISAAFK

SEQ ID NO: 39211 - protein, 25 aa, Homo sapiens
QVYEEEYGSSLEDDVVGDTSGYYQR

SEQ ID NO: 39212 - protein, 9 aa, Homo sapiens
SEIDLFNIR

SEQ ID NO: 39213 - protein, 10 aa, Homo sapiens
SEIDLFNIRK

SEQ ID NO: 39214 - protein, 15 aa, Homo sapiens
SIPAYLAETLYYAMK

SEQ ID NO: 39215 - protein, 9 aa, Homo sapiens
VLTEIIASR

SEQ ID NO: 39216 - protein, 15 aa, Homo sapiens
YMTISGFQIEETIDR

SEQ ID NO: 39217 - protein, 23 aa, Homo sapiens
MLISVESPNLTTPITSNPTDTRK

SEQ ID NO: 39218 - protein, 22 aa, Homo sapiens
RVFTEEAKDSLNTSENDSEHQT

SEQ ID NO: 39219 - protein, 36 aa, Homo sapiens
APVECPSLGPVPHRPPFEPGSAVATVPPYLGPDTPA

SEQ ID NO: 39220 - protein, 40 aa, Homo sapiens
TKPPTTPVGGGNLPSAPPPANFPHVTPNLPPPPALRPLNN

SEQ ID NO: 39221 - protein, 24 aa, Homo sapiens
KATFVKVVPTPNNGSTELVALHRN

SEQ ID NO: 39222 - protein, 13 aa, Homo sapiens
VLRTGFNTSQGKL

SEQ ID NO: 39223 - protein, 9 aa, Homo sapiens
EISTEEQLR

SEQ ID NO: 39224 - protein, 20 aa, Homo sapiens
GQEYINNIHLTHSLEECLVR

SEQ ID NO: 39225 - protein, 20 aa, Homo sapiens
LMKKLDILGDNANLTNEEQV

SEQ ID NO: 39226 - protein, 14 aa, Homo sapiens
TFIIGISGVTNSGK

SEQ ID NO: 39227 - protein, 14 aa, Homo sapiens
ICENPRFIIDGANR

SEQ ID NO: 39228 - protein, 20 aa, Homo sapiens
NMDNSLLQDSDLDPRGSDER

SEQ ID NO: 39229 - protein, 10 aa, Homo sapiens
QSEKDQYEEK

SEQ ID NO: 39230 - protein, 18 aa, Homo sapiens
ESSNDSTSVSAVASNMRD

SEQ ID NO: 39231 - protein, 25 aa, Homo sapiens
LWLALDYVVSNASVMNLLIISFDRY

SEQ ID NO: 39232 - protein, 9 aa, Homo sapiens
KPGSAGGPK

SEQ ID NO: 39233 - protein, 7 aa, Homo sapiens
LCEIFTR

SEQ ID NO: 39234 - protein, 18 aa, Homo sapiens
RNTGNGTQSSMGSPLTRP

SEQ ID NO: 39235 - protein, 18 aa, Homo sapiens
TILLLLLETLGDKEPTIR

SEQ ID NO: 39236 - protein, 10 aa, Homo sapiens
AIHLDLEEYR

SEQ ID NO: 39237 - protein, 14 aa, Homo sapiens
AIHLDLEEYRNSSR

SEQ ID NO: 39238 - protein, 11 aa, Homo sapiens
ALEQDLPVNIK

SEQ ID NO: 39239 - protein, 9 aa, Homo sapiens
DGSTIPIAK

SEQ ID NO: 39240 - protein, 9 aa, Homo sapiens
EEILMHLWR

SEQ ID NO: 39241 - protein, 15 aa, Homo sapiens
EWVAIESDSVQPVPR

SEQ ID NO: 39242 - protein, 20 aa, Homo sapiens
FIIEGMEEAGSVALEELVEK

SEQ ID NO: 39243 - protein, 7 aa, Homo sapiens
FRQELFR

SEQ ID NO: 39244 - protein, 16 aa, Homo sapiens
FSIRLVPHMNVSAVEK

SEQ ID NO: 39245 - protein, 20 aa, Homo sapiens
GATDNKGPVLAWINAVSAFR

SEQ ID NO: 39246 - protein, 17 aa, Homo sapiens
GDGWLTDPYVLTEVDGK

SEQ ID NO: 39247 - protein, 12 aa, Homo sapiens
GIEGAFDEPGTK

SEQ ID NO: 39248 - protein, 10 aa, Homo sapiens
GNSYFMVEVK

SEQ ID NO: 39249 - protein, 14 aa, Homo sapiens
GPVLAWINAVSAFR

SEQ ID NO: 39250 - protein, 8 aa, Homo sapiens
HLEDVFSK

SEQ ID NO: 39251 - protein, 13 aa, Homo sapiens
IANIDDTQYLAAK

SEQ ID NO: 39252 - protein, 22 aa, Homo sapiens
ILVPGIYDEVVPLTEEEINTYK

SEQ ID NO: 39253 - protein, 16 aa, Homo sapiens
KAIHLDLEEYRNSSRV

SEQ ID NO: 39254 - protein, 9 aa, Homo sapiens
KPAITYGTR

SEQ ID NO: 39255 - protein, 12 aa, Homo sapiens
LVPHMNVSAVEK

SEQ ID NO: 39256 - protein, 11 aa, Homo sapiens
MMAVAADTLQR

SEQ ID NO: 39257 - protein, 21 aa, Homo sapiens
MVVSMTLGLHPWIANIDDTQY

SEQ ID NO: 39258 - protein, 10 aa, Homo sapiens
PHMNVSAVEK

SEQ ID NO: 39259 - protein, 14 aa, Homo sapiens
RLVPHMNVSAVEKQ

SEQ ID NO: 39260 - protein, 20 aa, Homo sapiens
SVVLIPLGAVDDGEHSQNEK

SEQ ID NO: 39261 - protein, 20 aa, Homo sapiens
TLGLHPWIANIDDTQYLAAK

SEQ ID NO: 39262 - protein, 11 aa, Homo sapiens
TVFGTEPDMIR

SEQ ID NO: 39263 - protein, 33 aa, Homo sapiens
VASVDMGPQQLPDGQSLPIPPVILAELGSDPTK

SEQ ID NO: 39264 - protein, 17 aa, Homo sapiens
VFQYIDLHQDEFVQTLK

SEQ ID NO: 39265 - protein, 11 aa, Homo sapiens
VPHMNVSAVEK

SEQ ID NO: 39266 - protein, 8 aa, Homo sapiens
WNYIEGTK

SEQ ID NO: 39267 - protein, 19 aa, Homo sapiens
YPSLSIHGIEGAFDEPGTK

SEQ ID NO: 39268 - protein, 26 aa, Homo sapiens
AEVQNLGGELVVSGVDSAMSLIQAAK

SEQ ID NO: 39269 - protein, 18 aa, Homo sapiens
AHVLAASVEQATENFLEK

SEQ ID NO: 39270 - protein, 25 aa, Homo sapiens
AVMDHVSDSFLETNVPLLVLIEAAK

SEQ ID NO: 39271 - protein, 30 aa, Homo sapiens
FTEQVEAAVEALSSDPAQPMDENEFIDASR

SEQ ID NO: 39272 - protein, 12 aa, Homo sapiens
HVNPVQALSEFK

SEQ ID NO: 39273 - protein, 13 aa, Homo sapiens
IALYCHQLNICSK

SEQ ID NO: 39274 - protein, 9 aa, Homo sapiens
IVAECNAVR

SEQ ID NO: 39275 - protein, 13 aa, Homo sapiens
KHVNPVQALSEFK

SEQ ID NO: 39276 - protein, 19 aa, Homo sapiens
LIEVANLACSISNNEEGVK

SEQ ID NO: 39277 - protein, 18 aa, Homo sapiens
LLEPLVTQVTTLVNTNSK

SEQ ID NO: 39278 - protein, 12 aa, Homo sapiens
LLILADMADVYK

SEQ ID NO: 39279 - protein, 23 aa, Homo sapiens
MSASQLEALCPQVINAALALAAK

SEQ ID NO: 39280 - protein, 27 aa, Homo sapiens
MSASQLEALCPQVINAALALAAKPQSK

SEQ ID NO: 39281 - protein, 22 aa, Homo sapiens
NVPILYTASQACLQHPDVAAYK

SEQ ID NO: 39282 - protein, 16 aa, Homo sapiens
TASQACLQHPDVAAYK

SEQ ID NO: 39283 - protein, 12 aa, Homo sapiens
TIADHCPDSACK

SEQ ID NO: 39284 - protein, 20 aa, Homo sapiens
VIHVVTSEMDNYEPGVYTEK

SEQ ID NO: 39285 - protein, 29 aa, Homo sapiens
VLTDAVDDITSIDDFLAVSENHILEDVNK

SEQ ID NO: 39286 - protein, 11 aa, Homo sapiens
DNPDLGTAFVK

SEQ ID NO: 39287 - protein, 35 aa, Homo sapiens
LPGNDICCDCGSSEPTWLSTNLGILTCIECSGIHR

SEQ ID NO: 39288 - protein, 19 aa, Homo sapiens
NLLQGLSHNVIFTLDSLLK

SEQ ID NO: 39289 - protein, 15 aa, Homo sapiens
ELAQQVQQVAAEYCR

SEQ ID NO: 39290 - protein, 17 aa, Homo sapiens
FVINYDYPNSSEDYIHR

SEQ ID NO: 39291 - protein, 9 aa, Homo sapiens
LIDFLECGK

SEQ ID NO: 39292 - protein, 11 aa, Homo sapiens
NFYQEHPDLAR

SEQ ID NO: 39293 - protein, 22 aa, Homo sapiens
RLMEEIMSEKENKTIVFVETKR

SEQ ID NO: 39294 - protein, 14 aa, Homo sapiens
TGTAYTFFTPNNIK

SEQ ID NO: 39295 - protein, 20 aa, Homo sapiens
TLSYLLPAIVHINHQPFLER

SEQ ID NO: 39296 - protein, 15 aa, Homo sapiens
QNAQCLHGDIAQSQR

SEQ ID NO: 39297 - protein, 22 aa, Homo sapiens
TDSEDNPQTLLFSATCPQWVYK

SEQ ID NO: 39298 - protein, 11 aa, Homo sapiens
GILDVQSVQEK

SEQ ID NO: 39299 - protein, 14 aa, Homo sapiens
QIATSGPPPEGGLR

SEQ ID NO: 39300 - protein, 11 aa, Homo sapiens
ALNRPPTYPTK

SEQ ID NO: 39301 - protein, 19 aa, Homo sapiens
FVLCPECENPETDLHVNPK

SEQ ID NO: 39302 - protein, 15 aa, Homo sapiens
YFGCELGAQTQFDVK

SEQ ID NO: 39303 - protein, 11 aa, Homo sapiens
YIVNGSHEANK

SEQ ID NO: 39304 - protein, 20 aa, Homo sapiens
YLLHGLECVVAMHQAQLISK

SEQ ID NO: 39305 - protein, 16 aa, Homo sapiens
KLITNDTFQPEIMERS

SEQ ID NO: 39306 - protein, 24 aa, Homo sapiens
RQEDENFNSLLQNGDILNSSTEEK

SEQ ID NO: 39307 - protein, 24 aa, Homo sapiens
RTEDVMFISDNESFNPSLWEEQRK

SEQ ID NO: 39308 - protein, 20 aa, Homo sapiens
HGEMWAISPNDRLIPAVTRS

SEQ ID NO: 39309 - protein, 17 aa, Homo sapiens
NFGRLTKLQILELRENQ

SEQ ID NO: 39310 - protein, 14 aa, Homo sapiens
QMGQPLRPQANYSQ

SEQ ID NO: 39311 - protein, 22 aa, Homo sapiens
SQIHHPPQASVARHPSREQLID

SEQ ID NO: 39312 - protein, 19 aa, Homo sapiens
VKSHSITNMEIGGLKIYDI

SEQ ID NO: 39313 - protein, 34 aa, Homo sapiens
RQGNLSLPLNRELVEKVTNEYNESLLYSPEEPKI

SEQ ID NO: 39314 - protein, 9 aa, Homo sapiens
AILGATEVK

SEQ ID NO: 39315 - protein, 15 aa, Homo sapiens
EAGISDYLTIEELVK

SEQ ID NO: 39316 - protein, 7 aa, Homo sapiens
ELEVAIR

SEQ ID NO: 39317 - protein, 11 aa, Homo sapiens
FDPTWESLDAR

SEQ ID NO: 39318 - protein, 17 aa, Homo sapiens
FFNANQWADIFQASGAK

SEQ ID NO: 39319 - protein, 8 aa, Homo sapiens
GTVVTNDR

SEQ ID NO: 39320 - protein, 13 aa, Homo sapiens
WPTSGQLFLGHPK

SEQ ID NO: 39321 - protein, 11 aa, Homo sapiens
YEDFGPLFTAK

SEQ ID NO: 39322 - protein, 7 aa, Homo sapiens
YIVLTSK

SEQ ID NO: 39323 - protein, 16 aa, Homo sapiens
ETSLDTKSVSEGHLKR

SEQ ID NO: 39324 - protein, 7 aa, Homo sapiens
FLEQQNK

SEQ ID NO: 39325 - protein, 12 aa, Homo sapiens
HLQEYQDLLNVK

SEQ ID NO: 39326 - protein, 14 aa, Homo sapiens
ITIPVQTFSNLQIR

SEQ ID NO: 39327 - protein, 11 aa, Homo sapiens
LALDIEIATYR

SEQ ID NO: 39328 - protein, 16 aa, Homo sapiens
LEVERDNLAQDLATVR

SEQ ID NO: 39329 - protein, 12 aa, Homo sapiens
LRLDQLTANSAR

SEQ ID NO: 39330 - protein, 10 aa, Homo sapiens
NIVVKTVEMR

SEQ ID NO: 39331 - protein, 12 aa, Homo sapiens
SKFADLTDAAAR

SEQ ID NO: 39332 - protein, 18 aa, Homo sapiens
SKFADLTDAAARNAELLR

SEQ ID NO: 39333 - protein, 20 aa, Homo sapiens
IINEVKPTEIYNLGAQSHVK

SEQ ID NO: 39334 - protein, 14 aa, Homo sapiens
LHYGDLTDSTCLVK

SEQ ID NO: 39335 - protein, 16 aa, Homo sapiens
YYRPTEVDFLQGDCTK

SEQ ID NO: 39336 - protein, 17 aa, Homo sapiens
HYCYPHFTCAVDTENIR

SEQ ID NO: 39337 - protein, 16 aa, Homo sapiens
SNEYQLIDCAQYFLDK

SEQ ID NO: 39338 - protein, 21 aa, Homo sapiens
SNEYQLIDCAQYFLDKIDVIK

SEQ ID NO: 39339 - protein, 26 aa, Homo sapiens
ALGVAPASRNETCLGESCAPTVIQRR

SEQ ID NO: 39340 - protein, 22 aa, Homo sapiens
GLPFQANAQDIINFFAPLKPVR

SEQ ID NO: 39341 - protein, 19 aa, Homo sapiens
LPEAADFGTTSSLHFVHMR

SEQ ID NO: 39342 - protein, 27 aa, Homo sapiens
EGGVFTFGAGGYGQLGHNSTSHEINPR

SEQ ID NO: 39343 - protein, 26 aa, Homo sapiens
HTVFVLDDGTVYTCGCNDLGQLGHEK

SEQ ID NO: 39344 - protein, 25 aa, Homo sapiens
IFSGGDQSFSHYSSPQNCGPPDDFR

SEQ ID NO: 39345 - protein, 13 aa, Homo sapiens
IFWEVFHELPLEK

SEQ ID NO: 39346 - protein, 16 aa, Homo sapiens
IVYICCGEDHTAALTK

SEQ ID NO: 39347 - protein, 30 aa, Homo sapiens
KEGGVFTFGAGGYGQLGHNSTSHEINPRKV

SEQ ID NO: 39348 - protein, 30 aa, Homo sapiens
KKPEQVVALDAQNIVAVSCGEAHTLALNDK

SEQ ID NO: 39349 - protein, 29 aa, Homo sapiens
KPEQVVALDAQNIVAVSCGEAHTLALNDK

SEQ ID NO: 39350 - protein, 19 aa, Homo sapiens
LIQPDHPQISQQVAASLEK

SEQ ID NO: 39351 - protein, 27 aa, Homo sapiens
LVIQSTGGGEEYLPVSHTCFNLLDLPK

SEQ ID NO: 39352 - protein, 23 aa, Homo sapiens
QNVSSLFLPVIESVNPCLILVVR

SEQ ID NO: 39353 - protein, 15 aa, Homo sapiens
SVASLFDAFHAGFHK

SEQ ID NO: 39354 - protein, 31 aa, Homo sapiens
GGDGYDGGYGGFDDYGGYNNYGYGNDGFDDR

SEQ ID NO: 39355 - protein, 26 aa, Homo sapiens
GMGGHGYGGAGDASSGFHGGHFVHMR

SEQ ID NO: 39356 - protein, 44 aa, Homo sapiens
RMGMGNNYSGGYGTPDGLGGYGRGGGGSGGYYGQGGMSGGGWRG

SEQ ID NO: 39357 - protein, 10 aa, Homo sapiens
VHIDIGADGR

SEQ ID NO: 39358 - protein, 17 aa, Homo sapiens
CLELFTELAEDKENYKK

SEQ ID NO: 39359 - protein, 13 aa, Homo sapiens
ELHINLIPNKQDR

SEQ ID NO: 39360 - protein, 21 aa, Homo sapiens
HGLEVIYMIEPIDEYCVQQLK

SEQ ID NO: 39361 - protein, 17 aa, Homo sapiens
KCLELFTELAEDKENYK

SEQ ID NO: 39362 - protein, 22 aa, Homo sapiens
KHGLEVIYMIEPIDEYCVQQLK

SEQ ID NO: 39363 - protein, 16 aa, Homo sapiens
KHSQFIGYPITLFVEK

SEQ ID NO: 39364 - protein, 34 aa, Homo sapiens
LGLGIDEDDPTADDTSAAVTEEMPPLEGDDDTSR

SEQ ID NO: 39365 - protein, 8 aa, Homo sapiens
TKFENLCK

SEQ ID NO: 39366 - protein, 19 aa, Homo sapiens
VFIMDNCEELIPEYLNFIR

SEQ ID NO: 39367 - protein, 24 aa, Homo sapiens
LENSGRSKNFSYNLQSATQPKNKT

SEQ ID NO: 39368 - protein, 25 aa, Homo sapiens
PPTLVPLMNGSATPLPTALGLGGRA

SEQ ID NO: 39369 - protein, 21 aa, Homo sapiens
HDQQFHSLKPISGFITGDQAR

SEQ ID NO: 39370 - protein, 12 aa, Homo sapiens
LQEIDIFNNQLK

SEQ ID NO: 39371 - protein, 20 aa, Homo sapiens
KGSGQQAPSNVSGGLLVHRQ

SEQ ID NO: 39372 - protein, 13 aa, Homo sapiens
EDCCPGKPLNVFR

SEQ ID NO: 39373 - protein, 24 aa, Homo sapiens
EIELYGCPPDFPDEEEEEEETSVK

SEQ ID NO: 39374 - protein, 20 aa, Homo sapiens
FSEAEHWLDYFPPLAIQDLK

SEQ ID NO: 39375 - protein, 15 aa, Homo sapiens
IREDCCPGKPLNVFR

SEQ ID NO: 39376 - protein, 26 aa, Homo sapiens
LALADAGDTVEDANFVEAMADAGILR

SEQ ID NO: 39377 - protein, 11 aa, Homo sapiens
LHLGHTFSLSK

SEQ ID NO: 39378 - protein, 16 aa, Homo sapiens
NFEATLGWLQEHACSR

SEQ ID NO: 39379 - protein, 14 aa, Homo sapiens
NYPPWQHTTLSVLR

SEQ ID NO: 39380 - protein, 35 aa, Homo sapiens
YGIRDDMVLPFEPVPVIEIPGFGNLSAVTICDELK

SEQ ID NO: 39381 - protein, 14 aa, Homo sapiens
GLHSQNFTQALLER

SEQ ID NO: 39382 - protein, 25 aa, Homo sapiens
ICSIYTQSGENSLVQEGSEASPIGK

SEQ ID NO: 39383 - protein, 18 aa, Homo sapiens
VQDSVNISGHTNTNTLKV

SEQ ID NO: 39384 - protein, 10 aa, Homo sapiens
ELVQTVLARK

SEQ ID NO: 39385 - protein, 11 aa, Homo sapiens
EEAFLGITDEK

SEQ ID NO: 39386 - protein, 13 aa, Homo sapiens
FFLTNGEIMTFEK

SEQ ID NO: 39387 - protein, 9 aa, Homo sapiens
FQASVATPR

SEQ ID NO: 39388 - protein, 25 aa, Homo sapiens
LTYTNWNEGEPNNAGSDEDCVLLLK

SEQ ID NO: 39389 - protein, 13 aa, Homo sapiens
NAAENGAIQNLIK

SEQ ID NO: 39390 - protein, 13 aa, Homo sapiens
SPDGDSSLAASER

SEQ ID NO: 39391 - protein, 12 aa, Homo sapiens
TEGQFVDLTGNR

SEQ ID NO: 39392 - protein, 28 aa, Homo sapiens
INFTPSQLPNHPSLLDLGSLNTSSHRTV

SEQ ID NO: 39393 - protein, 23 aa, Homo sapiens
IVECRPPVVEPDINSTVEHDENR

SEQ ID NO: 39394 - protein, 16 aa, Homo sapiens
KLPHNGSTGSTPLLRN

SEQ ID NO: 39395 - protein, 26 aa, Homo sapiens
QHSLNLTESTSLDMLLDDTGECSARK

SEQ ID NO: 39396 - protein, 15 aa, Homo sapiens
RSSTSSIDSNISSKS

SEQ ID NO: 39397 - protein, 21 aa, Homo sapiens
AAQCGHPVLCVQPHHIGVAVK

SEQ ID NO: 39398 - protein, 13 aa, Homo sapiens
KAPGCVLSNPDQK

SEQ ID NO: 39399 - protein, 13 aa, Homo sapiens
LVEHGLNETIHIR

SEQ ID NO: 39400 - protein, 21 aa, Homo sapiens
QQQEGLSHLISIIKDDLEDIK

SEQ ID NO: 39401 - protein, 16 aa, Homo sapiens
VPATTLYAHFEQANIK

SEQ ID NO: 39402 - protein, 25 aa, Homo sapiens
RGPMNQCLVATGTHEPKNQSYMVRG

SEQ ID NO: 39403 - protein, 17 aa, Homo sapiens
ASVHTLSGHTNAVATVR

SEQ ID NO: 39404 - protein, 27 aa, Homo sapiens
VHAAVQPGSLDSESGIFACAFDQSESR

SEQ ID NO: 39405 - protein, 23 aa, Homo sapiens
RGLNVSCLSVQGSASIVAPLLLR

SEQ ID NO: 39406 - protein, 21 aa, Homo sapiens
RHLNSTDDADRIPFQEDWMKM

SEQ ID NO: 39407 - protein, 21 aa, Homo sapiens
FDDGAVFLAACSSGDTDEVLK

SEQ ID NO: 39408 - protein, 22 aa, Homo sapiens
VGQTAFDVADEDILGYLEELQK

SEQ ID NO: 39409 - protein, 14 aa, Homo sapiens
QITQVYGFYDECLR

SEQ ID NO: 39410 - protein, 19 aa, Homo sapiens
VDSPVTVCGDIHGQFYDLK

SEQ ID NO: 39411 - protein, 19 aa, Homo sapiens
FSYPNGLSENTSVVEKLKH

SEQ ID NO: 39412 - protein, 30 aa, Homo sapiens
MATYSATCANNSPAQGINMANSIANLRLKA

SEQ ID NO: 39413 - protein, 8 aa, Homo sapiens
GYQVHYVR

SEQ ID NO: 39414 - protein, 33 aa, Homo sapiens
RFSIPPTNHEIMPGGSVNITCVAVGSPMPYVKW

SEQ ID NO: 39415 - protein, 9 aa, Homo sapiens
SYSFVLTNR

SEQ ID NO: 39416 - protein, 20 aa, Homo sapiens
TATMLCAASGNPDPEITWFK

SEQ ID NO: 39417 - protein, 18 aa, Homo sapiens
WMLGAEDLTPEDDMPIGR

SEQ ID NO: 39418 - protein, 16 aa, Homo sapiens
KDMYNDTLNGSTEKRS

SEQ ID NO: 39419 - protein, 16 aa, Homo sapiens
EFADSLGIPFLETSAK

SEQ ID NO: 39420 - protein, 11 aa, Homo sapiens
LLLIGDSGVGK

SEQ ID NO: 39421 - protein, 12 aa, Homo sapiens
MGPGATAGGAEK

SEQ ID NO: 39422 - protein, 10 aa, Homo sapiens
MNPEYDYLFK

SEQ ID NO: 39423 - protein, 17 aa, Homo sapiens
NATNVEQSFMTMAAEIK

SEQ ID NO: 39424 - protein, 17 aa, Homo sapiens
IFEDHENLVENLLNWTR

SEQ ID NO: 39425 - protein, 9 aa, Homo sapiens
QVLDNLMDK

SEQ ID NO: 39426 - protein, 10 aa, Homo sapiens
DIICQIAYAR

SEQ ID NO: 39427 - protein, 14 aa, Homo sapiens
GAVDGGLSIPHSTK

SEQ ID NO: 39428 - protein, 12 aa, Homo sapiens
HIMGQNVADYMR

SEQ ID NO: 39429 - protein, 17 aa, Homo sapiens
IEGDMIVCAAYAHELPK

SEQ ID NO: 39430 - protein, 10 aa, Homo sapiens
RFPGYDSESK

SEQ ID NO: 39431 - protein, 6 aa, Homo sapiens
VFGALK

SEQ ID NO: 39432 - protein, 18 aa, Homo sapiens
VGLTNYAAAYCTGLLLAR

SEQ ID NO: 39433 - protein, 8 aa, Homo sapiens
DVIEEYFK

SEQ ID NO: 39434 - protein, 11 aa, Homo sapiens
KVVGCSCVVVK

SEQ ID NO: 39435 - protein, 9 aa, Homo sapiens
LGEWVGLCK

SEQ ID NO: 39436 - protein, 15 aa, Homo sapiens
LVEALCAEHQINLIK

SEQ ID NO: 39437 - protein, 18 aa, Homo sapiens
QAHLCVLASNCDEPMYVK

SEQ ID NO: 39438 - protein, 10 aa, Homo sapiens
TALIHDGLAR

SEQ ID NO: 39439 - protein, 10 aa, Homo sapiens
VVGCSCVVVK

SEQ ID NO: 39440 - protein, 15 aa, Homo sapiens
GLAPDLPEDLYHLIK

SEQ ID NO: 39441 - protein, 10 aa, Homo sapiens
GLSQSALPYR

SEQ ID NO: 39442 - protein, 15 aa, Homo sapiens
DTGKTPVEPEVAIHR

SEQ ID NO: 39443 - protein, 12 aa, Homo sapiens
LIDLHSPSEIVK

SEQ ID NO: 39444 - protein, 11 aa, Homo sapiens
TPVEPEVAIHR

SEQ ID NO: 39445 - protein, 7 aa, Homo sapiens
VCADLIR

SEQ ID NO: 39446 - protein, 35 aa, Homo sapiens
MATNESVSIFSSASLAVEYVDSLLPENPLQEPFKN

SEQ ID NO: 39447 - protein, 12 aa, Homo sapiens
AAYWEEEPAEVR

SEQ ID NO: 39448 - protein, 15 aa, Homo sapiens
GFFNIYHPLDPVAYR

SEQ ID NO: 39449 - protein, 34 aa, Homo sapiens
GIDDNLDEIPDGEMPQVDHLVFVVHGIGPVCDLR

SEQ ID NO: 39450 - protein, 11 aa, Homo sapiens
IDENYSLPTCK

SEQ ID NO: 39451 - protein, 17 aa, Homo sapiens
LLQNQYEPVQPHWFYCK

SEQ ID NO: 39452 - protein, 16 aa, Homo sapiens
RLEFPSGETIVMHNPK

SEQ ID NO: 39453 - protein, 21 aa, Homo sapiens
VEFLPVHWHSSLGGDATGVDR

SEQ ID NO: 39454 - protein, 20 aa, Homo sapiens
FLEVIKPFCVILPEIQKPER

SEQ ID NO: 39455 - protein, 23 aa, Homo sapiens
FSGNLLVSLLGTWSDTSSGGPAR

SEQ ID NO: 39456 - protein, 17 aa, Homo sapiens
DAEDAMDAMDGAVLDGR

SEQ ID NO: 39457 - protein, 11 aa, Homo sapiens
YGRPPDSHHSR

SEQ ID NO: 39458 - protein, 25 aa, Homo sapiens
KLENTGIEANVLCLESEISENILEK

SEQ ID NO: 39459 - protein, 29 aa, Homo sapiens
SPISDNSGCDAPGNSNPSLSVPSSAESEK

SEQ ID NO: 39460 - protein, 14 aa, Homo sapiens
NVADDYIHTAACLH

SEQ ID NO: 39461 - protein, 25 aa, Homo sapiens
NVADDYIHTAACLHSLALEEPTVIK

SEQ ID NO: 39462 - protein, 18 aa, Homo sapiens
RAEVVINGSSSPAVVDRS

SEQ ID NO: 39463 - protein, 18 aa, Homo sapiens
TSAEAPSHHLQQQQQQQR

SEQ ID NO: 39464 - protein, 32 aa, Homo sapiens
VMDTHLVNIQDVILQENLEKEDQILVSLAGLK

SEQ ID NO: 39465 - protein, 28 aa, Homo sapiens
TGDDYIAIGADEEELGSQIEEAIYQEIR

SEQ ID NO: 39466 - protein, 13 aa, Homo sapiens
TGGTQTDLFTCGK

SEQ ID NO: 39467 - protein, 9 aa, Homo sapiens
ADRDQYELL

SEQ ID NO: 39468 - protein, 13 aa, Homo sapiens
ADRDQYELLCLDN

SEQ ID NO: 39469 - protein, 15 aa, Homo sapiens
ADRDQYELLCLDNTR

SEQ ID NO: 39470 - protein, 22 aa, Homo sapiens
ADRDQYELLCLDNTRKPVDEYK

SEQ ID NO: 39471 - protein, 15 aa, Homo sapiens
AFVKHQTVPQNTGGK

SEQ ID NO: 39472 - protein, 21 aa, Homo sapiens
AIAANEADAVTLDAGLVYDAY

SEQ ID NO: 39473 - protein, 25 aa, Homo sapiens
AIAANEADAVTLDAGLVYDAYLAPN

SEQ ID NO: 39474 - protein, 28 aa, Homo sapiens
AIAANEADAVTLDAGLVYDAYLAPNNLK

SEQ ID NO: 39475 - protein, 34 aa, Homo sapiens
AIAANEADAVTLDAGLVYDAYLAPNNLKPVVAEF

SEQ ID NO: 39476 - protein, 35 aa, Homo sapiens
AIAANEADAVTLDAGLVYDAYLAPNNLKPVVAEFY

SEQ ID NO: 39477 - protein, 38 aa, Homo sapiens
AIAANEADAVTLDAGLVYDAYLAPNNLKPVVAEFYGSK

SEQ ID NO: 39478 - protein, 52 aa, Homo sapiens
AIAANEADAVTLDAGLVYDAYLAPNNLKPVVAEFYGSKEDPQTFYYAVAVVK

SEQ ID NO: 39479 - protein, 14 aa, Homo sapiens
AMSLDGGFVYIAGK

SEQ ID NO: 39480 - protein, 9 aa, Homo sapiens
APNHAVVTR

SEQ ID NO: 39481 - protein, 10 aa, Homo sapiens
APNHAVVTRK

SEQ ID NO: 39482 - protein, 12 aa, Homo sapiens
APNHAVVTRKDK

SEQ ID NO: 39483 - protein, 18 aa, Homo sapiens
APNHAVVTRKDKEACVHK

SEQ ID NO: 39484 - protein, 21 aa, Homo sapiens
APNHAVVTRKDKEACVHKILR

SEQ ID NO: 39485 - protein, 16 aa, Homo sapiens
APNNLKPVVAEFYGSK

SEQ ID NO: 39486 - protein, 8 aa, Homo sapiens
ASYLDCIR

SEQ ID NO: 39487 - protein, 31 aa, Homo sapiens
AVANFFSGSCAPCADGTDFPQLCQLCPGCGC

SEQ ID NO: 39488 - protein, 45 aa, Homo sapiens
AVANFFSGSCAPCADGTDFPQLCQLCPGCGCSTLNQYFGYSGAFK

SEQ ID NO: 39489 - protein, 6 aa, Homo sapiens
AVGNLR

SEQ ID NO: 39490 - protein, 7 aa, Homo sapiens
AVGNLRK

SEQ ID NO: 39491 - protein, 20 aa, Homo sapiens
AVGNLRKCSTSSLLEACTFR

SEQ ID NO: 39492 - protein, 9 aa, Homo sapiens
AVSEHEATK

SEQ ID NO: 39493 - protein, 30 aa, Homo sapiens
AVTLDAGLVYDAYLAPNNLKPVVAEFYGSK

SEQ ID NO: 39494 - protein, 8 aa, Homo sapiens
CALSHHER

SEQ ID NO: 39495 - protein, 10 aa, Homo sapiens
CAVSEHEATK

SEQ ID NO: 39496 - protein, 11 aa, Homo sapiens
CDEWSVNSVGK

SEQ ID NO: 39497 - protein, 22 aa, Homo sapiens
CDEWSVNSVGKIECVSAETTED

SEQ ID NO: 39498 - protein, 13 aa, Homo sapiens
CGLVPVLAENYNK

SEQ ID NO: 39499 - protein, 15 aa, Homo sapiens
CGLVPVLAENYNKSD

SEQ ID NO: 39500 - protein, 16 aa, Homo sapiens
CGLVPVLAENYNKSDN

SEQ ID NO: 39501 - protein, 19 aa, Homo sapiens
CGLVPVLAENYNKSDNCED

SEQ ID NO: 39502 - protein, 32 aa, Homo sapiens
CGLVPVLAENYNKSDNCEDTPEAGYFAVAVVK

SEQ ID NO: 39503 - protein, 14 aa, Homo sapiens
CHLAQVPSHTVVAR

SEQ ID NO: 39504 - protein, 7 aa, Homo sapiens
CHTAVGR

SEQ ID NO: 39505 - protein, 8 aa, Homo sapiens
CLAKLHDR

SEQ ID NO: 39506 - protein, 19 aa, Homo sapiens
CLDGTRKPVEEYANCHLAR

SEQ ID NO: 39507 - protein, 13 aa, Homo sapiens
CLKDGAGDVAFVK

SEQ ID NO: 39508 - protein, 12 aa, Homo sapiens
CLVEKGDVAFVK

SEQ ID NO: 39509 - protein, 14 aa, Homo sapiens
CLVEKGDVAFVKHQ

SEQ ID NO: 39510 - protein, 23 aa, Homo sapiens
CLVEKGDVAFVKHQTVPQNTGGK

SEQ ID NO: 39511 - protein, 20 aa, Homo sapiens
CPGCGCSTLNQYFGYSGAFK

SEQ ID NO: 39512 - protein, 23 aa, Homo sapiens
CQLCPGCGCSTLNQYFGYSGAFK

SEQ ID NO: 39513 - protein, 9 aa, Homo sapiens
CQSFRDHMK

SEQ ID NO: 39514 - protein, 16 aa, Homo sapiens
CRFDEFFSEGCAPGSK

SEQ ID NO: 39515 - protein, 9 aa, Homo sapiens
CSGNFCLFR

SEQ ID NO: 39516 - protein, 10 aa, Homo sapiens
CSTSSLLEAC

SEQ ID NO: 39517 - protein, 13 aa, Homo sapiens
CSTSSLLEACTFR

SEQ ID NO: 39518 - protein, 15 aa, Homo sapiens
CSTSSLLEACTFRRP

SEQ ID NO: 39519 - protein, 13 aa, Homo sapiens
CVSAETTEDCIAK

SEQ ID NO: 39520 - protein, 26 aa, Homo sapiens
DAGLVYDAYLAPNNLKPVVAEFYGSK

SEQ ID NO: 39521 - protein, 15 aa, Homo sapiens
DAMSLDGGFVYIAGK

SEQ ID NO: 39522 - protein, 31 aa, Homo sapiens
DAVTLDAGLVYDAYLAPNNLKPVVAEFYGSK

SEQ ID NO: 39523 - protein, 20 aa, Homo sapiens
DAYLAPNNLKPVVAEFYGSK

SEQ ID NO: 39524 - protein, 10 aa, Homo sapiens
DCHLAQVPSH

SEQ ID NO: 39525 - protein, 15 aa, Homo sapiens
DCHLAQVPSHTVVAR

SEQ ID NO: 39526 - protein, 10 aa, Homo sapiens
DCSGNFCLFR

SEQ ID NO: 39527 - protein, 8 aa, Homo sapiens
DDTVCLAK

SEQ ID NO: 39528 - protein, 12 aa, Homo sapiens
DDTVCLAKLHDR

SEQ ID NO: 39529 - protein, 10 aa, Homo sapiens
DGAGDVAFVK

SEQ ID NO: 39530 - protein, 21 aa, Homo sapiens
DGAGDVAFVKHSTIFENLANK

SEQ ID NO: 39531 - protein, 10 aa, Homo sapiens
DGGFVYIAGK

SEQ ID NO: 39532 - protein, 18 aa, Homo sapiens
DHMKSVIPSDGPSVACVK

SEQ ID NO: 39533 - protein, 8 aa, Homo sapiens
DKEACVHK

SEQ ID NO: 39534 - protein, 11 aa, Homo sapiens
DKEACVHKILR

SEQ ID NO: 39535 - protein, 32 aa, Homo sapiens
DKEACVHKILRQQQHLFGSNVTDCSGNFCLFR

SEQ ID NO: 39536 - protein, 15 aa, Homo sapiens
DKSKEFQLFSSPHGK

SEQ ID NO: 39537 - protein, 20 aa, Homo sapiens
DKSKEFQLFSSPHGKDLLFK

SEQ ID NO: 39538 - protein, 28 aa, Homo sapiens
DKSKEFQLFSSPHGKDLLFKDSAHGFLK

SEQ ID NO: 39539 - protein, 32 aa, Homo sapiens
DKSKEFQLFSSPHGKDLLFKDSAHGFLKVPPR

SEQ ID NO: 39540 - protein, 13 aa, Homo sapiens
DLLFKDSAHGFLK

SEQ ID NO: 39541 - protein, 17 aa, Homo sapiens
DLLFKDSAHGFLKVPPR

SEQ ID NO: 39542 - protein, 21 aa, Homo sapiens
DLLFKDSAHGFLKVPPRMDAK

SEQ ID NO: 39543 - protein, 13 aa, Homo sapiens
DLLFRDDTVCLAK

SEQ ID NO: 39544 - protein, 17 aa, Homo sapiens
DLLFRDDTVCLAKLHDR

SEQ ID NO: 39545 - protein, 22 aa, Homo sapiens
DLLFRDDTVCLAKLHDRNTYEK

SEQ ID NO: 39546 - protein, 23 aa, Homo sapiens
DPWAKNLNEKDYELLCLDGTRKP

SEQ ID NO: 39547 - protein, 12 aa, Homo sapiens
DQYELLCLDNTR

SEQ ID NO: 39548 - protein, 34 aa, Homo sapiens
DQYELLCLDNTRKPVDEYKDCHLAQVPSHTVVAR

SEQ ID NO: 39549 - protein, 8 aa, Homo sapiens
DSAHGFLK

SEQ ID NO: 39550 - protein, 12 aa, Homo sapiens
DSAHGFLKVPPR

SEQ ID NO: 39551 - protein, 16 aa, Homo sapiens
DSAHGFLKVPPRMDAK

SEQ ID NO: 39552 - protein, 10 aa, Homo sapiens
DSGFQMNQLR

SEQ ID NO: 39553 - protein, 12 aa, Homo sapiens
DSGFQMNQLRGK

SEQ ID NO: 39554 - protein, 13 aa, Homo sapiens
DSGFQMNQLRGKK

SEQ ID NO: 39555 - protein, 6 aa, Homo sapiens
DSSLCK

SEQ ID NO: 39556 - protein, 21 aa, Homo sapiens
DSSLCKLCMGSGLNLCEPNNK

SEQ ID NO: 39557 - protein, 11 aa, Homo sapiens
DYELLCLDGTR

SEQ ID NO: 39558 - protein, 12 aa, Homo sapiens
DYELLCLDGTRK

SEQ ID NO: 39559 - protein, 24 aa, Homo sapiens
DYELLCLDGTRKPVEEYANCHLAR

SEQ ID NO: 39560 - protein, 33 aa, Homo sapiens
EADAVTLDAGLVYDAYLAPNNLKPVVAEFYGSK

SEQ ID NO: 39561 - protein, 11 aa, Homo sapiens
EDLIWELLNQA

SEQ ID NO: 39562 - protein, 17 aa, Homo sapiens
EDLIWELLNQAQEHFGK

SEQ ID NO: 39563 - protein, 19 aa, Homo sapiens
EDLIWELLNQAQEHFGKDK

SEQ ID NO: 39564 - protein, 9 aa, Homo sapiens
EDPQTFYYA

SEQ ID NO: 39565 - protein, 14 aa, Homo sapiens
EDPQTFYYAVAVVK

SEQ ID NO: 39566 - protein, 15 aa, Homo sapiens
EDPQTFYYAVAVVKK

SEQ ID NO: 39567 - protein, 25 aa, Homo sapiens
EDPQTFYYAVAVVKKDSGFQMNQLR

SEQ ID NO: 39568 - protein, 10 aa, Homo sapiens
EEYANCHLAR

SEQ ID NO: 39569 - protein, 9 aa, Homo sapiens
EFQLFSSPH

SEQ ID NO: 39570 - protein, 11 aa, Homo sapiens
EFQLFSSPHGK

SEQ ID NO: 39571 - protein, 16 aa, Homo sapiens
EFQLFSSPHGKDLLFK

SEQ ID NO: 39572 - protein, 24 aa, Homo sapiens
EFQLFSSPHGKDLLFKDSAHGFLK

SEQ ID NO: 39573 - protein, 28 aa, Homo sapiens
EFQLFSSPHGKDLLFKDSAHGFLKVPPR

SEQ ID NO: 39574 - protein, 13 aa, Homo sapiens
EGTCPEAPTDECK

SEQ ID NO: 39575 - protein, 16 aa, Homo sapiens
EGTCPEAPTDECKPVK

SEQ ID NO: 39576 - protein, 25 aa, Homo sapiens
EGTCPEAPTDECKPVKWCALSHHER

SEQ ID NO: 39577 - protein, 11 aa, Homo sapiens
EGYYGYTGAFR

SEQ ID NO: 39578 - protein, 13 aa, Homo sapiens
EKDYELLCLDGTR

SEQ ID NO: 39579 - protein, 12 aa, Homo sapiens
ELLNQAQEHFGK

SEQ ID NO: 39580 - protein, 14 aa, Homo sapiens
ELLNQAQEHFGKDK

SEQ ID NO: 39581 - protein, 9 aa, Homo sapiens
EYANCHLAR

SEQ ID NO: 39582 - protein, 18 aa, Homo sapiens
EYKDCHLAQVPSHTVVAR

SEQ ID NO: 39583 - protein, 22 aa, Homo sapiens
FAVAVVKKSASDLTWDNLKGKK

SEQ ID NO: 39584 - protein, 12 aa, Homo sapiens
FDEFFSEGCAPG

SEQ ID NO: 39585 - protein, 14 aa, Homo sapiens
FDEFFSEGCAPGSK

SEQ ID NO: 39586 - protein, 15 aa, Homo sapiens
FDEFFSEGCAPGSKK

SEQ ID NO: 39587 - protein, 21 aa, Homo sapiens
FDEFFSEGCAPGSKKDSSLCK

SEQ ID NO: 39588 - protein, 16 aa, Homo sapiens
FGSNVTDCSGNFCLFR

SEQ ID NO: 39589 - protein, 8 aa, Homo sapiens
FGYSGAFK

SEQ ID NO: 39590 - protein, 10 aa, Homo sapiens
FRDDTVCLAK

SEQ ID NO: 39591 - protein, 14 aa, Homo sapiens
FRDDTVCLAKLHDR

SEQ ID NO: 39592 - protein, 14 aa, Homo sapiens
FVKHQTVPQNTGGK

SEQ ID NO: 39593 - protein, 9 aa, Homo sapiens
FYYAVAVVK

SEQ ID NO: 39594 - protein, 16 aa, Homo sapiens
GCSTLNQYFGYSGAFK

SEQ ID NO: 39595 - protein, 18 aa, Homo sapiens
GDVAFVKHQTVPQNTGGK

SEQ ID NO: 39596 - protein, 25 aa, Homo sapiens
GDVAFVKHQTVPQNTGGKNPDPWAK

SEQ ID NO: 39597 - protein, 12 aa, Homo sapiens
GEEYVKAVGNLR

SEQ ID NO: 39598 - protein, 8 aa, Homo sapiens
GFVYIAGK

SEQ ID NO: 39599 - protein, 9 aa, Homo sapiens
GGFVYIAGK

SEQ ID NO: 39600 - protein, 20 aa, Homo sapiens
GGKEDLIWELLNQAQEHFGK

SEQ ID NO: 39601 - protein, 22 aa, Homo sapiens
GGKEDLIWELLNQAQEHFGKDK

SEQ ID NO: 39602 - protein, 11 aa, Homo sapiens
GLLYCDLPEPR

SEQ ID NO: 39603 - protein, 16 aa, Homo sapiens
GLLYCDLPEPRKPLEK

SEQ ID NO: 39604 - protein, 10 aa, Homo sapiens
GLNLCEPNNK

SEQ ID NO: 39605 - protein, 12 aa, Homo sapiens
GLVPVLAENYNK

SEQ ID NO: 39606 - protein, 24 aa, Homo sapiens
GLVYDAYLAPNNLKPVVAEFYGSK

SEQ ID NO: 39607 - protein, 7 aa, Homo sapiens
GNFCLFR

SEQ ID NO: 39608 - protein, 12 aa, Homo sapiens
GSGLNLCEPNNK

SEQ ID NO: 39609 - protein, 23 aa, Homo sapiens
GSGLNLCEPNNKEGYYGYTGAFR

SEQ ID NO: 39610 - protein, 15 aa, Homo sapiens
GSNVTDCSGNFCLFR

SEQ ID NO: 39611 - protein, 16 aa, Homo sapiens
GTRKPVEEYANCHLAR

SEQ ID NO: 39612 - protein, 9 aa, Homo sapiens
GYEYVTAIR

SEQ ID NO: 39613 - protein, 13 aa, Homo sapiens
HLAQVPSHTVVAR

SEQ ID NO: 39614 - protein, 18 aa, Homo sapiens
HLFGSNVTDCSGNFCLFR

SEQ ID NO: 39615 - protein, 11 aa, Homo sapiens
HQTVPQNTGGK

SEQ ID NO: 39616 - protein, 12 aa, Homo sapiens
HQTVPQNTGGKN

SEQ ID NO: 39617 - protein, 14 aa, Homo sapiens
HQTVPQNTGGKNPD

SEQ ID NO: 39618 - protein, 18 aa, Homo sapiens
HQTVPQNTGGKNPDPWAK

SEQ ID NO: 39619 - protein, 23 aa, Homo sapiens
HQTVPQNTGGKNPDPWAKNLNEK

SEQ ID NO: 39620 - protein, 11 aa, Homo sapiens
HSTIFENLANK

SEQ ID NO: 39621 - protein, 14 aa, Homo sapiens
HSTIFENLANKADR

SEQ ID NO: 39622 - protein, 20 aa, Homo sapiens
HSTIFENLANKADRDQYELL

SEQ ID NO: 39623 - protein, 24 aa, Homo sapiens
HSTIFENLANKADRDQYELLCLDN

SEQ ID NO: 39624 - protein, 26 aa, Homo sapiens
HSTIFENLANKADRDQYELLCLDNTR

SEQ ID NO: 39625 - protein, 33 aa, Homo sapiens
HSTIFENLANKADRDQYELLCLDNTRKPVDEYK

SEQ ID NO: 39626 - protein, 15 aa, Homo sapiens
IECVSAETTEDCIAK

SEQ ID NO: 39627 - protein, 12 aa, Homo sapiens
IGLLYCDLPEPR

SEQ ID NO: 39628 - protein, 15 aa, Homo sapiens
ILRQQQHLFGSNVTD

SEQ ID NO: 39629 - protein, 19 aa, Homo sapiens
ILRQQQHLFGSNVTDCSGN

SEQ ID NO: 39630 - protein, 20 aa, Homo sapiens
ILRQQQHLFGSNVTDCSGNF

SEQ ID NO: 39631 - protein, 24 aa, Homo sapiens
ILRQQQHLFGSNVTDCSGNFCLFR

SEQ ID NO: 39632 - protein, 21 aa, Homo sapiens
IMNGEADAMSLDGGFVYIAGK

SEQ ID NO: 39633 - protein, 19 aa, Homo sapiens
INHCRFDEFFSEGCAPGSK

SEQ ID NO: 39634 - protein, 20 aa, Homo sapiens
INHCRFDEFFSEGCAPGSKK

SEQ ID NO: 39635 - protein, 26 aa, Homo sapiens
INHCRFDEFFSEGCAPGSKKDSSLCK

SEQ ID NO: 39636 - protein, 14 aa, Homo sapiens
IPIGLLYCDLPEPR

SEQ ID NO: 39637 - protein, 9 aa, Homo sapiens
IPMGLLYNK

SEQ ID NO: 39638 - protein, 12 aa, Homo sapiens
IPSDGPSVACVK

SEQ ID NO: 39639 - protein, 13 aa, Homo sapiens
IPSDGPSVACVKK

SEQ ID NO: 39640 - protein, 14 aa, Homo sapiens
IWELLNQAQEHFGK

SEQ ID NO: 39641 - protein, 9 aa, Homo sapiens
KASYLDCIR

SEQ ID NO: 39642 - protein, 14 aa, Homo sapiens
KCGLVPVLAENYNK

SEQ ID NO: 39643 - protein, 15 aa, Homo sapiens
KCGLVPVLAENYNKS

SEQ ID NO: 39644 - protein, 14 aa, Homo sapiens
KCSTSSLLEACTFR

SEQ ID NO: 39645 - protein, 16 aa, Homo sapiens
KCSTSSLLEACTFRRP

SEQ ID NO: 39646 - protein, 9 aa, Homo sapiens
KDKEACVHK

SEQ ID NO: 39647 - protein, 12 aa, Homo sapiens
KDKEACVHKILR

SEQ ID NO: 39648 - protein, 14 aa, Homo sapiens
KDLLFRDDTVCLAK

SEQ ID NO: 39649 - protein, 11 aa, Homo sapiens
KDSGFQMNQLR

SEQ ID NO: 39650 - protein, 13 aa, Homo sapiens
KDSGFQMNQLRGK

SEQ ID NO: 39651 - protein, 14 aa, Homo sapiens
KDSGFQMNQLRGKK

SEQ ID NO: 39652 - protein, 7 aa, Homo sapiens
KDSSLCK

SEQ ID NO: 39653 - protein, 31 aa, Homo sapiens
KEACVHKILRQQQHLFGSNVTDCSGNFCLFR

SEQ ID NO: 39654 - protein, 12 aa, Homo sapiens
KEGYYGYTGAFR

SEQ ID NO: 39655 - protein, 16 aa, Homo sapiens
KLCMGSGLNLCEPNNK

SEQ ID NO: 39656 - protein, 18 aa, Homo sapiens
KLHDRNTYEKYLGEEYVK

SEQ ID NO: 39657 - protein, 17 aa, Homo sapiens
KNLNEKDYELLCLDGTR

SEQ ID NO: 39658 - protein, 7 aa, Homo sapiens
KPVDEYK

SEQ ID NO: 39659 - protein, 9 aa, Homo sapiens
KPVDEYKDC

SEQ ID NO: 39660 - protein, 10 aa, Homo sapiens
KPVDEYKDCH

SEQ ID NO: 39661 - protein, 12 aa, Homo sapiens
KPVDEYKDCHLA

SEQ ID NO: 39662 - protein, 17 aa, Homo sapiens
KPVDEYKDCHLAQVPSH

SEQ ID NO: 39663 - protein, 21 aa, Homo sapiens
KPVDEYKDCHLAQVPSHTVVA

SEQ ID NO: 39664 - protein, 22 aa, Homo sapiens
KPVDEYKDCHLAQVPSHTVVAR

SEQ ID NO: 39665 - protein, 9 aa, Homo sapiens
KPVEEYANC

SEQ ID NO: 39666 - protein, 10 aa, Homo sapiens
KPVEEYANCH

SEQ ID NO: 39667 - protein, 11 aa, Homo sapiens
KPVEEYANCHL

SEQ ID NO: 39668 - protein, 12 aa, Homo sapiens
KPVEEYANCHLA

SEQ ID NO: 39669 - protein, 13 aa, Homo sapiens
KPVEEYANCHLAR

SEQ ID NO: 39670 - protein, 14 aa, Homo sapiens
KPVEEYANCHLARA

SEQ ID NO: 39671 - protein, 22 aa, Homo sapiens
KPVEEYANCHLARAPNHAVVTR

SEQ ID NO: 39672 - protein, 11 aa, Homo sapiens
KPVVAEFYGSK

SEQ ID NO: 39673 - protein, 12 aa, Homo sapiens
KSASDLTWDNLK

SEQ ID NO: 39674 - protein, 14 aa, Homo sapiens
KSASDLTWDNLKGK

SEQ ID NO: 39675 - protein, 15 aa, Homo sapiens
KSASDLTWDNLKGKK

SEQ ID NO: 39676 - protein, 9 aa, Homo sapiens
KSCHTAVGR

SEQ ID NO: 39677 - protein, 9 aa, Homo sapiens
KSCHTGLGR

SEQ ID NO: 39678 - protein, 15 aa, Homo sapiens
KSVIPSDGPSVACVK

SEQ ID NO: 39679 - protein, 15 aa, Homo sapiens
KYLGEEYVKAVGNLR

SEQ ID NO: 39680 - protein, 17 aa, Homo sapiens
LAPNNLKPVVAEFYGSK

SEQ ID NO: 39681 - protein, 12 aa, Homo sapiens
LAQVPSHTVVAR

SEQ ID NO: 39682 - protein, 24 aa, Homo sapiens
LAVGALLVCAVLGLCLAVPDKTVR

SEQ ID NO: 39683 - protein, 18 aa, Homo sapiens
LCEPNNKEGYYGYTGAFR

SEQ ID NO: 39684 - protein, 20 aa, Homo sapiens
LCLDGTRKPVEEYANCHLAR

SEQ ID NO: 39685 - protein, 15 aa, Homo sapiens
LCMGSGLNLCEPNNK

SEQ ID NO: 39686 - protein, 26 aa, Homo sapiens
LCMGSGLNLCEPNNKEGYYGYTGAFR

SEQ ID NO: 39687 - protein, 21 aa, Homo sapiens
LCPGCGCSTLNQYFGYSGAFK

SEQ ID NO: 39688 - protein, 24 aa, Homo sapiens
LCQLCPGCGCSTLNQYFGYSGAFK

SEQ ID NO: 39689 - protein, 27 aa, Homo sapiens
LDAGLVYDAYLAPNNLKPVVAEFYGSK

SEQ ID NO: 39690 - protein, 18 aa, Homo sapiens
LDGTRKPVEEYANCHLAR

SEQ ID NO: 39691 - protein, 17 aa, Homo sapiens
LFGSNVTDCSGNFCLFR

SEQ ID NO: 39692 - protein, 11 aa, Homo sapiens
LFRDDTVCLAK

SEQ ID NO: 39693 - protein, 15 aa, Homo sapiens
LFRDDTVCLAKLHDR

SEQ ID NO: 39694 - protein, 10 aa, Homo sapiens
LGYEYVTAIR

SEQ ID NO: 39695 - protein, 9 aa, Homo sapiens
LHDRNTYEK

SEQ ID NO: 39696 - protein, 14 aa, Homo sapiens
LHDRNTYEKYLGEE

SEQ ID NO: 39697 - protein, 17 aa, Homo sapiens
LHDRNTYEKYLGEEYVK

SEQ ID NO: 39698 - protein, 21 aa, Homo sapiens
LHDRNTYEKYLGEEYVKAVGN

SEQ ID NO: 39699 - protein, 23 aa, Homo sapiens
LHDRNTYEKYLGEEYVKAVGNLR

SEQ ID NO: 39700 - protein, 24 aa, Homo sapiens
LHDRNTYEKYLGEEYVKAVGNLRK

SEQ ID NO: 39701 - protein, 10 aa, Homo sapiens
LKCDEWSVNS

SEQ ID NO: 39702 - protein, 13 aa, Homo sapiens
LKCDEWSVNSVGK

SEQ ID NO: 39703 - protein, 24 aa, Homo sapiens
LKCDEWSVNSVGKIECVSAETTED

SEQ ID NO: 39704 - protein, 28 aa, Homo sapiens
LKCDEWSVNSVGKIECVSAETTEDCIAK

SEQ ID NO: 39705 - protein, 12 aa, Homo sapiens
LKPVVAEFYGSK

SEQ ID NO: 39706 - protein, 12 aa, Homo sapiens
LLFRDDTVCLAK

SEQ ID NO: 39707 - protein, 11 aa, Homo sapiens
LLNQAQEHFGK

SEQ ID NO: 39708 - protein, 10 aa, Homo sapiens
LLYCDLPEPR

SEQ ID NO: 39709 - protein, 15 aa, Homo sapiens
LNEKDYELLCLDGTR

SEQ ID NO: 39710 - protein, 10 aa, Homo sapiens
LNQAQEHFGK

SEQ ID NO: 39711 - protein, 12 aa, Homo sapiens
LNQAQEHFGKDK

SEQ ID NO: 39712 - protein, 11 aa, Homo sapiens
LVEKGDVAFVK

SEQ ID NO: 39713 - protein, 17 aa, Homo sapiens
LVPVLAENYNKSDNCED

SEQ ID NO: 39714 - protein, 9 aa, Homo sapiens
LYCDLPEPR

SEQ ID NO: 39715 - protein, 16 aa, Homo sapiens
MDAKMYLGYEYVTAIR

SEQ ID NO: 39716 - protein, 19 aa, Homo sapiens
MDAKMYLGYEYVTAIRNLR

SEQ ID NO: 39717 - protein, 13 aa, Homo sapiens
MGSGLNLCEPNNK

SEQ ID NO: 39718 - protein, 24 aa, Homo sapiens
MGSGLNLCEPNNKEGYYGYTGAFR

SEQ ID NO: 39719 - protein, 16 aa, Homo sapiens
MKSVIPSDGPSVACVK

SEQ ID NO: 39720 - protein, 12 aa, Homo sapiens
MYLGYEYVTAIR

SEQ ID NO: 39721 - protein, 15 aa, Homo sapiens
MYLGYEYVTAIRNLR

SEQ ID NO: 39722 - protein, 18 aa, Homo sapiens
MYLGYEYVTAIRNLREGT

SEQ ID NO: 39723 - protein, 17 aa, Homo sapiens
NCEDTPEAGYFAVAVVK

SEQ ID NO: 39724 - protein, 14 aa, Homo sapiens
NEKDYELLCLDGTR

SEQ ID NO: 39725 - protein, 19 aa, Homo sapiens
NGEADAMSLDGGFVYIAGK

SEQ ID NO: 39726 - protein, 7 aa, Homo sapiens
NHAVVTR

SEQ ID NO: 39727 - protein, 15 aa, Homo sapiens
NIPIGLLYCDLPEPR

SEQ ID NO: 39728 - protein, 10 aa, Homo sapiens
NIPMGLLYNK

SEQ ID NO: 39729 - protein, 13 aa, Homo sapiens
NKEGYYGYTGAFR

SEQ ID NO: 39730 - protein, 13 aa, Homo sapiens
NLKPVVAEFYGSK

SEQ ID NO: 39731 - protein, 14 aa, Homo sapiens
NLNEKDYELLCLDG

SEQ ID NO: 39732 - protein, 16 aa, Homo sapiens
NLNEKDYELLCLDGTR

SEQ ID NO: 39733 - protein, 17 aa, Homo sapiens
NLNEKDYELLCLDGTRK

SEQ ID NO: 39734 - protein, 24 aa, Homo sapiens
NLNEKDYELLCLDGTRKPVEEYAN

SEQ ID NO: 39735 - protein, 29 aa, Homo sapiens
NLNEKDYELLCLDGTRKPVEEYANCHLAR

SEQ ID NO: 39736 - protein, 19 aa, Homo sapiens
NLREGTCPEAPTDECKPVK

SEQ ID NO: 39737 - protein, 28 aa, Homo sapiens
NLREGTCPEAPTDECKPVKWCALSHHER

SEQ ID NO: 39738 - protein, 7 aa, Homo sapiens
NPDPWAK

SEQ ID NO: 39739 - protein, 12 aa, Homo sapiens
NPDPWAKNLNEK

SEQ ID NO: 39740 - protein, 23 aa, Homo sapiens
NPDPWAKNLNEKDYELLCLDGTR

SEQ ID NO: 39741 - protein, 11 aa, Homo sapiens
NQAQEHFGKDK

SEQ ID NO: 39742 - protein, 13 aa, Homo sapiens
NTYEKYLGEEYVK

SEQ ID NO: 39743 - protein, 19 aa, Homo sapiens
NTYEKYLGEEYVKAVGNLR

SEQ ID NO: 39744 - protein, 20 aa, Homo sapiens
NTYEKYLGEEYVKAVGNLRK

SEQ ID NO: 39745 - protein, 12 aa, Homo sapiens
PEAGYFAVAVVK

SEQ ID NO: 39746 - protein, 12 aa, Homo sapiens
PEAPTDECKPVK

SEQ ID NO: 39747 - protein, 21 aa, Homo sapiens
PEAPTDECKPVKWCALSHHER

SEQ ID NO: 39748 - protein, 19 aa, Homo sapiens
PGCGCSTLNQYFGYSGAFK

SEQ ID NO: 39749 - protein, 13 aa, Homo sapiens
PIGLLYCDLPEPR

SEQ ID NO: 39750 - protein, 18 aa, Homo sapiens
PIGLLYCDLPEPRKPLEK

SEQ ID NO: 39751 - protein, 8 aa, Homo sapiens
PMGLLYNK

SEQ ID NO: 39752 - protein, 13 aa, Homo sapiens
PMGLLYNKINHCR

SEQ ID NO: 39753 - protein, 8 aa, Homo sapiens
PNHAVVTR

SEQ ID NO: 39754 - protein, 15 aa, Homo sapiens
PNNLKPVVAEFYGSK

SEQ ID NO: 39755 - protein, 19 aa, Homo sapiens
PPRMDAKMYLGYEYVTAIR

SEQ ID NO: 39756 - protein, 26 aa, Homo sapiens
PQLCQLCPGCGCSTLNQYFGYSGAFK

SEQ ID NO: 39757 - protein, 12 aa, Homo sapiens
PQTFYYAVAVVK

SEQ ID NO: 39758 - protein, 13 aa, Homo sapiens
PQTFYYAVAVVKK

SEQ ID NO: 39759 - protein, 23 aa, Homo sapiens
PQTFYYAVAVVKKDSGFQMNQLR

SEQ ID NO: 39760 - protein, 25 aa, Homo sapiens
PQTFYYAVAVVKKDSGFQMNQLRGK

SEQ ID NO: 39761 - protein, 11 aa, Homo sapiens
PSDGPSVACVK

SEQ ID NO: 39762 - protein, 12 aa, Homo sapiens
PSDGPSVACVKK

SEQ ID NO: 39763 - protein, 20 aa, Homo sapiens
PSDGPSVACVKKASYLDCIR

SEQ ID NO: 39764 - protein, 8 aa, Homo sapiens
PSHTVVAR

SEQ ID NO: 39765 - protein, 18 aa, Homo sapiens
PTDECKPVKWCALSHHER

SEQ ID NO: 39766 - protein, 21 aa, Homo sapiens
PVDEYKDCHLAQVPSHTVVAR

SEQ ID NO: 39767 - protein, 12 aa, Homo sapiens
PVEEYANCHLAR

SEQ ID NO: 39768 - protein, 9 aa, Homo sapiens
PVLAENYNK

SEQ ID NO: 39769 - protein, 10 aa, Homo sapiens
PVVAEFYGSK

SEQ ID NO: 39770 - protein, 19 aa, Homo sapiens
QHLFGSNVTDCSGNFCLFR

SEQ ID NO: 39771 - protein, 22 aa, Homo sapiens
QLCPGCGCSTLNQYFGYSGAFK

SEQ ID NO: 39772 - protein, 20 aa, Homo sapiens
QQHLFGSNVTDCSGNFCLFR

SEQ ID NO: 39773 - protein, 12 aa, Homo sapiens
QQQHLFGSNVTD

SEQ ID NO: 39774 - protein, 13 aa, Homo sapiens
QQQHLFGSNVTDC

SEQ ID NO: 39775 - protein, 14 aa, Homo sapiens
QQQHLFGSNVTDCS

SEQ ID NO: 39776 - protein, 15 aa, Homo sapiens
QQQHLFGSNVTDCSG

SEQ ID NO: 39777 - protein, 16 aa, Homo sapiens
QQQHLFGSNVTDCSGN

SEQ ID NO: 39778 - protein, 17 aa, Homo sapiens
QQQHLFGSNVTDCSGNF

SEQ ID NO: 39779 - protein, 18 aa, Homo sapiens
QQQHLFGSNVTDCSGNFC

SEQ ID NO: 39780 - protein, 19 aa, Homo sapiens
QQQHLFGSNVTDCSGNFCL

SEQ ID NO: 39781 - protein, 21 aa, Homo sapiens
QQQHLFGSNVTDCSGNFCLFR

SEQ ID NO: 39782 - protein, 25 aa, Homo sapiens
QQQHLFGSNVTDCSGNFCLFRSETK

SEQ ID NO: 39783 - protein, 13 aa, Homo sapiens
RDQYELLCLDNTR

SEQ ID NO: 39784 - protein, 14 aa, Homo sapiens
RNTYEKYLGEEYVK

SEQ ID NO: 39785 - protein, 21 aa, Homo sapiens
RNTYEKYLGEEYVKAVGNLRK

SEQ ID NO: 39786 - protein, 23 aa, Homo sapiens
RQQQHLFGSNVTDCSGNFCLFRS

SEQ ID NO: 39787 - protein, 11 aa, Homo sapiens
SAETTEDCIAK

SEQ ID NO: 39788 - protein, 12 aa, Homo sapiens
SAGWNIPIGLLY

SEQ ID NO: 39789 - protein, 19 aa, Homo sapiens
SAGWNIPIGLLYCDLPEPR

SEQ ID NO: 39790 - protein, 24 aa, Homo sapiens
SAGWNIPIGLLYCDLPEPRKPLEK

SEQ ID NO: 39791 - protein, 15 aa, Homo sapiens
SAHGFLKVPPRMDAK

SEQ ID NO: 39792 - protein, 11 aa, Homo sapiens
SASDLTWDNLK

SEQ ID NO: 39793 - protein, 13 aa, Homo sapiens
SASDLTWDNLKGK

SEQ ID NO: 39794 - protein, 14 aa, Homo sapiens
SASDLTWDNLKGKK

SEQ ID NO: 39795 - protein, 22 aa, Homo sapiens
SASDLTWDNLKGKKSCHTAVGR

SEQ ID NO: 39796 - protein, 8 aa, Homo sapiens
SCHTAVGR

SEQ ID NO: 39797 - protein, 8 aa, Homo sapiens
SCHTGLGR

SEQ ID NO: 39798 - protein, 9 aa, Homo sapiens
SDLTWDNLK

SEQ ID NO: 39799 - protein, 11 aa, Homo sapiens
SDLTWDNLKGK

SEQ ID NO: 39800 - protein, 7 aa, Homo sapiens
SDNCEDT

SEQ ID NO: 39801 - protein, 19 aa, Homo sapiens
SDNCEDTPEAGYFAVAVVK

SEQ ID NO: 39802 - protein, 20 aa, Homo sapiens
SDNCEDTPEAGYFAVAVVKK

SEQ ID NO: 39803 - protein, 9 aa, Homo sapiens
SEGCAPGSK

SEQ ID NO: 39804 - protein, 16 aa, Homo sapiens
SEGCAPGSKKDSSLCK

SEQ ID NO: 39805 - protein, 9 aa, Homo sapiens
SETKDLLFR

SEQ ID NO: 39806 - protein, 11 aa, Homo sapiens
SETKDLLFRDD

SEQ ID NO: 39807 - protein, 16 aa, Homo sapiens
SETKDLLFRDDTVCLA

SEQ ID NO: 39808 - protein, 17 aa, Homo sapiens
SETKDLLFRDDTVCLAK

SEQ ID NO: 39809 - protein, 21 aa, Homo sapiens
SETKDLLFRDDTVCLAKLHDR

SEQ ID NO: 39810 - protein, 9 aa, Homo sapiens
SGFQMNQLR

SEQ ID NO: 39811 - protein, 22 aa, Homo sapiens
SGLNLCEPNNKEGYYGYTGAFR

SEQ ID NO: 39812 - protein, 8 aa, Homo sapiens
SGNFCLFR

SEQ ID NO: 39813 - protein, 11 aa, Homo sapiens
SKEFQLFSSPH

SEQ ID NO: 39814 - protein, 12 aa, Homo sapiens
SKEFQLFSSPHG

SEQ ID NO: 39815 - protein, 13 aa, Homo sapiens
SKEFQLFSSPHGK

SEQ ID NO: 39816 - protein, 18 aa, Homo sapiens
SKEFQLFSSPHGKDLLFK

SEQ ID NO: 39817 - protein, 24 aa, Homo sapiens
SKEFQLFSSPHGKDLLFKDSAHGF

SEQ ID NO: 39818 - protein, 26 aa, Homo sapiens
SKEFQLFSSPHGKDLLFKDSAHGFLK

SEQ ID NO: 39819 - protein, 30 aa, Homo sapiens
SKEFQLFSSPHGKDLLFKDSAHGFLKVPPR

SEQ ID NO: 39820 - protein, 12 aa, Homo sapiens
SLDGGFVYIAGK

SEQ ID NO: 39821 - protein, 9 aa, Homo sapiens
SLLEACTFR

SEQ ID NO: 39822 - protein, 16 aa, Homo sapiens
SMGGKEDLIWELLNQA

SEQ ID NO: 39823 - protein, 22 aa, Homo sapiens
SMGGKEDLIWELLNQAQEHFGK

SEQ ID NO: 39824 - protein, 24 aa, Homo sapiens
SMGGKEDLIWELLNQAQEHFGKDK

SEQ ID NO: 39825 - protein, 14 aa, Homo sapiens
SNVTDCSGNFCLFR

SEQ ID NO: 39826 - protein, 11 aa, Homo sapiens
SSPHGKDLLFK

SEQ ID NO: 39827 - protein, 19 aa, Homo sapiens
SSPHGKDLLFKDSAHGFLK

SEQ ID NO: 39828 - protein, 10 aa, Homo sapiens
STIFENLANK

SEQ ID NO: 39829 - protein, 14 aa, Homo sapiens
STLNQYFGYSGAFK

SEQ ID NO: 39830 - protein, 12 aa, Homo sapiens
STSSLLEACTFR

SEQ ID NO: 39831 - protein, 19 aa, Homo sapiens
SVGKIECVSAETTEDCIAK

SEQ ID NO: 39832 - protein, 14 aa, Homo sapiens
SVIPSDGPSVACVK

SEQ ID NO: 39833 - protein, 15 aa, Homo sapiens
SVIPSDGPSVACVKK

SEQ ID NO: 39834 - protein, 23 aa, Homo sapiens
SVIPSDGPSVACVKKASYLDCIR

SEQ ID NO: 39835 - protein, 7 aa, Homo sapiens
SYLDCIR

SEQ ID NO: 39836 - protein, 14 aa, Homo sapiens
TAGWNIPMGLLYNK

SEQ ID NO: 39837 - protein, 17 aa, Homo sapiens
TAGWNIPMGLLYNKINH

SEQ ID NO: 39838 - protein, 19 aa, Homo sapiens
TAGWNIPMGLLYNKINHCR

SEQ ID NO: 39839 - protein, 14 aa, Homo sapiens
TCPEAPTDECKPVK

SEQ ID NO: 39840 - protein, 11 aa, Homo sapiens
TDCSGNFCLFR

SEQ ID NO: 39841 - protein, 10 aa, Homo sapiens
TFYYAVAVVK

SEQ ID NO: 39842 - protein, 24 aa, Homo sapiens
TGLGRSAGWNIPIGLLYCDLPEPR

SEQ ID NO: 39843 - protein, 9 aa, Homo sapiens
TIFENLANK

SEQ ID NO: 39844 - protein, 24 aa, Homo sapiens
TIFENLANKADRDQYELLCLDNTR

SEQ ID NO: 39845 - protein, 28 aa, Homo sapiens
TLDAGLVYDAYLAPNNLKPVVAEFYGSK

SEQ ID NO: 39846 - protein, 13 aa, Homo sapiens
TLNQYFGYSGAFK

SEQ ID NO: 39847 - protein, 13 aa, Homo sapiens
TPEAGYFAVAVVK

SEQ ID NO: 39848 - protein, 24 aa, Homo sapiens
TRKPVDEYKDCHLAQVPSHTVVAR

SEQ ID NO: 39849 - protein, 15 aa, Homo sapiens
TRKPVEEYANCHLAR

SEQ ID NO: 39850 - protein, 10 aa, Homo sapiens
TVCLAKLHDR

SEQ ID NO: 39851 - protein, 12 aa, Homo sapiens
TYEKYLGEEYVK

SEQ ID NO: 39852 - protein, 16 aa, Homo sapiens
VAFVKHQTVPQNTGGK

SEQ ID NO: 39853 - protein, 20 aa, Homo sapiens
VDEYKDCHLAQVPSHTVVAR

SEQ ID NO: 39854 - protein, 11 aa, Homo sapiens
VEEYANCHLAR

SEQ ID NO: 39855 - protein, 10 aa, Homo sapiens
VEKGDVAFVK

SEQ ID NO: 39856 - protein, 20 aa, Homo sapiens
VKHQTVPQNTGGKNPDPWAK

SEQ ID NO: 39857 - protein, 18 aa, Homo sapiens
VPDKTVRWCAVSEHEATK

SEQ ID NO: 39858 - protein, 12 aa, Homo sapiens
VTDCSGNFCLFR

SEQ ID NO: 39859 - protein, 22 aa, Homo sapiens
VYDAYLAPNNLKPVVAEFYGSK

SEQ ID NO: 39860 - protein, 9 aa, Homo sapiens
WCALSHHER

SEQ ID NO: 39861 - protein, 9 aa, Homo sapiens
WCAVSEHEA

SEQ ID NO: 39862 - protein, 11 aa, Homo sapiens
WCAVSEHEATK

SEQ ID NO: 39863 - protein, 16 aa, Homo sapiens
WCAVSEHEATKCQSFR

SEQ ID NO: 39864 - protein, 20 aa, Homo sapiens
WCAVSEHEATKCQSFRDHMK

SEQ ID NO: 39865 - protein, 13 aa, Homo sapiens
WELLNQAQEHFGK

SEQ ID NO: 39866 - protein, 15 aa, Homo sapiens
WELLNQAQEHFGKDK

SEQ ID NO: 39867 - protein, 16 aa, Homo sapiens
WNIPIGLLYCDLPEPR

SEQ ID NO: 39868 - protein, 8 aa, Homo sapiens
YANCHLAR

SEQ ID NO: 39869 - protein, 8 aa, Homo sapiens
YCDLPEPR

SEQ ID NO: 39870 - protein, 13 aa, Homo sapiens
YCDLPEPRKPLEK

SEQ ID NO: 39871 - protein, 21 aa, Homo sapiens
YDAYLAPNNLKPVVAEFYGSK

SEQ ID NO: 39872 - protein, 11 aa, Homo sapiens
YEKYLGEEYVK

SEQ ID NO: 39873 - protein, 18 aa, Homo sapiens
YLAPNNLKPVVAEFYGSK

SEQ ID NO: 39874 - protein, 8 aa, Homo sapiens
YLGEEYVK

SEQ ID NO: 39875 - protein, 14 aa, Homo sapiens
YLGEEYVKAVGNLR

SEQ ID NO: 39876 - protein, 15 aa, Homo sapiens
YLGEEYVKAVGNLRK

SEQ ID NO: 39877 - protein, 11 aa, Homo sapiens
YLGYEYVTAIR

SEQ ID NO: 39878 - protein, 18 aa, Homo sapiens
DMLMEGTEEVEAELPDSR

SEQ ID NO: 39879 - protein, 18 aa, Homo sapiens
EELQMSLLKLNNEYEVIK

SEQ ID NO: 39880 - protein, 11 aa, Homo sapiens
ENSHLKTEYHK

SEQ ID NO: 39881 - protein, 11 aa, Homo sapiens
HMILIKDQLSK

SEQ ID NO: 39882 - protein, 15 aa, Homo sapiens
IYEMQKTIQVLQIEK

SEQ ID NO: 39883 - protein, 18 aa, Homo sapiens
KAKSDQLLSSNENFTNKV

SEQ ID NO: 39884 - protein, 9 aa, Homo sapiens
KLCTDLEEK

SEQ ID NO: 39885 - protein, 20 aa, Homo sapiens
KLMSLANSSEGKVDKVLMRN

SEQ ID NO: 39886 - protein, 30 aa, Homo sapiens
KLVSSSNAMENASHQASVQVESLQEQLNVV

SEQ ID NO: 39887 - protein, 15 aa, Homo sapiens
KNISLTKQIDQLSKD

SEQ ID NO: 39888 - protein, 9 aa, Homo sapiens
QEMLDDVQK

SEQ ID NO: 39889 - protein, 10 aa, Homo sapiens
QKQLIAEWKK

SEQ ID NO: 39890 - protein, 14 aa, Homo sapiens
QNLSELEQLNENLK

SEQ ID NO: 39891 - protein, 13 aa, Homo sapiens
VESTKKMEQLEDK

SEQ ID NO: 39892 - protein, 6 aa, Homo sapiens
VLQIEK

SEQ ID NO: 39893 - protein, 33 aa, Homo sapiens
KSKEQNVSDDPESTGFLYPYNDLLVWAVLMKRQ

SEQ ID NO: 39894 - protein, 12 aa, Homo sapiens
MIQNTFNFSLKQ

SEQ ID NO: 39895 - protein, 18 aa, Homo sapiens
ELAEITLDPPPNCSAGPK

SEQ ID NO: 39896 - protein, 18 aa, Homo sapiens
IYHCNINSQGVICLDILK

SEQ ID NO: 39897 - protein, 18 aa, Homo sapiens
GQVCLPVISAENWKPATK

SEQ ID NO: 39898 - protein, 15 aa, Homo sapiens
IEINFPAEYPFKPPK

SEQ ID NO: 39899 - protein, 9 aa, Homo sapiens
IYHPNIDEK

SEQ ID NO: 39900 - protein, 16 aa, Homo sapiens
NAEEFTKKYGEKRPVD

SEQ ID NO: 39901 - protein, 22 aa, Homo sapiens
TDQVIQSLIALVNDPQPEHPLR

SEQ ID NO: 39902 - protein, 17 aa, Homo sapiens
ADALQAGASQFETSAAK

SEQ ID NO: 39903 - protein, 16 aa, Homo sapiens
LQQTQAQVDEVVDIMR

SEQ ID NO: 39904 - protein, 7 aa, Homo sapiens
LSELDDR

SEQ ID NO: 39905 - protein, 22 aa, Homo sapiens
AAVALSSLIHALDDLDMVAIVR

SEQ ID NO: 39906 - protein, 19 aa, Homo sapiens
ALSSLIHALDDLDMVAIVR

SEQ ID NO: 39907 - protein, 28 aa, Homo sapiens
ASFEEASNQLINHIEQFLDTNETPYFMK

SEQ ID NO: 39908 - protein, 21 aa, Homo sapiens
AVALSSLIHALDDLDMVAIVR

SEQ ID NO: 39909 - protein, 26 aa, Homo sapiens
DDEAAAVALSSLIHALDDLDMVAIVR

SEQ ID NO: 39910 - protein, 24 aa, Homo sapiens
DKPSGDTAAVFEEGGDVDDLLDMI

SEQ ID NO: 39911 - protein, 23 aa, Homo sapiens
EPLPPIQQHIWNMLNPPAEVTTK

SEQ ID NO: 39912 - protein, 16 aa, Homo sapiens
ETVYCLNDDDETEVLK

SEQ ID NO: 39913 - protein, 24 aa, Homo sapiens
ETVYCLNDDDETEVLKEDIIQGFR

SEQ ID NO: 39914 - protein, 11 aa, Homo sapiens
HIEIFTDLSSR

SEQ ID NO: 39915 - protein, 16 aa, Homo sapiens
HLMLPDFDLLEDIESK

SEQ ID NO: 39916 - protein, 18 aa, Homo sapiens
HNYECLVYVQLPFMEDLR

SEQ ID NO: 39917 - protein, 28 aa, Homo sapiens
IQPGSQQADFLDALIVSMDVIQHETIGK

SEQ ID NO: 39918 - protein, 8 aa, Homo sapiens
LFQCLLHR

SEQ ID NO: 39919 - protein, 11 aa, Homo sapiens
LGGHGPSFPLK

SEQ ID NO: 39920 - protein, 26 aa, Homo sapiens
PGSQQADFLDALIVSMDVIQHETIGK

SEQ ID NO: 39921 - protein, 19 aa, Homo sapiens
QLNHFWEIVVQDGITLITK

SEQ ID NO: 39922 - protein, 20 aa, Homo sapiens
VALSSLIHALDDLDMVAIVR

SEQ ID NO: 39923 - protein, 22 aa, Homo sapiens
YAPTEAQLNAVDALIDSMSLAK

SEQ ID NO: 39924 - protein, 14 aa, Homo sapiens
KAFRNHSFLLIHQR

SEQ ID NO: 39925 - protein, 21 aa, Homo sapiens
RDVMLENYSHLVSVGYLVAKP

SEQ ID NO: 39926 - protein, 22 aa, Homo sapiens
EDIEMDEIIEEQEDENICFSAR

SEQ ID NO: 39927 - protein, 20 aa, Homo sapiens
KSALQVLVSILKHCDVSGMK

SEQ ID NO: 39928 - protein, 22 aa, Homo sapiens
MVDKYIPNISMCLKDSDPFIRK

SEQ ID NO: 39929 - protein, 26 aa, Homo sapiens
APPGFLGSLVPVVVETLGDAYPELQR

SEQ ID NO: 39930 - protein, 21 aa, Homo sapiens
HSTYDTDLFSPLLNAIQQGCR

SEQ ID NO: 39931 - protein, 27 aa, Homo sapiens
KNLSEMQDLEEIRKITGVCPQFNVQFD

SEQ ID NO: 39932 - protein, 36 aa, Homo sapiens
KSLKHQNILLEVDDFENRNGTDGLSYNGAIIVSGKQ

SEQ ID NO: 39933 - protein, 9 aa, Homo sapiens
ALAIEEFCK

SEQ ID NO: 39934 - protein, 19 aa, Homo sapiens
EAEHHCLLHSPIPVNCPIR

SEQ ID NO: 39935 - protein, 20 aa, Homo sapiens
FDYSGVGSSDGNSEESTLGK

SEQ ID NO: 39936 - protein, 21 aa, Homo sapiens
LLHGMKDDIVPWHTSMQVADR

SEQ ID NO: 39937 - protein, 8 aa, Homo sapiens
SLGHACIR

SEQ ID NO: 39938 - protein, 16 aa, Homo sapiens
AGHFDKEIVPVLVSTR

SEQ ID NO: 39939 - protein, 24 aa, Homo sapiens
APEDVSEVIFGHVLAAGCGQNPVR

SEQ ID NO: 39940 - protein, 8 aa, Homo sapiens
APHLAYLR

SEQ ID NO: 39941 - protein, 27 aa, Homo sapiens
ATVAPEDVSEVIFGHVLAAGCGQNPVR

SEQ ID NO: 39942 - protein, 10 aa, Homo sapiens
HGSNIEAMSK

SEQ ID NO: 39943 - protein, 11 aa, Homo sapiens
ILVTLLHTLER

SEQ ID NO: 39944 - protein, 23 aa, Homo sapiens
IVSWSQVGVEPSIMGIGPIPAIK

SEQ ID NO: 39945 - protein, 23 aa, Homo sapiens
PEDVSEVIFGHVLAAGCGQNPVR

SEQ ID NO: 39946 - protein, 24 aa, Homo sapiens
TIIGSFNGALAAVPVQDLGSTVIK

SEQ ID NO: 39947 - protein, 20 aa, Homo sapiens
VNIEGGAIALGHPLGASGCR

SEQ ID NO: 39948 - protein, 8 aa, Homo sapiens
NQSFCNKI

SEQ ID NO: 39949 - protein, 17 aa, Homo sapiens
APEEHPVLLTEAPLNPK

SEQ ID NO: 39950 - protein, 22 aa, Homo sapiens
CYVALDFEQEMATAASSSSLEK

SEQ ID NO: 39951 - protein, 17 aa, Homo sapiens
DDDIAALVVDNGSGMCK

SEQ ID NO: 39952 - protein, 24 aa, Homo sapiens
DSGDGVTHTVPIYEGYALPHAILR

SEQ ID NO: 39953 - protein, 23 aa, Homo sapiens
FQPSFLGMESCGIHETTFNSIMK

SEQ ID NO: 39954 - protein, 22 aa, Homo sapiens
KDLYANTVLSGGTTMYPGIADR

SEQ ID NO: 39955 - protein, 18 aa, Homo sapiens
MDDDIAALVVDNGSGMCK

SEQ ID NO: 39956 - protein, 19 aa, Homo sapiens
MDDDIAALVVDNGSGMCKA

SEQ ID NO: 39957 - protein, 16 aa, Homo sapiens
PEEHPVLLTEAPLNPK

SEQ ID NO: 39958 - protein, 21 aa, Homo sapiens
PSFLGMESCGIHETTFNSIMK

SEQ ID NO: 39959 - protein, 22 aa, Homo sapiens
TTGIVMDSGDGVTHTVPIYEGY

SEQ ID NO: 39960 - protein, 26 aa, Homo sapiens
TTGIVMDSGDGVTHTVPIYEGYALPH

SEQ ID NO: 39961 - protein, 30 aa, Homo sapiens
TTGIVMDSGDGVTHTVPIYEGYALPHAILR

SEQ ID NO: 39962 - protein, 16 aa, Homo sapiens
TVLSGGTTMYPGIADR

SEQ ID NO: 39963 - protein, 20 aa, Homo sapiens
VALDFEQEMATAASSSSLEK

SEQ ID NO: 39964 - protein, 21 aa, Homo sapiens
VAPEEHPVLLTEAPLNPKANR

SEQ ID NO: 39965 - protein, 17 aa, Homo sapiens
AGTQIENIEEDFRNGLK

SEQ ID NO: 39966 - protein, 8 aa, Homo sapiens
ASFNHFDR

SEQ ID NO: 39967 - protein, 13 aa, Homo sapiens
CQLEINFNTLQTK

SEQ ID NO: 39968 - protein, 10 aa, Homo sapiens
DLLLDPAWEK

SEQ ID NO: 39969 - protein, 9 aa, Homo sapiens
EGLLLWCQR

SEQ ID NO: 39970 - protein, 14 aa, Homo sapiens
FAIQDISVEETSAK

SEQ ID NO: 39971 - protein, 11 aa, Homo sapiens
GYEEWLLNEIR

SEQ ID NO: 39972 - protein, 10 aa, Homo sapiens
HTNYTMEHIR

SEQ ID NO: 39973 - protein, 13 aa, Homo sapiens
ISNRPAFMPSEGK

SEQ ID NO: 39974 - protein, 15 aa, Homo sapiens
KHEAFESDLAAHQDR

SEQ ID NO: 39975 - protein, 11 aa, Homo sapiens
TFTAWCNSHLR

SEQ ID NO: 39976 - protein, 30 aa, Homo sapiens
GIALPANTAEGLLNVIGMDKPLTLPDFLAK

SEQ ID NO: 39977 - protein, 16 aa, Homo sapiens
LGHGYHTLEDQALYNR

SEQ ID NO: 39978 - protein, 17 aa, Homo sapiens
NDQANYSLNTDDPLIFK

SEQ ID NO: 39979 - protein, 31 aa, Homo sapiens
VEPIPWNQAEGDLTPDEVVALVGQGLQEGER

SEQ ID NO: 39980 - protein, 20 aa, Homo sapiens
VQVCSLPACGGNHQNSTVRA

SEQ ID NO: 39981 - protein, 30 aa, Homo sapiens
RQPGKAPNFSVNWTVGDSAIEVINATTGKD

SEQ ID NO: 39982 - protein, 15 aa, Homo sapiens
KAAHNNSENIPLHKS

SEQ ID NO: 39983 - protein, 30 aa, Homo sapiens
MKDFLTDRSNQSHLVGVPKPGVPQTPVNKI

SEQ ID NO: 39984 - protein, 16 aa, Homo sapiens
AAGAPGASDADGLKPR

SEQ ID NO: 39985 - protein, 22 aa, Homo sapiens
ADVQTDAGCLSEPVASALIPVK

SEQ ID NO: 39986 - protein, 17 aa, Homo sapiens
DTCVQSPISSFPCTDLK

SEQ ID NO: 39987 - protein, 16 aa, Homo sapiens
ISSVQPICLDSFTGPR

SEQ ID NO: 39988 - protein, 7 aa, Homo sapiens
NHFGVGR

SEQ ID NO: 39989 - protein, 19 aa, Homo sapiens
QFLLSPAEVPNWYEFSGCR

SEQ ID NO: 39990 - protein, 11 aa, Homo sapiens
AAADPHECYAK

SEQ ID NO: 39991 - protein, 7 aa, Homo sapiens
AACLLPK

SEQ ID NO: 39992 - protein, 12 aa, Homo sapiens
AACLLPKLDELR

SEQ ID NO: 39993 - protein, 16 aa, Homo sapiens
AACLLPKLDELRDEGK

SEQ ID NO: 39994 - protein, 21 aa, Homo sapiens
AACLLPKLDELRDEGKASSAK

SEQ ID NO: 39995 - protein, 23 aa, Homo sapiens
AACLLPKLDELRDEGKASSAKQR

SEQ ID NO: 39996 - protein, 11 aa, Homo sapiens
AADKAACLLPK

SEQ ID NO: 39997 - protein, 12 aa, Homo sapiens
AAFTECCQAADK

SEQ ID NO: 39998 - protein, 19 aa, Homo sapiens
AAFTECCQAADKAACLLPK

SEQ ID NO: 39999 - protein, 28 aa, Homo sapiens
AAFTECCQAADKAACLLPKLDELRDEGK

SEQ ID NO: 40000 - protein, 33 aa, Homo sapiens
AAFTECCQAADKAACLLPKLDELRDEGKASSAK

SEQ ID NO: 40001 - protein, 35 aa, Homo sapiens
AAFTECCQAADKAACLLPKLDELRDEGKASSAKQR

SEQ ID NO: 40002 - protein, 15 aa, Homo sapiens
ACLLPKLDELRDEGK

SEQ ID NO: 40003 - protein, 12 aa, Homo sapiens
ADDKETCFAEEG

SEQ ID NO: 40004 - protein, 13 aa, Homo sapiens
ADDKETCFAEEGK

SEQ ID NO: 40005 - protein, 14 aa, Homo sapiens
ADDKETCFAEEGKK

SEQ ID NO: 40006 - protein, 24 aa, Homo sapiens
ADDKETCFAEEGKKLVAASQAALG

SEQ ID NO: 40007 - protein, 25 aa, Homo sapiens
ADDKETCFAEEGKKLVAASQAALGL

SEQ ID NO: 40008 - protein, 21 aa, Homo sapiens
ADDRADLAKYICENQDSISSK

SEQ ID NO: 40009 - protein, 19 aa, Homo sapiens
ADESAENCDKSLHTLFGDK

SEQ ID NO: 40010 - protein, 9 aa, Homo sapiens
ADICTLSEK

SEQ ID NO: 40011 - protein, 17 aa, Homo sapiens
ADLAKYICENQDSISSK

SEQ ID NO: 40012 - protein, 14 aa, Homo sapiens
ADLPSLAADFVESK

SEQ ID NO: 40013 - protein, 18 aa, Homo sapiens
AEDYLSVVLNQLCVLHEK

SEQ ID NO: 40014 - protein, 17 aa, Homo sapiens
AEEGKKLVAASQAALGL

SEQ ID NO: 40015 - protein, 8 aa, Homo sapiens
AEFAEVSK

SEQ ID NO: 40016 - protein, 15 aa, Homo sapiens
AEFAEVSKLVTDLTK

SEQ ID NO: 40017 - protein, 19 aa, Homo sapiens
AEFAEVSKLVTDLTKVHTE

SEQ ID NO: 40018 - protein, 15 aa, Homo sapiens
AENCDKSLHTLFGDK

SEQ ID NO: 40019 - protein, 16 aa, Homo sapiens
AETFTFHADICTLSEK

SEQ ID NO: 40020 - protein, 18 aa, Homo sapiens
AETFTFHADICTLSEKER

SEQ ID NO: 40021 - protein, 12 aa, Homo sapiens
AEVSKLVTDLTK

SEQ ID NO: 40022 - protein, 16 aa, Homo sapiens
AFAQYLQQCPFEDHVK

SEQ ID NO: 40023 - protein, 11 aa, Homo sapiens
AFHDNEETFLK

SEQ ID NO: 40024 - protein, 12 aa, Homo sapiens
AFHDNEETFLKK

SEQ ID NO: 40025 - protein, 9 aa, Homo sapiens
AFKAWAVAR

SEQ ID NO: 40026 - protein, 16 aa, Homo sapiens
AFKAWAVARLSQRFPK

SEQ ID NO: 40027 - protein, 24 aa, Homo sapiens
AFKAWAVARLSQRFPKAEFAEVSK

SEQ ID NO: 40028 - protein, 31 aa, Homo sapiens
AFKAWAVARLSQRFPKAEFAEVSKLVTDLTK

SEQ ID NO: 40029 - protein, 9 aa, Homo sapiens
AHKSEVAHR

SEQ ID NO: 40030 - protein, 19 aa, Homo sapiens
AHKSEVAHRFKDLGEENFK

SEQ ID NO: 40031 - protein, 23 aa, Homo sapiens
AKQEPERNECFLQHKDDNPNLPR

SEQ ID NO: 40032 - protein, 15 aa, Homo sapiens
AKTCVADESAENCDK

SEQ ID NO: 40033 - protein, 19 aa, Homo sapiens
AKVFDEFKPLVEEPQNLIK

SEQ ID NO: 40034 - protein, 11 aa, Homo sapiens
ALEVDETYVPK

SEQ ID NO: 40035 - protein, 7 aa, Homo sapiens
ALVELVK

SEQ ID NO: 40036 - protein, 21 aa, Homo sapiens
ALVLIAFAQYLQQCPFEDHVK

SEQ ID NO: 40037 - protein, 31 aa, Homo sapiens
ALVLIAFAQYLQQCPFEDHVKLVNEVTEFAK

SEQ ID NO: 40038 - protein, 9 aa, Homo sapiens
APELLFFAK

SEQ ID NO: 40039 - protein, 10 aa, Homo sapiens
APELLFFAKR

SEQ ID NO: 40040 - protein, 12 aa, Homo sapiens
APELLFFAKRYK

SEQ ID NO: 40041 - protein, 14 aa, Homo sapiens
AQYLQQCPFEDHVK

SEQ ID NO: 40042 - protein, 24 aa, Homo sapiens
AQYLQQCPFEDHVKLVNEVTEFAK

SEQ ID NO: 40043 - protein, 18 aa, Homo sapiens
ASLQKFGERAFKAWAVAR

SEQ ID NO: 40044 - protein, 7 aa, Homo sapiens
ATKEQLK

SEQ ID NO: 40045 - protein, 11 aa, Homo sapiens
ATKEQLKAVMD

SEQ ID NO: 40046 - protein, 19 aa, Homo sapiens
ATKEQLKAVMDDFAAFVEK

SEQ ID NO: 40047 - protein, 20 aa, Homo sapiens
ATKEQLKAVMDDFAAFVEKC

SEQ ID NO: 40048 - protein, 12 aa, Homo sapiens
AVMDDFAAFVEK

SEQ ID NO: 40049 - protein, 13 aa, Homo sapiens
AVMDDFAAFVEKC

SEQ ID NO: 40050 - protein, 15 aa, Homo sapiens
AVMDDFAAFVEKCCK

SEQ ID NO: 40051 - protein, 6 aa, Homo sapiens
AWAVAR

SEQ ID NO: 40052 - protein, 21 aa, Homo sapiens
AWAVARLSQRFPKAEFAEVSK

SEQ ID NO: 40053 - protein, 12 aa, Homo sapiens
CAAADPHECYAK

SEQ ID NO: 40054 - protein, 19 aa, Homo sapiens
CAEDYLSVVLNQLCVLHEK

SEQ ID NO: 40055 - protein, 6 aa, Homo sapiens
CASLQK

SEQ ID NO: 40056 - protein, 10 aa, Homo sapiens
CASLQKFGER

SEQ ID NO: 40057 - protein, 19 aa, Homo sapiens
CASLQKFGERAFKAWAVAR

SEQ ID NO: 40058 - protein, 20 aa, Homo sapiens
CASLQKFGERAFKAWAVARL

SEQ ID NO: 40059 - protein, 9 aa, Homo sapiens
CCAAADPHE

SEQ ID NO: 40060 - protein, 13 aa, Homo sapiens
CCAAADPHECYAK

SEQ ID NO: 40061 - protein, 9 aa, Homo sapiens
CCEKPLLEK

SEQ ID NO: 40062 - protein, 13 aa, Homo sapiens
CCHGDLLECADDR

SEQ ID NO: 40063 - protein, 17 aa, Homo sapiens
CCKADDKETCFAEEGKK

SEQ ID NO: 40064 - protein, 8 aa, Homo sapiens
CCKHPEAK

SEQ ID NO: 40065 - protein, 9 aa, Homo sapiens
CCTESLVNR

SEQ ID NO: 40066 - protein, 8 aa, Homo sapiens
CEKPLLEK

SEQ ID NO: 40067 - protein, 11 aa, Homo sapiens
CELFEQLGEYK

SEQ ID NO: 40068 - protein, 10 aa, Homo sapiens
CENQDSISSK

SEQ ID NO: 40069 - protein, 14 aa, Homo sapiens
CFLQHKDDNPNLPR

SEQ ID NO: 40070 - protein, 14 aa, Homo sapiens
CFSALEVDETYVPK

SEQ ID NO: 40071 - protein, 12 aa, Homo sapiens
CHGDLLECADDR

SEQ ID NO: 40072 - protein, 17 aa, Homo sapiens
CHGDLLECADDRADLAK

SEQ ID NO: 40073 - protein, 25 aa, Homo sapiens
CIAEVENDEMPADLPSLAADFVESK

SEQ ID NO: 40074 - protein, 14 aa, Homo sapiens
CLLPKLDELRDEGK

SEQ ID NO: 40075 - protein, 13 aa, Homo sapiens
CQAADKAACLLPK

SEQ ID NO: 40076 - protein, 13 aa, Homo sapiens
CTAFHDNEETFLK

SEQ ID NO: 40077 - protein, 14 aa, Homo sapiens
CTAFHDNEETFLKK

SEQ ID NO: 40078 - protein, 12 aa, Homo sapiens
CVADESAENCDK

SEQ ID NO: 40079 - protein, 10 aa, Homo sapiens
DAHKSEVAHR

SEQ ID NO: 40080 - protein, 11 aa, Homo sapiens
DAHKSEVAHRF

SEQ ID NO: 40081 - protein, 12 aa, Homo sapiens
DAHKSEVAHRFK

SEQ ID NO: 40082 - protein, 13 aa, Homo sapiens
DAHKSEVAHRFKD

SEQ ID NO: 40083 - protein, 14 aa, Homo sapiens
DAHKSEVAHRFKDL

SEQ ID NO: 40084 - protein, 15 aa, Homo sapiens
DAHKSEVAHRFKDLG

SEQ ID NO: 40085 - protein, 16 aa, Homo sapiens
DAHKSEVAHRFKDLGE

SEQ ID NO: 40086 - protein, 18 aa, Homo sapiens
DAHKSEVAHRFKDLGEEN

SEQ ID NO: 40087 - protein, 20 aa, Homo sapiens
DAHKSEVAHRFKDLGEENFK

SEQ ID NO: 40088 - protein, 9 aa, Homo sapiens
DDFAAFVEK

SEQ ID NO: 40089 - protein, 12 aa, Homo sapiens
DDKETCFAEEGK

SEQ ID NO: 40090 - protein, 13 aa, Homo sapiens
DDKETCFAEEGKK

SEQ ID NO: 40091 - protein, 8 aa, Homo sapiens
DDNPNLPR

SEQ ID NO: 40092 - protein, 15 aa, Homo sapiens
DEFKPLVEEPQNLIK

SEQ ID NO: 40093 - protein, 13 aa, Homo sapiens
DELRDEGKASSAK

SEQ ID NO: 40094 - protein, 18 aa, Homo sapiens
DEMPADLPSLAADFVESK

SEQ ID NO: 40095 - protein, 7 aa, Homo sapiens
DETYVPK

SEQ ID NO: 40096 - protein, 11 aa, Homo sapiens
DKETCFAEEGK

SEQ ID NO: 40097 - protein, 12 aa, Homo sapiens
DKETCFAEEGKK

SEQ ID NO: 40098 - protein, 8 aa, Homo sapiens
DLGEENFK

SEQ ID NO: 40099 - protein, 29 aa, Homo sapiens
DLGEENFKALVLIAFAQYLQQCPFEDHVK

SEQ ID NO: 40100 - protein, 9 aa, Homo sapiens
DLLECADDR

SEQ ID NO: 40101 - protein, 14 aa, Homo sapiens
DLLECADDRADLAK

SEQ ID NO: 40102 - protein, 13 aa, Homo sapiens
DLPSLAADFVESK

SEQ ID NO: 40103 - protein, 19 aa, Homo sapiens
DRADLAKYICENQDSISSK

SEQ ID NO: 40104 - protein, 10 aa, Homo sapiens
DVCKNYAEAK

SEQ ID NO: 40105 - protein, 23 aa, Homo sapiens
DVCKNYAEAKDVFLGMFLYEYAR

SEQ ID NO: 40106 - protein, 8 aa, Homo sapiens
DVFLGMFL

SEQ ID NO: 40107 - protein, 13 aa, Homo sapiens
DVFLGMFLYEYAR

SEQ ID NO: 40108 - protein, 14 aa, Homo sapiens
DVFLGMFLYEYARR

SEQ ID NO: 40109 - protein, 25 aa, Homo sapiens
DVFLGMFLYEYARRHPDYSVVLLLR

SEQ ID NO: 40110 - protein, 16 aa, Homo sapiens
DYLSVVLNQLCVLHEK

SEQ ID NO: 40111 - protein, 9 aa, Homo sapiens
DYSVVLLLR

SEQ ID NO: 40112 - protein, 10 aa, Homo sapiens
ECCEKPLLEK

SEQ ID NO: 40113 - protein, 14 aa, Homo sapiens
ECCHGDLLECADDR

SEQ ID NO: 40114 - protein, 15 aa, Homo sapiens
ECCQAADKAACLLPK

SEQ ID NO: 40115 - protein, 15 aa, Homo sapiens
ECFLQHKDDNPNLPR

SEQ ID NO: 40116 - protein, 22 aa, Homo sapiens
ECYAKVFDEFKPLVEEPQNLIK

SEQ ID NO: 40117 - protein, 15 aa, Homo sapiens
EDHVKLVNEVTEFAK

SEQ ID NO: 40118 - protein, 17 aa, Homo sapiens
EDYLSVVLNQLCVLHEK

SEQ ID NO: 40119 - protein, 14 aa, Homo sapiens
EFAEVSKLVTDLTK

SEQ ID NO: 40120 - protein, 26 aa, Homo sapiens
EFAKTCVADESAENCDKSLHTLFGDK

SEQ ID NO: 40121 - protein, 14 aa, Homo sapiens
EFKPLVEEPQNLIK

SEQ ID NO: 40122 - protein, 10 aa, Homo sapiens
EFNAETFTFH

SEQ ID NO: 40123 - protein, 11 aa, Homo sapiens
EFNAETFTFHA

SEQ ID NO: 40124 - protein, 12 aa, Homo sapiens
EFNAETFTFHAD

SEQ ID NO: 40125 - protein, 14 aa, Homo sapiens
EFNAETFTFHADIC

SEQ ID NO: 40126 - protein, 16 aa, Homo sapiens
EFNAETFTFHADICTL

SEQ ID NO: 40127 - protein, 19 aa, Homo sapiens
EFNAETFTFHADICTLSEK

SEQ ID NO: 40128 - protein, 21 aa, Homo sapiens
EFNAETFTFHADICTLSEKER

SEQ ID NO: 40129 - protein, 17 aa, Homo sapiens
EMPADLPSLAADFVESK

SEQ ID NO: 40130 - protein, 20 aa, Homo sapiens
ENDEMPADLPSLAADFVESK

SEQ ID NO: 40131 - protein, 20 aa, Homo sapiens
EPERNECFLQHKDDNPNLPR

SEQ ID NO: 40132 - protein, 15 aa, Homo sapiens
EQLGEYKFQNALLVR

SEQ ID NO: 40133 - protein, 16 aa, Homo sapiens
EQLKAVMDDFAAFVEK

SEQ ID NO: 40134 - protein, 15 aa, Homo sapiens
ERQIKKQTALVELVK

SEQ ID NO: 40135 - protein, 19 aa, Homo sapiens
ERQIKKQTALVELVKHKPK

SEQ ID NO: 40136 - protein, 17 aa, Homo sapiens
ESAENCDKSLHTLFGDK

SEQ ID NO: 40137 - protein, 9 aa, Homo sapiens
ETCFAEEGK

SEQ ID NO: 40138 - protein, 10 aa, Homo sapiens
ETCFAEEGKK

SEQ ID NO: 40139 - protein, 15 aa, Homo sapiens
ETFTFHADICTLSEK

SEQ ID NO: 40140 - protein, 12 aa, Homo sapiens
ETYGEMADCCAK

SEQ ID NO: 40141 - protein, 17 aa, Homo sapiens
ETYGEMADCCAKQEPER

SEQ ID NO: 40142 - protein, 33 aa, Homo sapiens
ETYGEMADCCAKQEPERNECFLQHKDDNPNLPR

SEQ ID NO: 40143 - protein, 9 aa, Homo sapiens
EVDETYVPK

SEQ ID NO: 40144 - protein, 22 aa, Homo sapiens
EVENDEMPADLPSLAADFVESK

SEQ ID NO: 40145 - protein, 23 aa, Homo sapiens
EVENDEMPADLPSLAADFVESKD

SEQ ID NO: 40146 - protein, 13 aa, Homo sapiens
FAEVSKLVTDLTK

SEQ ID NO: 40147 - protein, 15 aa, Homo sapiens
FAQYLQQCPFEDHVK

SEQ ID NO: 40148 - protein, 16 aa, Homo sapiens
FDEFKPLVEEPQNLIK

SEQ ID NO: 40149 - protein, 16 aa, Homo sapiens
FEDHVKLVNEVTEFAK

SEQ ID NO: 40150 - protein, 8 aa, Homo sapiens
FEQLGEYK

SEQ ID NO: 40151 - protein, 16 aa, Homo sapiens
FEQLGEYKFQNALLVR

SEQ ID NO: 40152 - protein, 12 aa, Homo sapiens
FGDKLCTVATLR

SEQ ID NO: 40153 - protein, 7 aa, Homo sapiens
FGERAFK

SEQ ID NO: 40154 - protein, 13 aa, Homo sapiens
FGERAFKAWAVAR

SEQ ID NO: 40155 - protein, 10 aa, Homo sapiens
FHDNEETFLK

SEQ ID NO: 40156 - protein, 11 aa, Homo sapiens
FHDNEETFLKK

SEQ ID NO: 40157 - protein, 8 aa, Homo sapiens
FKAWAVAR

SEQ ID NO: 40158 - protein, 10 aa, Homo sapiens
FKDLGEENFK

SEQ ID NO: 40159 - protein, 12 aa, Homo sapiens
FKDLGEENFKAL

SEQ ID NO: 40160 - protein, 14 aa, Homo sapiens
FKDLGEENFKALVL

SEQ ID NO: 40161 - protein, 31 aa, Homo sapiens
FKDLGEENFKALVLIAFAQYLQQCPFEDHVK

SEQ ID NO: 40162 - protein, 13 aa, Homo sapiens
FKPLVEEPQNLIK

SEQ ID NO: 40163 - protein, 11 aa, Homo sapiens
FLGMFLYEYAR

SEQ ID NO: 40164 - protein, 13 aa, Homo sapiens
FLQHKDDNPNLPR

SEQ ID NO: 40165 - protein, 11 aa, Homo sapiens
FPKAEFAEVSK

SEQ ID NO: 40166 - protein, 18 aa, Homo sapiens
FPKAEFAEVSKLVTDLTK

SEQ ID NO: 40167 - protein, 8 aa, Homo sapiens
FQNALLVR

SEQ ID NO: 40168 - protein, 11 aa, Homo sapiens
FQNALLVRYTK

SEQ ID NO: 40169 - protein, 13 aa, Homo sapiens
FSALEVDETYVPK

SEQ ID NO: 40170 - protein, 34 aa, Homo sapiens
FSALEVDETYVPKEFNAETFTFHADICTLSEKER

SEQ ID NO: 40171 - protein, 10 aa, Homo sapiens
FTECCQAADK

SEQ ID NO: 40172 - protein, 17 aa, Homo sapiens
FTECCQAADKAACLLPK

SEQ ID NO: 40173 - protein, 13 aa, Homo sapiens
FTFHADICTLSEK

SEQ ID NO: 40174 - protein, 11 aa, Homo sapiens
FYAPELLFFAK

SEQ ID NO: 40175 - protein, 12 aa, Homo sapiens
FYAPELLFFAKR

SEQ ID NO: 40176 - protein, 11 aa, Homo sapiens
GDKLCTVATLR

SEQ ID NO: 40177 - protein, 15 aa, Homo sapiens
GDLLECADDRADLAK

SEQ ID NO: 40178 - protein, 9 aa, Homo sapiens
GEMADCCAK

SEQ ID NO: 40179 - protein, 12 aa, Homo sapiens
GEYKFQNALLVR

SEQ ID NO: 40180 - protein, 10 aa, Homo sapiens
HADICTLSEK

SEQ ID NO: 40181 - protein, 12 aa, Homo sapiens
HADICTLSEKER

SEQ ID NO: 40182 - protein, 9 aa, Homo sapiens
HDNEETFLK

SEQ ID NO: 40183 - protein, 11 aa, Homo sapiens
HGDLLECADDR

SEQ ID NO: 40184 - protein, 16 aa, Homo sapiens
HGDLLECADDRADLAK

SEQ ID NO: 40185 - protein, 10 aa, Homo sapiens
HKDDNPNLPR

SEQ ID NO: 40186 - protein, 11 aa, Homo sapiens
HKPKATKEQLK

SEQ ID NO: 40187 - protein, 23 aa, Homo sapiens
HKPKATKEQLKAVMDDFAAFVEK

SEQ ID NO: 40188 - protein, 8 aa, Homo sapiens
HKSEVAHR

SEQ ID NO: 40189 - protein, 11 aa, Homo sapiens
HPDYSVVLLLR

SEQ ID NO: 40190 - protein, 14 aa, Homo sapiens
HPDYSVVLLLRLAK

SEQ ID NO: 40191 - protein, 22 aa, Homo sapiens
HPDYSVVLLLRLAKTYETTLEK

SEQ ID NO: 40192 - protein, 10 aa, Homo sapiens
HPYFYAPELL

SEQ ID NO: 40193 - protein, 11 aa, Homo sapiens
HPYFYAPELLF

SEQ ID NO: 40194 - protein, 12 aa, Homo sapiens
HPYFYAPELLFF

SEQ ID NO: 40195 - protein, 14 aa, Homo sapiens
HPYFYAPELLFFAK

SEQ ID NO: 40196 - protein, 15 aa, Homo sapiens
HPYFYAPELLFFAKR

SEQ ID NO: 40197 - protein, 17 aa, Homo sapiens
HPYFYAPELLFFAKRYK

SEQ ID NO: 40198 - protein, 16 aa, Homo sapiens
HTECCHGDLLECADDR

SEQ ID NO: 40199 - protein, 21 aa, Homo sapiens
HTECCHGDLLECADDRADLAK

SEQ ID NO: 40200 - protein, 7 aa, Homo sapiens
HTLFGDK

SEQ ID NO: 40201 - protein, 15 aa, Homo sapiens
HTLFGDKLCTVATLR

SEQ ID NO: 40202 - protein, 13 aa, Homo sapiens
HVKLVNEVTEFAK

SEQ ID NO: 40203 - protein, 24 aa, Homo sapiens
IAEVENDEMPADLPSLAADFVESK

SEQ ID NO: 40204 - protein, 17 aa, Homo sapiens
IAFAQYLQQCPFEDHVK

SEQ ID NO: 40205 - protein, 11 aa, Homo sapiens
ICENQDSISSK

SEQ ID NO: 40206 - protein, 13 aa, Homo sapiens
ICENQDSISSKLK

SEQ ID NO: 40207 - protein, 13 aa, Homo sapiens
KAAFTECCQAADK

SEQ ID NO: 40208 - protein, 14 aa, Homo sapiens
KADDKETCFAEEGK

SEQ ID NO: 40209 - protein, 15 aa, Homo sapiens
KADDKETCFAEEGKK

SEQ ID NO: 40210 - protein, 16 aa, Homo sapiens
KAEFAEVSKLVTDLTK

SEQ ID NO: 40211 - protein, 13 aa, Homo sapiens
KAVMDDFAAFVEK

SEQ ID NO: 40212 - protein, 18 aa, Homo sapiens
KCCKADDKETCFAEEGKK

SEQ ID NO: 40213 - protein, 9 aa, Homo sapiens
KDLGEENFK

SEQ ID NO: 40214 - protein, 11 aa, Homo sapiens
KECCEKPLLEK

SEQ ID NO: 40215 - protein, 17 aa, Homo sapiens
KEQLKAVMDDFAAFVEK

SEQ ID NO: 40216 - protein, 11 aa, Homo sapiens
KETCFAEEGKK

SEQ ID NO: 40217 - protein, 9 aa, Homo sapiens
KFQNALLVR

SEQ ID NO: 40218 - protein, 24 aa, Homo sapiens
KHKPKATKEQLKAVMDDFAAFVEK

SEQ ID NO: 40219 - protein, 16 aa, Homo sapiens
KKVPQVSTPTLVEVSR

SEQ ID NO: 40220 - protein, 12 aa, Homo sapiens
KLVAASQAALGL

SEQ ID NO: 40221 - protein, 11 aa, Homo sapiens
KLVNEVTEFAK

SEQ ID NO: 40222 - protein, 12 aa, Homo sapiens
KPLVEEPQNLIK

SEQ ID NO: 40223 - protein, 14 aa, Homo sapiens
KQNCELFEQLGEYK

SEQ ID NO: 40224 - protein, 10 aa, Homo sapiens
KQTALVELVK

SEQ ID NO: 40225 - protein, 12 aa, Homo sapiens
KQTALVELVKHK

SEQ ID NO: 40226 - protein, 14 aa, Homo sapiens
KQTALVELVKHKPK

SEQ ID NO: 40227 - protein, 21 aa, Homo sapiens
KQTALVELVKHKPKATKEQLK

SEQ ID NO: 40228 - protein, 28 aa, Homo sapiens
KSHCIAEVENDEMPADLPSLAADFVESK

SEQ ID NO: 40229 - protein, 14 aa, Homo sapiens
KTCVADESAENCDK

SEQ ID NO: 40230 - protein, 18 aa, Homo sapiens
KVFDEFKPLVEEPQNLIK

SEQ ID NO: 40231 - protein, 18 aa, Homo sapiens
KVHTECCHGDLLECADDR

SEQ ID NO: 40232 - protein, 23 aa, Homo sapiens
KVHTECCHGDLLECADDRADLAK

SEQ ID NO: 40233 - protein, 9 aa, Homo sapiens
KVPQVSTPT

SEQ ID NO: 40234 - protein, 10 aa, Homo sapiens
KVPQVSTPTL

SEQ ID NO: 40235 - protein, 12 aa, Homo sapiens
KVPQVSTPTLVE

SEQ ID NO: 40236 - protein, 13 aa, Homo sapiens
KVPQVSTPTLVEV

SEQ ID NO: 40237 - protein, 14 aa, Homo sapiens
KVPQVSTPTLVEVS

SEQ ID NO: 40238 - protein, 15 aa, Homo sapiens
KVPQVSTPTLVEVSR

SEQ ID NO: 40239 - protein, 17 aa, Homo sapiens
KVPQVSTPTLVEVSRNL

SEQ ID NO: 40240 - protein, 18 aa, Homo sapiens
KVPQVSTPTLVEVSRNLG

SEQ ID NO: 40241 - protein, 19 aa, Homo sapiens
KVPQVSTPTLVEVSRNLGK

SEQ ID NO: 40242 - protein, 21 aa, Homo sapiens
KVPQVSTPTLVEVSRNLGKVG

SEQ ID NO: 40243 - protein, 23 aa, Homo sapiens
KVPQVSTPTLVEVSRNLGKVGSK

SEQ ID NO: 40244 - protein, 13 aa, Homo sapiens
KYICENQDSISSK

SEQ ID NO: 40245 - protein, 8 aa, Homo sapiens
KYLYEIAR

SEQ ID NO: 40246 - protein, 9 aa, Homo sapiens
KYLYEIARR

SEQ ID NO: 40247 - protein, 9 aa, Homo sapiens
LAADFVESK

SEQ ID NO: 40248 - protein, 11 aa, Homo sapiens
LAKTYETTLEK

SEQ ID NO: 40249 - protein, 12 aa, Homo sapiens
LAKTYETTLEKC

SEQ ID NO: 40250 - protein, 24 aa, Homo sapiens
LAKTYETTLEKCCAAADPHECYAK

SEQ ID NO: 40251 - protein, 8 aa, Homo sapiens
LCTVATLR

SEQ ID NO: 40252 - protein, 20 aa, Homo sapiens
LCTVATLRETYGEMADCCAK

SEQ ID NO: 40253 - protein, 9 aa, Homo sapiens
LDELRDEGK

SEQ ID NO: 40254 - protein, 11 aa, Homo sapiens
LDELRDEGKAS

SEQ ID NO: 40255 - protein, 14 aa, Homo sapiens
LDELRDEGKASSAK

SEQ ID NO: 40256 - protein, 16 aa, Homo sapiens
LDELRDEGKASSAKQR

SEQ ID NO: 40257 - protein, 18 aa, Homo sapiens
LDELRDEGKASSAKQRLK

SEQ ID NO: 40258 - protein, 10 aa, Homo sapiens
LEVDETYVPK

SEQ ID NO: 40259 - protein, 10 aa, Homo sapiens
LGMFLYEYAR

SEQ ID NO: 40260 - protein, 18 aa, Homo sapiens
LIAFAQYLQQCPFEDHVK

SEQ ID NO: 40261 - protein, 14 aa, Homo sapiens
LKAVMDDFAAFVEK

SEQ ID NO: 40262 - protein, 8 aa, Homo sapiens
LKCASLQK

SEQ ID NO: 40263 - protein, 12 aa, Homo sapiens
LKCASLQKFGER

SEQ ID NO: 40264 - protein, 15 aa, Homo sapiens
LKCASLQKFGERAFK

SEQ ID NO: 40265 - protein, 20 aa, Homo sapiens
LKCASLQKFGERAFKAWAVA

SEQ ID NO: 40266 - protein, 21 aa, Homo sapiens
LKCASLQKFGERAFKAWAVAR

SEQ ID NO: 40267 - protein, 22 aa, Homo sapiens
LKCASLQKFGERAFKAWAVARL

SEQ ID NO: 40268 - protein, 12 aa, Homo sapiens
LKECCEKPLLEK

SEQ ID NO: 40269 - protein, 14 aa, Homo sapiens
LKECCEKPLLEKSH

SEQ ID NO: 40270 - protein, 8 aa, Homo sapiens
LLECADDR

SEQ ID NO: 40271 - protein, 13 aa, Homo sapiens
LLECADDRADLAK

SEQ ID NO: 40272 - protein, 31 aa, Homo sapiens
LLEKSHCIAEVENDEMPADLPSLAADFVESK

SEQ ID NO: 40273 - protein, 13 aa, Homo sapiens
LLPKLDELRDEGK

SEQ ID NO: 40274 - protein, 10 aa, Homo sapiens
LNQLCVLHEK

SEQ ID NO: 40275 - protein, 12 aa, Homo sapiens
LPSLAADFVESK

SEQ ID NO: 40276 - protein, 12 aa, Homo sapiens
LQHKDDNPNLPR

SEQ ID NO: 40277 - protein, 11 aa, Homo sapiens
LQQCPFEDHVK

SEQ ID NO: 40278 - protein, 11 aa, Homo sapiens
LRDEGKASSAK

SEQ ID NO: 40279 - protein, 7 aa, Homo sapiens
LSQRFPK

SEQ ID NO: 40280 - protein, 14 aa, Homo sapiens
LSQRFPKAEFAEVS

SEQ ID NO: 40281 - protein, 15 aa, Homo sapiens
LSQRFPKAEFAEVSK

SEQ ID NO: 40282 - protein, 22 aa, Homo sapiens
LSQRFPKAEFAEVSKLVTDLTK

SEQ ID NO: 40283 - protein, 14 aa, Homo sapiens
LSVVLNQLCVLHEK

SEQ ID NO: 40284 - protein, 10 aa, Homo sapiens
LVAASQAALG

SEQ ID NO: 40285 - protein, 11 aa, Homo sapiens
LVAASQAALGL

SEQ ID NO: 40286 - protein, 8 aa, Homo sapiens
LVNEVTEF

SEQ ID NO: 40287 - protein, 10 aa, Homo sapiens
LVNEVTEFAK

SEQ ID NO: 40288 - protein, 23 aa, Homo sapiens
LVNEVTEFAKTCVADESAENCDK

SEQ ID NO: 40289 - protein, 9 aa, Homo sapiens
LVRPEVDVM

SEQ ID NO: 40290 - protein, 10 aa, Homo sapiens
LVRPEVDVMC

SEQ ID NO: 40291 - protein, 13 aa, Homo sapiens
LVRPEVDVMCTAF

SEQ ID NO: 40292 - protein, 14 aa, Homo sapiens
LVRPEVDVMCTAFH

SEQ ID NO: 40293 - protein, 15 aa, Homo sapiens
LVRPEVDVMCTAFHD

SEQ ID NO: 40294 - protein, 16 aa, Homo sapiens
LVRPEVDVMCTAFHDN

SEQ ID NO: 40295 - protein, 18 aa, Homo sapiens
LVRPEVDVMCTAFHDNEE

SEQ ID NO: 40296 - protein, 19 aa, Homo sapiens
LVRPEVDVMCTAFHDNEET

SEQ ID NO: 40297 - protein, 21 aa, Homo sapiens
LVRPEVDVMCTAFHDNEETFL

SEQ ID NO: 40298 - protein, 22 aa, Homo sapiens
LVRPEVDVMCTAFHDNEETFLK

SEQ ID NO: 40299 - protein, 23 aa, Homo sapiens
LVRPEVDVMCTAFHDNEETFLKK

SEQ ID NO: 40300 - protein, 24 aa, Homo sapiens
LVRPEVDVMCTAFHDNEETFLKKY

SEQ ID NO: 40301 - protein, 30 aa, Homo sapiens
LVRPEVDVMCTAFHDNEETFLKKYLYEIAR

SEQ ID NO: 40302 - protein, 7 aa, Homo sapiens
LVTDLTK

SEQ ID NO: 40303 - protein, 11 aa, Homo sapiens
LVTDLTKVHTE

SEQ ID NO: 40304 - protein, 12 aa, Homo sapiens
LVTDLTKVHTEC

SEQ ID NO: 40305 - protein, 24 aa, Homo sapiens
LVTDLTKVHTECCHGDLLECADDR

SEQ ID NO: 40306 - protein, 29 aa, Homo sapiens
LVTDLTKVHTECCHGDLLECADDRADLAK

SEQ ID NO: 40307 - protein, 14 aa, Homo sapiens
MCTAFHDNEETFLK

SEQ ID NO: 40308 - protein, 10 aa, Homo sapiens
MDDFAAFVEK

SEQ ID NO: 40309 - protein, 13 aa, Homo sapiens
MDDFAAFVEKCCK

SEQ ID NO: 40310 - protein, 16 aa, Homo sapiens
MPADLPSLAADFVESK

SEQ ID NO: 40311 - protein, 16 aa, Homo sapiens
MPCAEDYLSVVLNQLC

SEQ ID NO: 40312 - protein, 19 aa, Homo sapiens
MPCAEDYLSVVLNQLCVLH

SEQ ID NO: 40313 - protein, 21 aa, Homo sapiens
MPCAEDYLSVVLNQLCVLHEK

SEQ ID NO: 40314 - protein, 27 aa, Homo sapiens
MPCAEDYLSVVLNQLCVLHEKTPVSDR

SEQ ID NO: 40315 - protein, 17 aa, Homo sapiens
NAETFTFHADICTLSEK

SEQ ID NO: 40316 - protein, 19 aa, Homo sapiens
NAETFTFHADICTLSEKER

SEQ ID NO: 40317 - protein, 12 aa, Homo sapiens
NCELFEQLGEYK

SEQ ID NO: 40318 - protein, 19 aa, Homo sapiens
NDEMPADLPSLAADFVESK

SEQ ID NO: 40319 - protein, 8 aa, Homo sapiens
NECFLQHK

SEQ ID NO: 40320 - protein, 16 aa, Homo sapiens
NECFLQHKDDNPNLPR

SEQ ID NO: 40321 - protein, 8 aa, Homo sapiens
NEVTEFAK

SEQ ID NO: 40322 - protein, 8 aa, Homo sapiens
NLGKVGSK

SEQ ID NO: 40323 - protein, 17 aa, Homo sapiens
NLGKVGSKCCKHPEAKR

SEQ ID NO: 40324 - protein, 6 aa, Homo sapiens
NPNLPR

SEQ ID NO: 40325 - protein, 9 aa, Homo sapiens
NQLCVLHEK

SEQ ID NO: 40326 - protein, 6 aa, Homo sapiens
NYAEAK

SEQ ID NO: 40327 - protein, 19 aa, Homo sapiens
NYAEAKDVFLGMFLYEYAR

SEQ ID NO: 40328 - protein, 20 aa, Homo sapiens
NYAEAKDVFLGMFLYEYARR

SEQ ID NO: 40329 - protein, 15 aa, Homo sapiens
PADLPSLAADFVESK

SEQ ID NO: 40330 - protein, 19 aa, Homo sapiens
PADLPSLAADFVESKDVCK

SEQ ID NO: 40331 - protein, 20 aa, Homo sapiens
PCAEDYLSVVLNQLCVLHEK

SEQ ID NO: 40332 - protein, 15 aa, Homo sapiens
PCFSALEVDETYVPK

SEQ ID NO: 40333 - protein, 10 aa, Homo sapiens
PDYSVVLLLR

SEQ ID NO: 40334 - protein, 8 aa, Homo sapiens
PELLFFAK

SEQ ID NO: 40335 - protein, 11 aa, Homo sapiens
PELLFFAKRYK

SEQ ID NO: 40336 - protein, 19 aa, Homo sapiens
PERNECFLQHKDDNPNLPR

SEQ ID NO: 40337 - protein, 19 aa, Homo sapiens
PEVDVMCTAFHDNEETFLK

SEQ ID NO: 40338 - protein, 20 aa, Homo sapiens
PEVDVMCTAFHDNEETFLKK

SEQ ID NO: 40339 - protein, 17 aa, Homo sapiens
PFEDHVKLVNEVTEFAK

SEQ ID NO: 40340 - protein, 7 aa, Homo sapiens
PHECYAK

SEQ ID NO: 40341 - protein, 10 aa, Homo sapiens
PKAEFAEVSK

SEQ ID NO: 40342 - protein, 17 aa, Homo sapiens
PKAEFAEVSKLVTDLTK

SEQ ID NO: 40343 - protein, 16 aa, Homo sapiens
PKLDELRDEGKASSAK

SEQ ID NO: 40344 - protein, 11 aa, Homo sapiens
PLVEEPQNLIK

SEQ ID NO: 40345 - protein, 32 aa, Homo sapiens
PLVEEPQNLIKQNCELFEQLGEYKFQNALLVR

SEQ ID NO: 40346 - protein, 19 aa, Homo sapiens
PQNLIKQNCELFEQLGEYK

SEQ ID NO: 40347 - protein, 27 aa, Homo sapiens
PQNLIKQNCELFEQLGEYKFQNALLVR

SEQ ID NO: 40348 - protein, 13 aa, Homo sapiens
PQVSTPTLVEVSR

SEQ ID NO: 40349 - protein, 17 aa, Homo sapiens
PQVSTPTLVEVSRNLGK

SEQ ID NO: 40350 - protein, 11 aa, Homo sapiens
PSLAADFVESK

SEQ ID NO: 40351 - protein, 8 aa, Homo sapiens
PTLVEVSR

SEQ ID NO: 40352 - protein, 12 aa, Homo sapiens
PTLVEVSRNLGK

SEQ ID NO: 40353 - protein, 13 aa, Homo sapiens
PYFYAPELLFFAK

SEQ ID NO: 40354 - protein, 14 aa, Homo sapiens
PYFYAPELLFFAKR

SEQ ID NO: 40355 - protein, 13 aa, Homo sapiens
QEPERNECFLQHK

SEQ ID NO: 40356 - protein, 21 aa, Homo sapiens
QEPERNECFLQHKDDNPNLPR

SEQ ID NO: 40357 - protein, 13 aa, Homo sapiens
QIKKQTALVELVK

SEQ ID NO: 40358 - protein, 17 aa, Homo sapiens
QIKKQTALVELVKHKPK

SEQ ID NO: 40359 - protein, 20 aa, Homo sapiens
QIKKQTALVELVKHKPKATK

SEQ ID NO: 40360 - protein, 24 aa, Homo sapiens
QIKKQTALVELVKHKPKATKEQLK

SEQ ID NO: 40361 - protein, 8 aa, Homo sapiens
QLCVLHEK

SEQ ID NO: 40362 - protein, 17 aa, Homo sapiens
QLCVLHEKTPVSDRVTK

SEQ ID NO: 40363 - protein, 13 aa, Homo sapiens
QNCELFEQLGEYK

SEQ ID NO: 40364 - protein, 21 aa, Homo sapiens
QNCELFEQLGEYKFQNALLVR

SEQ ID NO: 40365 - protein, 10 aa, Homo sapiens
QRLKCASLQK

SEQ ID NO: 40366 - protein, 23 aa, Homo sapiens
QRLKCASLQKFGERAFKAWAVAR

SEQ ID NO: 40367 - protein, 9 aa, Homo sapiens
QTALVELVK

SEQ ID NO: 40368 - protein, 13 aa, Homo sapiens
QTALVELVKHKPK

SEQ ID NO: 40369 - protein, 16 aa, Homo sapiens
QTALVELVKHKPKATK

SEQ ID NO: 40370 - protein, 20 aa, Homo sapiens
QTALVELVKHKPKATKEQLK

SEQ ID NO: 40371 - protein, 12 aa, Homo sapiens
QVSTPTLVEVSR

SEQ ID NO: 40372 - protein, 8 aa, Homo sapiens
RHPDYSVV

SEQ ID NO: 40373 - protein, 9 aa, Homo sapiens
RHPDYSVVL

SEQ ID NO: 40374 - protein, 10 aa, Homo sapiens
RHPDYSVVLL

SEQ ID NO: 40375 - protein, 11 aa, Homo sapiens
RHPDYSVVLLL

SEQ ID NO: 40376 - protein, 12 aa, Homo sapiens
RHPDYSVVLLLR

SEQ ID NO: 40377 - protein, 15 aa, Homo sapiens
RHPDYSVVLLLRLAK

SEQ ID NO: 40378 - protein, 23 aa, Homo sapiens
RHPDYSVVLLLRLAKTYETTLEK

SEQ ID NO: 40379 - protein, 10 aa, Homo sapiens
RHPYFYAPEL

SEQ ID NO: 40380 - protein, 11 aa, Homo sapiens
RHPYFYAPELL

SEQ ID NO: 40381 - protein, 12 aa, Homo sapiens
RHPYFYAPELLF

SEQ ID NO: 40382 - protein, 13 aa, Homo sapiens
RHPYFYAPELLFF

SEQ ID NO: 40383 - protein, 14 aa, Homo sapiens
RHPYFYAPELLFFA

SEQ ID NO: 40384 - protein, 15 aa, Homo sapiens
RHPYFYAPELLFFAK

SEQ ID NO: 40385 - protein, 16 aa, Homo sapiens
RHPYFYAPELLFFAKR

SEQ ID NO: 40386 - protein, 17 aa, Homo sapiens
RHPYFYAPELLFFAKRY

SEQ ID NO: 40387 - protein, 18 aa, Homo sapiens
RHPYFYAPELLFFAKRYK

SEQ ID NO: 40388 - protein, 23 aa, Homo sapiens
RLVRPEVDVMCTAFHDNEETFLK

SEQ ID NO: 40389 - protein, 22 aa, Homo sapiens
RMPCAEDYLSVVLNQLCVLHEK

SEQ ID NO: 40390 - protein, 28 aa, Homo sapiens
RMPCAEDYLSVVLNQLCVLHEKTPVSDR

SEQ ID NO: 40391 - protein, 30 aa, Homo sapiens
RMPCAEDYLSVVLNQLCVLHEKTPVSDRVT

SEQ ID NO: 40392 - protein, 31 aa, Homo sapiens
RMPCAEDYLSVVLNQLCVLHEKTPVSDRVTK

SEQ ID NO: 40393 - protein, 10 aa, Homo sapiens
RPCFSALEVD

SEQ ID NO: 40394 - protein, 11 aa, Homo sapiens
RPCFSALEVDE

SEQ ID NO: 40395 - protein, 13 aa, Homo sapiens
RPCFSALEVDETY

SEQ ID NO: 40396 - protein, 16 aa, Homo sapiens
RPCFSALEVDETYVPK

SEQ ID NO: 40397 - protein, 18 aa, Homo sapiens
RPCFSALEVDETYVPKEF

SEQ ID NO: 40398 - protein, 35 aa, Homo sapiens
RPCFSALEVDETYVPKEFNAETFTFHADICTLSEK

SEQ ID NO: 40399 - protein, 21 aa, Homo sapiens
RPEVDVMCTAFHDNEETFLKK

SEQ ID NO: 40400 - protein, 15 aa, Homo sapiens
RYKAAFTECCQAADK

SEQ ID NO: 40401 - protein, 16 aa, Homo sapiens
SAENCDKSLHTLFGDK

SEQ ID NO: 40402 - protein, 12 aa, Homo sapiens
SALEVDETYVPK

SEQ ID NO: 40403 - protein, 6 aa, Homo sapiens
SEVAHR

SEQ ID NO: 40404 - protein, 11 aa, Homo sapiens
SHCIAEVENDE

SEQ ID NO: 40405 - protein, 12 aa, Homo sapiens
SHCIAEVENDEM

SEQ ID NO: 40406 - protein, 14 aa, Homo sapiens
SHCIAEVENDEMPA

SEQ ID NO: 40407 - protein, 15 aa, Homo sapiens
SHCIAEVENDEMPAD

SEQ ID NO: 40408 - protein, 18 aa, Homo sapiens
SHCIAEVENDEMPADLPS

SEQ ID NO: 40409 - protein, 20 aa, Homo sapiens
SHCIAEVENDEMPADLPSLA

SEQ ID NO: 40410 - protein, 21 aa, Homo sapiens
SHCIAEVENDEMPADLPSLAA

SEQ ID NO: 40411 - protein, 22 aa, Homo sapiens
SHCIAEVENDEMPADLPSLAAD

SEQ ID NO: 40412 - protein, 25 aa, Homo sapiens
SHCIAEVENDEMPADLPSLAADFVE

SEQ ID NO: 40413 - protein, 26 aa, Homo sapiens
SHCIAEVENDEMPADLPSLAADFVES

SEQ ID NO: 40414 - protein, 27 aa, Homo sapiens
SHCIAEVENDEMPADLPSLAADFVESK

SEQ ID NO: 40415 - protein, 31 aa, Homo sapiens
SHCIAEVENDEMPADLPSLAADFVESKDVCK

SEQ ID NO: 40416 - protein, 37 aa, Homo sapiens
SHCIAEVENDEMPADLPSLAADFVESKDVCKNYAEAK

SEQ ID NO: 40417 - protein, 10 aa, Homo sapiens
SLAADFVESK

SEQ ID NO: 40418 - protein, 9 aa, Homo sapiens
SLHTLFGDK

SEQ ID NO: 40419 - protein, 10 aa, Homo sapiens
SLHTLFGDKL

SEQ ID NO: 40420 - protein, 11 aa, Homo sapiens
SLHTLFGDKLC

SEQ ID NO: 40421 - protein, 12 aa, Homo sapiens
SLHTLFGDKLCT

SEQ ID NO: 40422 - protein, 14 aa, Homo sapiens
SLHTLFGDKLCTVA

SEQ ID NO: 40423 - protein, 17 aa, Homo sapiens
SLHTLFGDKLCTVATLR

SEQ ID NO: 40424 - protein, 25 aa, Homo sapiens
SLHTLFGDKLCTVATLRETYGEMAD

SEQ ID NO: 40425 - protein, 29 aa, Homo sapiens
SLHTLFGDKLCTVATLRETYGEMADCCAK

SEQ ID NO: 40426 - protein, 17 aa, Homo sapiens
SLQKFGERAFKAWAVAR

SEQ ID NO: 40427 - protein, 14 aa, Homo sapiens
SQRFPKAEFAEVSK

SEQ ID NO: 40428 - protein, 21 aa, Homo sapiens
SQRFPKAEFAEVSKLVTDLTK

SEQ ID NO: 40429 - protein, 18 aa, Homo sapiens
SVVLLLRLAKTYETTLEK

SEQ ID NO: 40430 - protein, 13 aa, Homo sapiens
SVVLNQLCVLHEK

SEQ ID NO: 40431 - protein, 12 aa, Homo sapiens
TAFHDNEETFLK

SEQ ID NO: 40432 - protein, 13 aa, Homo sapiens
TAFHDNEETFLKK

SEQ ID NO: 40433 - protein, 8 aa, Homo sapiens
TALVELVK

SEQ ID NO: 40434 - protein, 12 aa, Homo sapiens
TALVELVKHKPK

SEQ ID NO: 40435 - protein, 19 aa, Homo sapiens
TALVELVKHKPKATKEQLK

SEQ ID NO: 40436 - protein, 9 aa, Homo sapiens
TCFAEEGKK

SEQ ID NO: 40437 - protein, 13 aa, Homo sapiens
TCVADESAENCDK

SEQ ID NO: 40438 - protein, 16 aa, Homo sapiens
TCVADESAENCDKSLH

SEQ ID NO: 40439 - protein, 22 aa, Homo sapiens
TCVADESAENCDKSLHTLFGDK

SEQ ID NO: 40440 - protein, 23 aa, Homo sapiens
TCVADESAENCDKSLHTLFGDKL

SEQ ID NO: 40441 - protein, 30 aa, Homo sapiens
TCVADESAENCDKSLHTLFGDKLCTVATLR

SEQ ID NO: 40442 - protein, 15 aa, Homo sapiens
TECCHGDLLECADDR

SEQ ID NO: 40443 - protein, 20 aa, Homo sapiens
TECCHGDLLECADDRADLAK

SEQ ID NO: 40444 - protein, 9 aa, Homo sapiens
TECCQAADK

SEQ ID NO: 40445 - protein, 16 aa, Homo sapiens
TECCQAADKAACLLPK

SEQ ID NO: 40446 - protein, 12 aa, Homo sapiens
TFHADICTLSEK

SEQ ID NO: 40447 - protein, 14 aa, Homo sapiens
TFTFHADICTLSEK

SEQ ID NO: 40448 - protein, 16 aa, Homo sapiens
TFTFHADICTLSEKER

SEQ ID NO: 40449 - protein, 18 aa, Homo sapiens
TKEQLKAVMDDFAAFVEK

SEQ ID NO: 40450 - protein, 17 aa, Homo sapiens
TKKVPQVSTPTLVEVSR

SEQ ID NO: 40451 - protein, 14 aa, Homo sapiens
TLFGDKLCTVATLR

SEQ ID NO: 40452 - protein, 9 aa, Homo sapiens
TPTLVEVSR

SEQ ID NO: 40453 - protein, 17 aa, Homo sapiens
TPTLVEVSRNLGKVGSK

SEQ ID NO: 40454 - protein, 6 aa, Homo sapiens
TPVSDR

SEQ ID NO: 40455 - protein, 9 aa, Homo sapiens
TPVSDRVTK

SEQ ID NO: 40456 - protein, 10 aa, Homo sapiens
TPVSDRVTKC

SEQ ID NO: 40457 - protein, 8 aa, Homo sapiens
TYETTLEK

SEQ ID NO: 40458 - protein, 14 aa, Homo sapiens
TYETTLEKCCAAAD

SEQ ID NO: 40459 - protein, 21 aa, Homo sapiens
TYETTLEKCCAAADPHECYAK

SEQ ID NO: 40460 - protein, 11 aa, Homo sapiens
TYGEMADCCAK

SEQ ID NO: 40461 - protein, 11 aa, Homo sapiens
VADESAENCDK

SEQ ID NO: 40462 - protein, 20 aa, Homo sapiens
VADESAENCDKSLHTLFGDK

SEQ ID NO: 40463 - protein, 8 aa, Homo sapiens
VDETYVPK

SEQ ID NO: 40464 - protein, 9 aa, Homo sapiens
VELVKHKPK

SEQ ID NO: 40465 - protein, 21 aa, Homo sapiens
VENDEMPADLPSLAADFVESK

SEQ ID NO: 40466 - protein, 6 aa, Homo sapiens
VFDEFK

SEQ ID NO: 40467 - protein, 9 aa, Homo sapiens
VFDEFKPLV

SEQ ID NO: 40468 - protein, 10 aa, Homo sapiens
VFDEFKPLVE

SEQ ID NO: 40469 - protein, 11 aa, Homo sapiens
VFDEFKPLVEE

SEQ ID NO: 40470 - protein, 13 aa, Homo sapiens
VFDEFKPLVEEPQ

SEQ ID NO: 40471 - protein, 14 aa, Homo sapiens
VFDEFKPLVEEPQN

SEQ ID NO: 40472 - protein, 15 aa, Homo sapiens
VFDEFKPLVEEPQNL

SEQ ID NO: 40473 - protein, 17 aa, Homo sapiens
VFDEFKPLVEEPQNLIK

SEQ ID NO: 40474 - protein, 18 aa, Homo sapiens
VFDEFKPLVEEPQNLIKQ

SEQ ID NO: 40475 - protein, 19 aa, Homo sapiens
VFDEFKPLVEEPQNLIKQN

SEQ ID NO: 40476 - protein, 30 aa, Homo sapiens
VFDEFKPLVEEPQNLIKQNCELFEQLGEYK

SEQ ID NO: 40477 - protein, 12 aa, Homo sapiens
VGSKCCKHPEAK

SEQ ID NO: 40478 - protein, 12 aa, Homo sapiens
VHTECCHGDLLE

SEQ ID NO: 40479 - protein, 13 aa, Homo sapiens
VHTECCHGDLLEC

SEQ ID NO: 40480 - protein, 17 aa, Homo sapiens
VHTECCHGDLLECADDR

SEQ ID NO: 40481 - protein, 22 aa, Homo sapiens
VHTECCHGDLLECADDRADLAK

SEQ ID NO: 40482 - protein, 34 aa, Homo sapiens
VHTECCHGDLLECADDRADLAKYICENQDSISSK

SEQ ID NO: 40483 - protein, 12 aa, Homo sapiens
VKLVNEVTEFAK

SEQ ID NO: 40484 - protein, 14 aa, Homo sapiens
VLHEKTPVSDRVTK

SEQ ID NO: 40485 - protein, 19 aa, Homo sapiens
VLIAFAQYLQQCPFEDHVK

SEQ ID NO: 40486 - protein, 11 aa, Homo sapiens
VLNQLCVLHEK

SEQ ID NO: 40487 - protein, 15 aa, Homo sapiens
VMCTAFHDNEETFLK

SEQ ID NO: 40488 - protein, 16 aa, Homo sapiens
VMCTAFHDNEETFLKK

SEQ ID NO: 40489 - protein, 11 aa, Homo sapiens
VMDDFAAFVEK

SEQ ID NO: 40490 - protein, 9 aa, Homo sapiens
VNEVTEFAK

SEQ ID NO: 40491 - protein, 13 aa, Homo sapiens
VPQVSTPTLVEVS

SEQ ID NO: 40492 - protein, 14 aa, Homo sapiens
VPQVSTPTLVEVSR

SEQ ID NO: 40493 - protein, 18 aa, Homo sapiens
VPQVSTPTLVEVSRNLGK

SEQ ID NO: 40494 - protein, 22 aa, Homo sapiens
VPQVSTPTLVEVSRNLGKVGSK

SEQ ID NO: 40495 - protein, 21 aa, Homo sapiens
VRPEVDVMCTAFHDNEETFLK

SEQ ID NO: 40496 - protein, 22 aa, Homo sapiens
VRPEVDVMCTAFHDNEETFLKK

SEQ ID NO: 40497 - protein, 11 aa, Homo sapiens
VSTPTLVEVSR

SEQ ID NO: 40498 - protein, 12 aa, Homo sapiens
VVLNQLCVLHEK

SEQ ID NO: 40499 - protein, 23 aa, Homo sapiens
WAVARLSQRFPKAEFAEVSKLVT

SEQ ID NO: 40500 - protein, 10 aa, Homo sapiens
YAPELLFFAK

SEQ ID NO: 40501 - protein, 20 aa, Homo sapiens
YETTLEKCCAAADPHECYAK

SEQ ID NO: 40502 - protein, 12 aa, Homo sapiens
YFYAPELLFFAK

SEQ ID NO: 40503 - protein, 13 aa, Homo sapiens
YFYAPELLFFAKR

SEQ ID NO: 40504 - protein, 10 aa, Homo sapiens
YGEMADCCAK

SEQ ID NO: 40505 - protein, 12 aa, Homo sapiens
YICENQDSISSK

SEQ ID NO: 40506 - protein, 14 aa, Homo sapiens
YICENQDSISSKLK

SEQ ID NO: 40507 - protein, 15 aa, Homo sapiens
YICENQDSISSKLKE

SEQ ID NO: 40508 - protein, 24 aa, Homo sapiens
YICENQDSISSKLKECCEKPLLEK

SEQ ID NO: 40509 - protein, 14 aa, Homo sapiens
YKAAFTECCQAADK

SEQ ID NO: 40510 - protein, 16 aa, Homo sapiens
YKAAFTECCQAADKAA

SEQ ID NO: 40511 - protein, 21 aa, Homo sapiens
YKAAFTECCQAADKAACLLPK

SEQ ID NO: 40512 - protein, 30 aa, Homo sapiens
YKAAFTECCQAADKAACLLPKLDELRDEGK

SEQ ID NO: 40513 - protein, 35 aa, Homo sapiens
YKAAFTECCQAADKAACLLPKLDELRDEGKASSAK

SEQ ID NO: 40514 - protein, 12 aa, Homo sapiens
YLQQCPFEDHVK

SEQ ID NO: 40515 - protein, 15 aa, Homo sapiens
YLSVVLNQLCVLHEK

SEQ ID NO: 40516 - protein, 7 aa, Homo sapiens
YLYEIAR

SEQ ID NO: 40517 - protein, 8 aa, Homo sapiens
YLYEIARR

SEQ ID NO: 40518 - protein, 8 aa, Homo sapiens
YSVVLLLR

SEQ ID NO: 40519 - protein, 16 aa, Homo sapiens
YTKKVPQVSTPTLVEV

SEQ ID NO: 40520 - protein, 18 aa, Homo sapiens
YTKKVPQVSTPTLVEVSR

SEQ ID NO: 40521 - protein, 22 aa, Homo sapiens
YTKKVPQVSTPTLVEVSRNLGK

SEQ ID NO: 40522 - protein, 24 aa, Homo sapiens
YTKKVPQVSTPTLVEVSRNLGKVG

SEQ ID NO: 40523 - protein, 26 aa, Homo sapiens
YTKKVPQVSTPTLVEVSRNLGKVGSK

SEQ ID NO: 40524 - protein, 15 aa, Homo sapiens
FTPEEEMFKMVTKIK

SEQ ID NO: 40525 - protein, 19 aa, Homo sapiens
KGNTALHIASLAGQAEVVK

SEQ ID NO: 40526 - protein, 20 aa, Homo sapiens
TVAPQGQDMASIAPDNRSKS

SEQ ID NO: 40527 - protein, 10 aa, Homo sapiens
KNNTIAPKKA

SEQ ID NO: 40528 - protein, 27 aa, Homo sapiens
KSNCCNSAVNAPSLVMNSGNNASGVSG

SEQ ID NO: 40529 - protein, 7 aa, Homo sapiens
AWFLESK

SEQ ID NO: 40530 - protein, 12 aa, Homo sapiens
AWFLESKDSLLK

SEQ ID NO: 40531 - protein, 13 aa, Homo sapiens
DGWQWFWSPSTFR

SEQ ID NO: 40532 - protein, 9 aa, Homo sapiens
ELLETVVNR

SEQ ID NO: 40533 - protein, 12 aa, Homo sapiens
GFMQTYYDDHLR

SEQ ID NO: 40534 - protein, 19 aa, Homo sapiens
GFMQTYYDDHLRDLGPLTK

SEQ ID NO: 40535 - protein, 11 aa, Homo sapiens
KELLETVVNRT

SEQ ID NO: 40536 - protein, 11 aa, Homo sapiens
MKELLETVVNR

SEQ ID NO: 40537 - protein, 10 aa, Homo sapiens
MQTYYDDHLR

SEQ ID NO: 40538 - protein, 15 aa, Homo sapiens
TRDGWQWFWSPSTFR

SEQ ID NO: 40539 - protein, 10 aa, Homo sapiens
DAVLLVFANK

SEQ ID NO: 40540 - protein, 18 aa, Homo sapiens
HYFQNTQGLIFVVDSNDR

SEQ ID NO: 40541 - protein, 20 aa, Homo sapiens
HYFQNTQGLIFVVDSNDRER

SEQ ID NO: 40542 - protein, 11 aa, Homo sapiens
ILMVGLDAAGK

SEQ ID NO: 40543 - protein, 21 aa, Homo sapiens
LGEIVTTIPTIGFNVETVEYK

SEQ ID NO: 40544 - protein, 7 aa, Homo sapiens
LGLHSLR

SEQ ID NO: 40545 - protein, 8 aa, Homo sapiens
MLAEDELR

SEQ ID NO: 40546 - protein, 14 aa, Homo sapiens
NISFTVWDVGGQDK

SEQ ID NO: 40547 - protein, 27 aa, Homo sapiens
NWYIQATCATSGDGLYEGLDWLANQLK

SEQ ID NO: 40548 - protein, 15 aa, Homo sapiens
QDLPNAMNAAEITDK

SEQ ID NO: 40549 - protein, 14 aa, Homo sapiens
EHNGHITGIDWAPK

SEQ ID NO: 40550 - protein, 23 aa, Homo sapiens
STVLSLDWHPNNVLLAAGSCDFK

SEQ ID NO: 40551 - protein, 16 aa, Homo sapiens
TQIALSPNNHEVHIYK

SEQ ID NO: 40552 - protein, 31 aa, Homo sapiens
RSPLQACENLAMNEGGPPTENNSLILEENKI

SEQ ID NO: 40553 - protein, 30 aa, Homo sapiens
RDNLSGLSADMQDYGLIIDGAALSLIMKPR

SEQ ID NO: 40554 - protein, 21 aa, Homo sapiens
RVINFYAGANQSMNVTCAGKR

SEQ ID NO: 40555 - protein, 29 aa, Homo sapiens
MTMALSVLVTIEMCNALNSLSENQSLLRM

SEQ ID NO: 40556 - protein, 9 aa, Homo sapiens
ANACNSVIK

SEQ ID NO: 40557 - protein, 34 aa, Homo sapiens
DDKPVNCHQYDGLVELATICALCNDSALDYNEAK

SEQ ID NO: 40558 - protein, 15 aa, Homo sapiens
DIVPGDIVEIAVGDK

SEQ ID NO: 40559 - protein, 18 aa, Homo sapiens
SLPSVETLGCTSVICSDK

SEQ ID NO: 40560 - protein, 15 aa, Homo sapiens
VGEATETALTCLVEK

SEQ ID NO: 40561 - protein, 13 aa, Homo sapiens
VSFYQLSHFLQCK

SEQ ID NO: 40562 - protein, 10 aa, Homo sapiens
DDKERESVEK

SEQ ID NO: 40563 - protein, 13 aa, Homo sapiens
ENDRNLCQHLGKR

SEQ ID NO: 40564 - protein, 15 aa, Homo sapiens
GGLGAGAAGGGGAGR

SEQ ID NO: 40565 - protein, 18 aa, Homo sapiens
RYLINSYDFVNDTLSLKH

SEQ ID NO: 40566 - protein, 31 aa, Homo sapiens
KCEQSYGTNSSDESGSFSEADSESCPVQDRG

SEQ ID NO: 40567 - protein, 26 aa, Homo sapiens
KKDLSCSNFSLLAYQFDHFSHEKIKD

SEQ ID NO: 40568 - protein, 27 aa, Homo sapiens
KNLDLILPTLRNYTVINSKIIVVTIRP

SEQ ID NO: 40569 - protein, 21 aa, Homo sapiens
MFPKNFTNCTWTLENPDPTKY

SEQ ID NO: 40570 - protein, 19 aa, Homo sapiens
RFRDIPNTSSMENPAPNKN

SEQ ID NO: 40571 - protein, 28 aa, Homo sapiens
AAEAAAAPAESAAPAAGEEPSKEEGEPK

SEQ ID NO: 40572 - protein, 13 aa, Homo sapiens
AEGAATEEEGTPK

SEQ ID NO: 40573 - protein, 24 aa, Homo sapiens
AEPPKAPEQEQAAPGPAAGGEAPK

SEQ ID NO: 40574 - protein, 24 aa, Homo sapiens
AQGPAASAEEPKPVEAPAANSDQT

SEQ ID NO: 40575 - protein, 26 aa, Homo sapiens
AQGPAASAEEPKPVEAPAANSDQTVT

SEQ ID NO: 40576 - protein, 29 aa, Homo sapiens
AQGPAASAEEPKPVEAPAANSDQTVTVKE

SEQ ID NO: 40577 - protein, 14 aa, Homo sapiens
ESEPQAAAEPAEAK

SEQ ID NO: 40578 - protein, 14 aa, Homo sapiens
ETPAATEAPSSTPK

SEQ ID NO: 40579 - protein, 21 aa, Homo sapiens
SDGAPASDSKPGSSEAAPSSK

SEQ ID NO: 40580 - protein, 34 aa, Homo sapiens
TEAPAAPAAQETKSDGAPASDSKPGSSEAAPSSK

SEQ ID NO: 40581 - protein, 17 aa, Homo sapiens
RELAGNTSSPPLSPGRP

SEQ ID NO: 40582 - protein, 23 aa, Homo sapiens
KNISNPPDMSGWNPFGEDNFSKL

SEQ ID NO: 40583 - protein, 21 aa, Homo sapiens
KFIKNQHCTNISELSNTSEND

SEQ ID NO: 40584 - protein, 14 aa, Homo sapiens
AEGDKSGSAGAPSK

SEQ ID NO: 40585 - protein, 12 aa, Homo sapiens
APLVCLPVFVSR

SEQ ID NO: 40586 - protein, 17 aa, Homo sapiens
IAEVGGVPYLLPLVNQK

SEQ ID NO: 40587 - protein, 7 aa, Homo sapiens
KVYDLNK

SEQ ID NO: 40588 - protein, 9 aa, Homo sapiens
LEHTHFFSR

SEQ ID NO: 40589 - protein, 33 aa, Homo sapiens
IGENQKAVEFMNMKKSHEVQAMSELISSIADYY

SEQ ID NO: 40590 - protein, 32 aa, Homo sapiens
KVKNKVKNKADTEEVFNNSPTNQEKMPTSAIL

SEQ ID NO: 40591 - protein, 12 aa, Homo sapiens
LVSVEAFALAAK

SEQ ID NO: 40592 - protein, 16 aa, Homo sapiens
RNSSLLEPQKSGNNET

SEQ ID NO: 40593 - protein, 14 aa, Homo sapiens
HLVDPIDDLFLAAK

SEQ ID NO: 40594 - protein, 24 aa, Homo sapiens
IPEVHHISQDPLHYSIASVSASQK

SEQ ID NO: 40595 - protein, 12 aa, Homo sapiens
DNSEKCVLEKWK

SEQ ID NO: 40596 - protein, 21 aa, Homo sapiens
EASYSNDNQIILQSPSSNGTK

SEQ ID NO: 40597 - protein, 24 aa, Homo sapiens
LGSNSALTTSNIASFEEAFICLQK

SEQ ID NO: 40598 - protein, 27 aa, Homo sapiens
LTIGCRQLVEMEYTMQQCNASVYMEAK

SEQ ID NO: 40599 - protein, 21 aa, Homo sapiens
QLVEMEYTMQQCNASVYMEAK

SEQ ID NO: 40600 - protein, 25 aa, Homo sapiens
RQLVEMEYTMQQCNASVYMEAKNRG

SEQ ID NO: 40601 - protein, 35 aa, Homo sapiens
REVKYEVWLQEQGENTYVPYILALQNHTFTENIKP

SEQ ID NO: 40602 - protein, 20 aa, Homo sapiens
KSKSDLAVSNISPPSPDSKS

SEQ ID NO: 40603 - protein, 9 aa, Homo sapiens
SLSDNDVEK

SEQ ID NO: 40604 - protein, 18 aa, Homo sapiens
DCGLPPDVPNAQPALEGR

SEQ ID NO: 40605 - protein, 19 aa, Homo sapiens
EIYCPAPPQIDNGIIQGER

SEQ ID NO: 40606 - protein, 15 aa, Homo sapiens
KGSQWSDIEEFCNRS

SEQ ID NO: 40607 - protein, 18 aa, Homo sapiens
FLLENVPCNNASCEEARR

SEQ ID NO: 40608 - protein, 28 aa, Homo sapiens
KSELGAVIFWGQNQTLDPNNMTILNRTF

SEQ ID NO: 40609 - protein, 11 aa, Homo sapiens
DIQGSLQDIFK

SEQ ID NO: 40610 - protein, 12 aa, Homo sapiens
EDLDCTPGFQQK

SEQ ID NO: 40611 - protein, 14 aa, Homo sapiens
GDIVTVVSPALLDR

SEQ ID NO: 40612 - protein, 12 aa, Homo sapiens
INENTGSVSVTR

SEQ ID NO: 40613 - protein, 26 aa, Homo sapiens
KANYNLPIMVTDSGKPPMTNITDLRV

SEQ ID NO: 40614 - protein, 18 aa, Homo sapiens
KINNTHALVSLLQNLNKA

SEQ ID NO: 40615 - protein, 27 aa, Homo sapiens
KVFHINQPAEFIEDQSILNLTFSDCKG

SEQ ID NO: 40616 - protein, 20 aa, Homo sapiens
KVNSDGGLVALRNITAVGKT

SEQ ID NO: 40617 - protein, 22 aa, Homo sapiens
MFYIDPEKGDIVTVVSPALLDR

SEQ ID NO: 40618 - protein, 29 aa, Homo sapiens
RQEDLSVGSVLLTVNATDPDSLQHQTIRY

SEQ ID NO: 40619 - protein, 14 aa, Homo sapiens
SIVVSPILIPENQR

SEQ ID NO: 40620 - protein, 23 aa, Homo sapiens
TLEGPVPLEVIVIDQNDNRPIFR

SEQ ID NO: 40621 - protein, 16 aa, Homo sapiens
TPHAEDMAELVIVGGK

SEQ ID NO: 40622 - protein, 11 aa, Homo sapiens
VNSDGGLVALR

SEQ ID NO: 40623 - protein, 9 aa, Homo sapiens
YEVSSPYFK

SEQ ID NO: 40624 - protein, 27 aa, Homo sapiens
MAPMNQSQVLMSGSPLELNSLGEEQRI

SEQ ID NO: 40625 - protein, 28 aa, Homo sapiens
HSGVPEAPDRPTISTASETSVYVTWIPR

SEQ ID NO: 40626 - protein, 34 aa, Homo sapiens
KIHQGTLTILSLNSSLLGYYQCLANNSIGAIVSG

SEQ ID NO: 40627 - protein, 21 aa, Homo sapiens
LEIENDGGFKPVIITAPVSAK

SEQ ID NO: 40628 - protein, 17 aa, Homo sapiens
ALTVAHELLCNKPEEEK

SEQ ID NO: 40629 - protein, 11 aa, Homo sapiens
ASHLLETLLCK

SEQ ID NO: 40630 - protein, 14 aa, Homo sapiens
KPEVASWVHFDNLK

SEQ ID NO: 40631 - protein, 25 aa, Homo sapiens
NLNDSSLFVSAEEFGHLLDENMGSK

SEQ ID NO: 40632 - protein, 16 aa, Homo sapiens
NPLFCGAENTSLWELK

SEQ ID NO: 40633 - protein, 27 aa, Homo sapiens
RNLNDSSLFVSAEEFGHLLDENMGSKF

SEQ ID NO: 40634 - protein, 18 aa, Homo sapiens
PGAYNNTALFEESGLIRI

SEQ ID NO: 40635 - protein, 23 aa, Homo sapiens
KKTLDEERNSSSRSGITGTTNKK

SEQ ID NO: 40636 - protein, 12 aa, Homo sapiens
ASGVAVSDGVIK

SEQ ID NO: 40637 - protein, 10 aa, Homo sapiens
AVLFCLSEDK

SEQ ID NO: 40638 - protein, 11 aa, Homo sapiens
AVLFCLSEDKK

SEQ ID NO: 40639 - protein, 16 aa, Homo sapiens
EDLVFIFWAPESAPLK

SEQ ID NO: 40640 - protein, 20 aa, Homo sapiens
EILVGDVGQTVDDPYATFVK

SEQ ID NO: 40641 - protein, 12 aa, Homo sapiens
HELQANCYEEVK

SEQ ID NO: 40642 - protein, 14 aa, Homo sapiens
HELQANCYEEVKDR

SEQ ID NO: 40643 - protein, 12 aa, Homo sapiens
KAVLFCLSEDKK

SEQ ID NO: 40644 - protein, 17 aa, Homo sapiens
KEDLVFIFWAPESAPLK

SEQ ID NO: 40645 - protein, 14 aa, Homo sapiens
LGGSAVISLEGKPL

SEQ ID NO: 40646 - protein, 19 aa, Homo sapiens
LTGIKHELQANCYEEVKDR

SEQ ID NO: 40647 - protein, 12 aa, Homo sapiens
MIYASSKDAIKK

SEQ ID NO: 40648 - protein, 8 aa, Homo sapiens
MLPDKDCR

SEQ ID NO: 40649 - protein, 28 aa, Homo sapiens
NIILEEGKEILVGDVGQTVDDPYATFVK

SEQ ID NO: 40650 - protein, 11 aa, Homo sapiens
YALYDATYETK

SEQ ID NO: 40651 - protein, 12 aa, Homo sapiens
AAQPQFVHPEHR

SEQ ID NO: 40652 - protein, 18 aa, Homo sapiens
AASEFESSEGVFLFPELR

SEQ ID NO: 40653 - protein, 11 aa, Homo sapiens
AMQHISYLNSR

SEQ ID NO: 40654 - protein, 11 aa, Homo sapiens
AQPQFVHPEHR

SEQ ID NO: 40655 - protein, 8 aa, Homo sapiens
ATEDVLVK

SEQ ID NO: 40656 - protein, 20 aa, Homo sapiens
ATVHIQVNDVNEYAPVFKEK

SEQ ID NO: 40657 - protein, 13 aa, Homo sapiens
EGLDLQVLEDSGR

SEQ ID NO: 40658 - protein, 10 aa, Homo sapiens
EPFTISVWMR

SEQ ID NO: 40659 - protein, 9 aa, Homo sapiens
GNLAGLTLR

SEQ ID NO: 40660 - protein, 25 aa, Homo sapiens
GVQIQAHPSQLVLTLEGEDLGELDK

SEQ ID NO: 40661 - protein, 15 aa, Homo sapiens
IHGQNVPFDAVVVDK

SEQ ID NO: 40662 - protein, 23 aa, Homo sapiens
IHGQNVPFDAVVVDKSTGEGVIR

SEQ ID NO: 40663 - protein, 7 aa, Homo sapiens
IISTITR

SEQ ID NO: 40664 - protein, 11 aa, Homo sapiens
IPDGVVSVSPK

SEQ ID NO: 40665 - protein, 11 aa, Homo sapiens
ISLSGVHHFAR

SEQ ID NO: 40666 - protein, 10 aa, Homo sapiens
KRATEDVLVK

SEQ ID NO: 40667 - protein, 13 aa, Homo sapiens
MAAQPQFVHPEHR

SEQ ID NO: 40668 - protein, 17 aa, Homo sapiens
PFDAVVVDKSTGEGVIR

SEQ ID NO: 40669 - protein, 13 aa, Homo sapiens
PPLIALDKDAPLR

SEQ ID NO: 40670 - protein, 9 aa, Homo sapiens
PQFVHPEHR

SEQ ID NO: 40671 - protein, 16 aa, Homo sapiens
SFVDLSGHNLANPHPF

SEQ ID NO: 40672 - protein, 24 aa, Homo sapiens
SFVDLSGHNLANPHPFAVVPSTAT

SEQ ID NO: 40673 - protein, 25 aa, Homo sapiens
SFVDLSGHNLANPHPFAVVPSTATV

SEQ ID NO: 40674 - protein, 8 aa, Homo sapiens
STGEGVIR

SEQ ID NO: 40675 - protein, 10 aa, Homo sapiens
SYKATVIEGK

SEQ ID NO: 40676 - protein, 9 aa, Homo sapiens
VIDCLYTCK

SEQ ID NO: 40677 - protein, 16 aa, Homo sapiens
EGLDINSLESLGQGIK

SEQ ID NO: 40678 - protein, 23 aa, Homo sapiens
RHLDATNSTAGYSIYGVGSMSRY

SEQ ID NO: 40679 - protein, 21 aa, Homo sapiens
KAYNSAGTGPSSATVNVTTRK

SEQ ID NO: 40680 - protein, 15 aa, Homo sapiens
KLNGTDVDTGMDFRY

SEQ ID NO: 40681 - protein, 26 aa, Homo sapiens
TTAQLSWRPGPDNHSPITMYVIQART

SEQ ID NO: 40682 - protein, 8 aa, Homo sapiens
DAGFLSYK

SEQ ID NO: 40683 - protein, 23 aa, Homo sapiens
DAGFLSYKDHLPVSQVVVGDTDR

SEQ ID NO: 40684 - protein, 15 aa, Homo sapiens
DHLPVSQVVVGDTDR

SEQ ID NO: 40685 - protein, 8 aa, Homo sapiens
DVIALNFK

SEQ ID NO: 40686 - protein, 17 aa, Homo sapiens
ENFAILTIDGDEASAVR

SEQ ID NO: 40687 - protein, 24 aa, Homo sapiens
GGAGGWSPSDSDHYQWLQVDFGNR

SEQ ID NO: 40688 - protein, 25 aa, Homo sapiens
GGAGGWSPSDSDHYQWLQVDFGNRK

SEQ ID NO: 40689 - protein, 10 aa, Homo sapiens
HELQHPIIAR

SEQ ID NO: 40690 - protein, 23 aa, Homo sapiens
HLGQTSNYYWIDPDGSGPLGPLK

SEQ ID NO: 40691 - protein, 13 aa, Homo sapiens
HYYWGGSGPGIQK

SEQ ID NO: 40692 - protein, 11 aa, Homo sapiens
IVPLDWNGEGR

SEQ ID NO: 40693 - protein, 9 aa, Homo sapiens
KAPTEGHTR

SEQ ID NO: 40694 - protein, 9 aa, Homo sapiens
KDAGFLSYK

SEQ ID NO: 40695 - protein, 33 aa, Homo sapiens
KGAESAESADAAIMNNDPNFTETIDESKKEWLI

SEQ ID NO: 40696 - protein, 20 aa, Homo sapiens
KGCMESINYNGVNITDLARR

SEQ ID NO: 40697 - protein, 11 aa, Homo sapiens
KQISAIATQGR

SEQ ID NO: 40698 - protein, 13 aa, Homo sapiens
KVGVHINITQTKM

SEQ ID NO: 40699 - protein, 16 aa, Homo sapiens
LLNTPDGSPYTWWVGK

SEQ ID NO: 40700 - protein, 13 aa, Homo sapiens
LNQDLFSVSFQFR

SEQ ID NO: 40701 - protein, 8 aa, Homo sapiens
MLYSDTGR

SEQ ID NO: 40702 - protein, 11 aa, Homo sapiens
MNGVTLDLEER

SEQ ID NO: 40703 - protein, 21 aa, Homo sapiens
MSQIDISSGSGLNDGQWHEVR

SEQ ID NO: 40704 - protein, 25 aa, Homo sapiens
NWKPYHQDGNIWAFPGNINSDGVVR

SEQ ID NO: 40705 - protein, 8 aa, Homo sapiens
QASLQVDR

SEQ ID NO: 40706 - protein, 10 aa, Homo sapiens
QISAIATQGR

SEQ ID NO: 40707 - protein, 16 aa, Homo sapiens
RNMANGQPHSVNITRH

SEQ ID NO: 40708 - protein, 12 aa, Homo sapiens
SPTPLNDDQWHR

SEQ ID NO: 40709 - protein, 11 aa, Homo sapiens
TLKDVIALNFK

SEQ ID NO: 40710 - protein, 8 aa, Homo sapiens
TNSPLQVK

SEQ ID NO: 40711 - protein, 24 aa, Homo sapiens
TSESEGVILHGEGQQGDYITLELK

SEQ ID NO: 40712 - protein, 25 aa, Homo sapiens
TSESEGVILHGEGQQGDYITLELKK

SEQ ID NO: 40713 - protein, 20 aa, Homo sapiens
VDNAPDQQNSHPDLAQEEIR

SEQ ID NO: 40714 - protein, 11 aa, Homo sapiens
YSSSDWVTQYR

SEQ ID NO: 40715 - protein, 19 aa, Homo sapiens
ADDANVVRDRDLEVDTTLK

SEQ ID NO: 40716 - protein, 18 aa, Homo sapiens
DDANVVRDRDLEVDTTLK

SEQ ID NO: 40717 - protein, 17 aa, Homo sapiens
DKGESGPSGPAGPTGAR

SEQ ID NO: 40718 - protein, 11 aa, Homo sapiens
DRDLEVDTTLK

SEQ ID NO: 40719 - protein, 9 aa, Homo sapiens
DVWKPEPCR

SEQ ID NO: 40720 - protein, 24 aa, Homo sapiens
GDAGAPGAPGSQGAPGLQGMPGER

SEQ ID NO: 40721 - protein, 18 aa, Homo sapiens
GETGPAGPAGPVGPVGAR

SEQ ID NO: 40722 - protein, 21 aa, Homo sapiens
GPAGPQGPRGDKGETGEQGDR

SEQ ID NO: 40723 - protein, 24 aa, Homo sapiens
GPAGPQGPRGDKGETGEQGDRGIK

SEQ ID NO: 40724 - protein, 15 aa, Homo sapiens
NSVAYMDQQTGNLKK

SEQ ID NO: 40725 - protein, 11 aa, Homo sapiens
PPITCVQNGLR

SEQ ID NO: 40726 - protein, 26 aa, Homo sapiens
QLSYGYDEKSTGGISVPGPMGPSGPR

SEQ ID NO: 40727 - protein, 17 aa, Homo sapiens
RLMSTEASQNITYHCKN

SEQ ID NO: 40728 - protein, 10 aa, Homo sapiens
SLSQQIENIR

SEQ ID NO: 40729 - protein, 16 aa, Homo sapiens
SLSQQIENIRSPEGSR

SEQ ID NO: 40730 - protein, 17 aa, Homo sapiens
STGGISVPGPMGPSGPR

SEQ ID NO: 40731 - protein, 12 aa, Homo sapiens
VLCDDVICDETK

SEQ ID NO: 40732 - protein, 13 aa, Homo sapiens
YHDRDVWKPEPCR

SEQ ID NO: 40733 - protein, 22 aa, Homo sapiens
YYRADDANVVRDRDLEVDTTLK

SEQ ID NO: 40734 - protein, 29 aa, Homo sapiens
KSDLFQDDLYPDTAGPEAALEAEEWFEGK

SEQ ID NO: 40735 - protein, 13 aa, Homo sapiens
KTTDTASVQNEAK

SEQ ID NO: 40736 - protein, 10 aa, Homo sapiens
NGSLICTASK

SEQ ID NO: 40737 - protein, 12 aa, Homo sapiens
NGSLICTASKDK

SEQ ID NO: 40738 - protein, 12 aa, Homo sapiens
NILDSKPTANKK

SEQ ID NO: 40739 - protein, 25 aa, Homo sapiens
QSKFRHVFGQAVKNDQCYDDIRVSR

SEQ ID NO: 40740 - protein, 7 aa, Homo sapiens
RGLDVNK

SEQ ID NO: 40741 - protein, 28 aa, Homo sapiens
SDLFQDDLYPDTAGPEAALEAEEWFEGK

SEQ ID NO: 40742 - protein, 12 aa, Homo sapiens
SIKDTICNQDER

SEQ ID NO: 40743 - protein, 12 aa, Homo sapiens
TTDTASVQNEAK

SEQ ID NO: 40744 - protein, 26 aa, Homo sapiens
RNFNYHILSPCDLSNYTDLAMSTVKQ

SEQ ID NO: 40745 - protein, 25 aa, Homo sapiens
AVSDASAGDYGSAIETLVTAISLIK

SEQ ID NO: 40746 - protein, 14 aa, Homo sapiens
ELHGQNPVVTPCNK

SEQ ID NO: 40747 - protein, 15 aa, Homo sapiens
RELHGQNPVVTPCNK

SEQ ID NO: 40748 - protein, 16 aa, Homo sapiens
VLISSLQDCLHGIESK

SEQ ID NO: 40749 - protein, 25 aa, Homo sapiens
GSSMGQMAAQMGQLGQMGQPGLGAD

SEQ ID NO: 40750 - protein, 26 aa, Homo sapiens
KKKPSMPNVSNDLSQKLYATMEKHKE

SEQ ID NO: 40751 - protein, 11 aa, Homo sapiens
MPNVSNDLSQK

SEQ ID NO: 40752 - protein, 22 aa, Homo sapiens
NQQTILGSPASGIQNTIGSVGT

SEQ ID NO: 40753 - protein, 30 aa, Homo sapiens
RNQQTILGSPASGIQNTIGSVGTGQQNATS

SEQ ID NO: 40754 - protein, 29 aa, Homo sapiens
VLAETLTQVSPQMTGHAGLNTAQAGGMAK

SEQ ID NO: 40755 - protein, 6 aa, Homo sapiens
YHFCEK

SEQ ID NO: 40756 - protein, 16 aa, Homo sapiens
LFFHCSQYNGNLQDLK

SEQ ID NO: 40757 - protein, 12 aa, Homo sapiens
QRPGQQVATCVR

SEQ ID NO: 40758 - protein, 19 aa, Homo sapiens
THSVNGITEEADPTIYSGK

SEQ ID NO: 40759 - protein, 14 aa, Homo sapiens
FNLTGLNEQVPHYR

SEQ ID NO: 40760 - protein, 16 aa, Homo sapiens
GNEFFCEVDEDYIQDK

SEQ ID NO: 40761 - protein, 30 aa, Homo sapiens
GNEFFCEVDEDYIQDKFNLTGLNEQVPHYR

SEQ ID NO: 40762 - protein, 9 aa, Homo sapiens
RPANQFVPR

SEQ ID NO: 40763 - protein, 13 aa, Homo sapiens
EQGTQDITDASER

SEQ ID NO: 40764 - protein, 21 aa, Homo sapiens
KGTVLCGPPPAVENASLIGAR

SEQ ID NO: 40765 - protein, 13 aa, Homo sapiens
RANATLLLGPLRA

SEQ ID NO: 40766 - protein, 14 aa, Homo sapiens
RNPQELYDVYCFAR

SEQ ID NO: 40767 - protein, 20 aa, Homo sapiens
TASGQRQDLPILVAKDNVVR

SEQ ID NO: 40768 - protein, 6 aa, Homo sapiens
VLELEK

SEQ ID NO: 40769 - protein, 28 aa, Homo sapiens
KKNATMLYTASQAFLRHPDVAATRANRD

SEQ ID NO: 40770 - protein, 28 aa, Homo sapiens
RIVAECNAVRQALQDLLSEYMNNTGRKE

SEQ ID NO: 40771 - protein, 17 aa, Homo sapiens
DQECDKFNQCGTCNEFK

SEQ ID NO: 40772 - protein, 9 aa, Homo sapiens
GDGLAPLGR

SEQ ID NO: 40773 - protein, 7 aa, Homo sapiens
IVTSTYK

SEQ ID NO: 40774 - protein, 10 aa, Homo sapiens
IVTSTYKDGK

SEQ ID NO: 40775 - protein, 10 aa, Homo sapiens
NSWGEPWGER

SEQ ID NO: 40776 - protein, 12 aa, Homo sapiens
NVDGVNYASITR

SEQ ID NO: 40777 - protein, 20 aa, Homo sapiens
RLANYTGGIYAEYQDTTYIN

SEQ ID NO: 40778 - protein, 17 aa, Homo sapiens
STYPRPHEYLSPADLPK

SEQ ID NO: 40779 - protein, 17 aa, Homo sapiens
SWDWRNVDGVNYASITR

SEQ ID NO: 40780 - protein, 10 aa, Homo sapiens
VGDYGSLSGR

SEQ ID NO: 40781 - protein, 12 aa, Homo sapiens
VGDYGSLSGREK

SEQ ID NO: 40782 - protein, 16 aa, Homo sapiens
YNLAIEEHCTFGDPIV

SEQ ID NO: 40783 - protein, 36 aa, Homo sapiens
RNISLLHYLIMILEKHFPDILNMPSELQHLPEAAKV

SEQ ID NO: 40784 - protein, 11 aa, Homo sapiens
DGHIALHLAVR

SEQ ID NO: 40785 - protein, 19 aa, Homo sapiens
KEIQHPNVITLHEVYENKT

SEQ ID NO: 40786 - protein, 17 aa, Homo sapiens
YLCLMGASVEALTTDGK

SEQ ID NO: 40787 - protein, 9 aa, Homo sapiens
EYALKIIKK

SEQ ID NO: 40788 - protein, 6 aa, Homo sapiens
LKIIKK

SEQ ID NO: 40789 - protein, 13 aa, Homo sapiens
STSYTKIASSSRR

SEQ ID NO: 40790 - protein, 39 aa, Homo sapiens
RRSKSPADSANGTSSSQLSTPKSKQSPISTPTSPGSLRK

SEQ ID NO: 40791 - protein, 14 aa, Homo sapiens
TKNVNPNWSVNVKT

SEQ ID NO: 40792 - protein, 18 aa, Homo sapiens
RNRNLSGGVLMGFMLNRI

SEQ ID NO: 40793 - protein, 15 aa, Homo sapiens
KEGMLTKQNNSFQRS

SEQ ID NO: 40794 - protein, 24 aa, Homo sapiens
TILLDAHEAGSAENDTADAEPPKI

SEQ ID NO: 40795 - protein, 15 aa, Homo sapiens
HECTLSSQEYVHELR

SEQ ID NO: 40796 - protein, 11 aa, Homo sapiens
NPVVNHPCATR

SEQ ID NO: 40797 - protein, 39 aa, Homo sapiens
PPPPPPLLFGGPPPPPPLGGVPPPPGISLNLPYGMKQKK

SEQ ID NO: 40798 - protein, 28 aa, Homo sapiens
VSLTSNPVSWVNNFGHEGLGLLLDELEK

SEQ ID NO: 40799 - protein, 19 aa, Homo sapiens
KLKTNVTFPLDILLLSFKA

SEQ ID NO: 40800 - protein, 11 aa, Homo sapiens
RSNFTLTAARH

SEQ ID NO: 40801 - protein, 14 aa, Homo sapiens
LIPTGRDVGPVPLK

SEQ ID NO: 40802 - protein, 16 aa, Homo sapiens
RDWYEQVNGSDGMFKY

SEQ ID NO: 40803 - protein, 8 aa, Homo sapiens
KPPPPVPK

SEQ ID NO: 40804 - protein, 19 aa, Homo sapiens
SLPDCTPHPNSISIDAGPR

SEQ ID NO: 40805 - protein, 22 aa, Homo sapiens
ALCLDLLSLSAACDALDQHNLK

SEQ ID NO: 40806 - protein, 11 aa, Homo sapiens
DMNEDNEGTVK

SEQ ID NO: 40807 - protein, 11 aa, Homo sapiens
IKTGKASIPLK

SEQ ID NO: 40808 - protein, 8 aa, Homo sapiens
KETLVEDK

SEQ ID NO: 40809 - protein, 15 aa, Homo sapiens
LYSLKQDLLSTLKNK

SEQ ID NO: 40810 - protein, 14 aa, Homo sapiens
QAEEVNTEWEKLNL

SEQ ID NO: 40811 - protein, 26 aa, Homo sapiens
QAEVIKGSWQPVGDLLIDSLQDHLEK

SEQ ID NO: 40812 - protein, 10 aa, Homo sapiens
QDLLSTLKNK

SEQ ID NO: 40813 - protein, 7 aa, Homo sapiens
QLAKDLR

SEQ ID NO: 40814 - protein, 10 aa, Homo sapiens
QSMGKLYSLK

SEQ ID NO: 40815 - protein, 11 aa, Homo sapiens
RKEGNFSDLKE

SEQ ID NO: 40816 - protein, 22 aa, Homo sapiens
SCFQFANNKPEIEAALFLDWMR

SEQ ID NO: 40817 - protein, 24 aa, Homo sapiens
TLNATGEEIIQQSSKTDASILQEK

SEQ ID NO: 40818 - protein, 7 aa, Homo sapiens
YQLGIEK

SEQ ID NO: 40819 - protein, 15 aa, Homo sapiens
AGLPGFYDPCVGEEK

SEQ ID NO: 40820 - protein, 12 aa, Homo sapiens
GIRPGLTTVLAR

SEQ ID NO: 40821 - protein, 15 aa, Homo sapiens
GVLHQVMVLDSEALR

SEQ ID NO: 40822 - protein, 18 aa, Homo sapiens
LFNLVHQAYEVLSDPQTR

SEQ ID NO: 40823 - protein, 15 aa, Homo sapiens
KWRSNTSLLQQNLRQ

SEQ ID NO: 40824 - protein, 11 aa, Homo sapiens
APEPDLMSPTR

SEQ ID NO: 40825 - protein, 25 aa, Homo sapiens
MNGSGQSPSVLKGILHEAAMQYPKQ

SEQ ID NO: 40826 - protein, 20 aa, Homo sapiens
KSNISPNFNFMGQLLDFERT

SEQ ID NO: 40827 - protein, 29 aa, Homo sapiens
APPHELTEEEKQQILHSEEFLSFFDHSTR

SEQ ID NO: 40828 - protein, 27 aa, Homo sapiens
LDLWNLNNDTEVPTASISVEGNPALNR

SEQ ID NO: 40829 - protein, 18 aa, Homo sapiens
QQILHSEEFLSFFDHSTR

SEQ ID NO: 40830 - protein, 16 aa, Homo sapiens
TPLSAAAHTHPVYCVN

SEQ ID NO: 40831 - protein, 24 aa, Homo sapiens
TPLSAAAHTHPVYCVNVVGTQNAH

SEQ ID NO: 40832 - protein, 34 aa, Homo sapiens
TPLSAAAHTHPVYCVNVVGTQNAHNLISISTDGK

SEQ ID NO: 40833 - protein, 32 aa, Homo sapiens
KDHPVSCCLGLLLESLVPFIVNDNITNNFFRF

SEQ ID NO: 40834 - protein, 25 aa, Homo sapiens
KALKSNSSLTKGLRTMVEQNLMEKL

SEQ ID NO: 40835 - protein, 13 aa, Homo sapiens
ATAPQTQHVSPMR

SEQ ID NO: 40836 - protein, 15 aa, Homo sapiens
FEEHVQSVDIAAFNK

SEQ ID NO: 40837 - protein, 14 aa, Homo sapiens
FYEQMNGPVAGASR

SEQ ID NO: 40838 - protein, 12 aa, Homo sapiens
KLQIQCVVEDDK

SEQ ID NO: 40839 - protein, 24 aa, Homo sapiens
KLQIQCVVEDDKVGTDLLEEEITK

SEQ ID NO: 40840 - protein, 7 aa, Homo sapiens
KPALVAK

SEQ ID NO: 40841 - protein, 11 aa, Homo sapiens
LQIQCVVEDDK

SEQ ID NO: 40842 - protein, 23 aa, Homo sapiens
LQIQCVVEDDKVGTDLLEEEITK

SEQ ID NO: 40843 - protein, 24 aa, Homo sapiens
SLAGSSGPGASSGTSGDHGELVVR

SEQ ID NO: 40844 - protein, 24 aa, Homo sapiens
SSILLDVKPWDDETDMAQLEACVR

SEQ ID NO: 40845 - protein, 27 aa, Homo sapiens
VGTDLLEEEITKFEEHVQSVDIAAFNK

SEQ ID NO: 40846 - protein, 28 aa, Homo sapiens
VGTDLLEEEITKFEEHVQSVDIAAFNKI

SEQ ID NO: 40847 - protein, 16 aa, Homo sapiens
RRDNASGDAAKGKVKA

SEQ ID NO: 40848 - protein, 37 aa, Homo sapiens
DLATVNSNPFDDPDAAELNPFGDPDSEEPITETASPR

SEQ ID NO: 40849 - protein, 10 aa, Homo sapiens
KPSEDEVLNK

SEQ ID NO: 40850 - protein, 14 aa, Homo sapiens
LQTLDIGSNLEKEK

SEQ ID NO: 40851 - protein, 18 aa, Homo sapiens
NTEEEEAMMQEWFMLVNK

SEQ ID NO: 40852 - protein, 14 aa, Homo sapiens
NTVSAGKDLSTSPK

SEQ ID NO: 40853 - protein, 20 aa, Homo sapiens
STPPPNNLVNPVQELETERR

SEQ ID NO: 40854 - protein, 24 aa, Homo sapiens
TSGSDDPGICSNTDSTQAQVLLGK

SEQ ID NO: 40855 - protein, 28 aa, Homo sapiens
KVLESPENKSGTFKAQEAEAGVLGNEKG

SEQ ID NO: 40856 - protein, 27 aa, Homo sapiens
RLRNSSSFSMDDPDAGAMGAAAAEGQA

SEQ ID NO: 40857 - protein, 9 aa, Homo sapiens
CVCLDDKER

SEQ ID NO: 40858 - protein, 11 aa, Homo sapiens
LQTSLANLHQK

SEQ ID NO: 40859 - protein, 14 aa, Homo sapiens
TGIAQLVKYGLKDL

SEQ ID NO: 40860 - protein, 13 aa, Homo sapiens
YLKLVCDEIYNIK

SEQ ID NO: 40861 - protein, 29 aa, Homo sapiens
RSDFLLVYGDVISNINITRALEEHRLRRK

SEQ ID NO: 40862 - protein, 19 aa, Homo sapiens
VAAGAQIHQSLLCDNAEVK

SEQ ID NO: 40863 - protein, 28 aa, Homo sapiens
YDLLDCHISICSPQVAQLFTDNFDYQTR

SEQ ID NO: 40864 - protein, 17 aa, Homo sapiens
KPSIAAVVGSMDAHPNR

SEQ ID NO: 40865 - protein, 27 aa, Homo sapiens
RPASHQTFPLQQESGQTVECTVAQYFK

SEQ ID NO: 40866 - protein, 15 aa, Homo sapiens
DASDDLDDLNFFNQK

SEQ ID NO: 40867 - protein, 10 aa, Homo sapiens
DYTYEELLNR

SEQ ID NO: 40868 - protein, 9 aa, Homo sapiens
EYVTCHTCR

SEQ ID NO: 40869 - protein, 12 aa, Homo sapiens
LYFLQCETCHSR

SEQ ID NO: 40870 - protein, 11 aa, Homo sapiens
TSFVNFTDICK

SEQ ID NO: 40871 - protein, 29 aa, Homo sapiens
DNSDFDLLTVSETANEPPQDEGNSFNSPR

SEQ ID NO: 40872 - protein, 14 aa, Homo sapiens
IFHTVTTTDDPVIR

SEQ ID NO: 40873 - protein, 19 aa, Homo sapiens
NLAMEATYINHNFSQQCLR

SEQ ID NO: 40874 - protein, 21 aa, Homo sapiens
RNLAMEATYINHNFSQQCLRM

SEQ ID NO: 40875 - protein, 20 aa, Homo sapiens
TQGNVFATDAILATLMSCTR

SEQ ID NO: 40876 - protein, 21 aa, Homo sapiens
YLEVSEPQDIECCGALEYYDK

SEQ ID NO: 40877 - protein, 14 aa, Homo sapiens
AASLLLEILGLLCK

SEQ ID NO: 40878 - protein, 11 aa, Homo sapiens
EAVGDLLDAFK

SEQ ID NO: 40879 - protein, 20 aa, Homo sapiens
EAVQCVQELASPSLLFIFVR

SEQ ID NO: 40880 - protein, 11 aa, Homo sapiens
EITKPLRPLGK

SEQ ID NO: 40881 - protein, 19 aa, Homo sapiens
ITKPGSIDSNNQLFAPGGR

SEQ ID NO: 40882 - protein, 19 aa, Homo sapiens
LQGINCGPDFTPSFANLGR

SEQ ID NO: 40883 - protein, 14 aa, Homo sapiens
VPTTEKPTVTVNFR

SEQ ID NO: 40884 - protein, 23 aa, Homo sapiens
NDFQLIGIQDGYLSLLQDSGEVR

SEQ ID NO: 40885 - protein, 24 aa, Homo sapiens
RNDFQLIGIQDGYLSLLQDSGEVR

SEQ ID NO: 40886 - protein, 24 aa, Homo sapiens
YDCGEEILITVLSAMTEEAAVAIK

SEQ ID NO: 40887 - protein, 14 aa, Homo sapiens
AMEKLLASVEERQR

SEQ ID NO: 40888 - protein, 17 aa, Homo sapiens
RETNTTSQMQAALLEKL

SEQ ID NO: 40889 - protein, 24 aa, Homo sapiens
RGTELGGAAGQGGHPPGYTSLASR

SEQ ID NO: 40890 - protein, 10 aa, Homo sapiens
RLEDRFNSTL

SEQ ID NO: 40891 - protein, 16 aa, Homo sapiens
RLGALNSSLQLLEDRL

SEQ ID NO: 40892 - protein, 13 aa, Homo sapiens
LPDTPQGLLGEAR

SEQ ID NO: 40893 - protein, 10 aa, Homo sapiens
TQILEWAAER

SEQ ID NO: 40894 - protein, 32 aa, Homo sapiens
VSPSVSEFLLQLDSCHLDLGPEGGTVELIQGR

SEQ ID NO: 40895 - protein, 18 aa, Homo sapiens
AAVPSGASTGIYEALELR

SEQ ID NO: 40896 - protein, 7 aa, Homo sapiens
AVEHINK

SEQ ID NO: 40897 - protein, 16 aa, Homo sapiens
AVEHINKTIAPALVSK

SEQ ID NO: 40898 - protein, 17 aa, Homo sapiens
AVEHINKTIAPALVSKK

SEQ ID NO: 40899 - protein, 19 aa, Homo sapiens
DATNVGDEGGFAPNILENK

SEQ ID NO: 40900 - protein, 26 aa, Homo sapiens
DATNVGDEGGFAPNILENKEGLELLK

SEQ ID NO: 40901 - protein, 21 aa, Homo sapiens
DYPVVSIEDPFDQDDWGAWQK

SEQ ID NO: 40902 - protein, 7 aa, Homo sapiens
EGLELLK

SEQ ID NO: 40903 - protein, 15 aa, Homo sapiens
FGANAILGVSLAVCK

SEQ ID NO: 40904 - protein, 20 aa, Homo sapiens
FTASAGIQVVGDDLTVTNPK

SEQ ID NO: 40905 - protein, 21 aa, Homo sapiens
FTASAGIQVVGDDLTVTNPKR

SEQ ID NO: 40906 - protein, 13 aa, Homo sapiens
GNPTVEVDLFTSK

SEQ ID NO: 40907 - protein, 20 aa, Homo sapiens
GVSKAVEHINKTIAPALVSK

SEQ ID NO: 40908 - protein, 30 aa, Homo sapiens
HIADLAGNSEVILPVPAFNVINGGSHAGNK

SEQ ID NO: 40909 - protein, 8 aa, Homo sapiens
IEEELGSK

SEQ ID NO: 40910 - protein, 10 aa, Homo sapiens
IGAEVYHNLK

SEQ ID NO: 40911 - protein, 9 aa, Homo sapiens
KLNVTEQEK

SEQ ID NO: 40912 - protein, 12 aa, Homo sapiens
KLNVTEQEKIDK

SEQ ID NO: 40913 - protein, 17 aa, Homo sapiens
LAMQEFMILPVGAANFR

SEQ ID NO: 40914 - protein, 14 aa, Homo sapiens
LAQANGWGVMVSHR

SEQ ID NO: 40915 - protein, 11 aa, Homo sapiens
LMIEMDGTENK

SEQ ID NO: 40916 - protein, 8 aa, Homo sapiens
LNVTEQEK

SEQ ID NO: 40917 - protein, 11 aa, Homo sapiens
LNVTEQEKIDK

SEQ ID NO: 40918 - protein, 15 aa, Homo sapiens
PAFNVINGGSHAGNK

SEQ ID NO: 40919 - protein, 15 aa, Homo sapiens
PSGASTGIYEALELR

SEQ ID NO: 40920 - protein, 17 aa, Homo sapiens
PVPAFNVINGGSHAGNK

SEQ ID NO: 40921 - protein, 19 aa, Homo sapiens
PVVSIEDPFDQDDWGAWQK

SEQ ID NO: 40922 - protein, 8 aa, Homo sapiens
SCNCLLLK

SEQ ID NO: 40923 - protein, 25 aa, Homo sapiens
SFIKDYPVVSIEDPFDQDDWGAWQK

SEQ ID NO: 40924 - protein, 22 aa, Homo sapiens
SGETEDTFIADLVVGLCTGQIK

SEQ ID NO: 40925 - protein, 9 aa, Homo sapiens
SGKYDLDFK

SEQ ID NO: 40926 - protein, 16 aa, Homo sapiens
SGKYDLDFKSPDDPSR

SEQ ID NO: 40927 - protein, 9 aa, Homo sapiens
TIAPALVSK

SEQ ID NO: 40928 - protein, 15 aa, Homo sapiens
VNQIGSVTESLQACK

SEQ ID NO: 40929 - protein, 14 aa, Homo sapiens
VVIGMDVAASEFFR

SEQ ID NO: 40930 - protein, 12 aa, Homo sapiens
YISPDQLADLYK

SEQ ID NO: 40931 - protein, 16 aa, Homo sapiens
YNQLLRIEEELGSKAK

SEQ ID NO: 40932 - protein, 33 aa, Homo sapiens
AGMNPGMLAAGNGQGIMPNQVMNGSIGAGRGRQ

SEQ ID NO: 40933 - protein, 23 aa, Homo sapiens
HTNYTFEIDAVNGVSELSSPPRQ

SEQ ID NO: 40934 - protein, 22 aa, Homo sapiens
RGTNVTISSLKPDTIYVFQIRA

SEQ ID NO: 40935 - protein, 26 aa, Homo sapiens
RNVISNINETSVILDWSWPLDTGGRK

SEQ ID NO: 40936 - protein, 19 aa, Homo sapiens
RQFGLTNTTVTVTDLLAHT

SEQ ID NO: 40937 - protein, 13 aa, Homo sapiens
TVMGDLGWIAFPK

SEQ ID NO: 40938 - protein, 9 aa, Homo sapiens
RWNTTYRRY

SEQ ID NO: 40939 - protein, 29 aa, Homo sapiens
RISESGIKKMCRNIFVLQQNLTNITMSRE

SEQ ID NO: 40940 - protein, 13 aa, Homo sapiens
FDPSTKIYEISNR

SEQ ID NO: 40941 - protein, 17 aa, Homo sapiens
IFIKPNAQKPLPQALSK

SEQ ID NO: 40942 - protein, 32 aa, Homo sapiens
LENVLFGPHDCSHAPPDGYPIIPTSGSVPVQK

SEQ ID NO: 40943 - protein, 22 aa, Homo sapiens
PIEETPCHFISSLDELVELNEK

SEQ ID NO: 40944 - protein, 11 aa, Homo sapiens
KATNATLDPRS

SEQ ID NO: 40945 - protein, 18 aa, Homo sapiens
REYNLNFSGSSTIQEVKR

SEQ ID NO: 40946 - protein, 19 aa, Homo sapiens
GLLGALTSTPYSPTQHLER

SEQ ID NO: 40947 - protein, 21 aa, Homo sapiens
MRINNVPAEGENEVNNELANR

SEQ ID NO: 40948 - protein, 27 aa, Homo sapiens
VLTCTDLEQGPNFFLDFENAQPTESEK

SEQ ID NO: 40949 - protein, 20 aa, Homo sapiens
VMVGVIILYDHVHPVGAFAK

SEQ ID NO: 40950 - protein, 16 aa, Homo sapiens
YTTKHLNDETTSKQIK

SEQ ID NO: 40951 - protein, 26 aa, Homo sapiens
RIKSLDDSSNETIYYEPLEMTDPSKN

SEQ ID NO: 40952 - protein, 29 aa, Homo sapiens
LTCNDTSAALLISHIVQSEIGDFDEALDR

SEQ ID NO: 40953 - protein, 7 aa, Homo sapiens
QVLDYVK

SEQ ID NO: 40954 - protein, 20 aa, Homo sapiens
RVFFAGFSNATVDNSILLRL

SEQ ID NO: 40955 - protein, 16 aa, Homo sapiens
KEILYWFANSTQWTKA

SEQ ID NO: 40956 - protein, 23 aa, Homo sapiens
REENNISGLNQDITDVCFSPEKD

SEQ ID NO: 40957 - protein, 21 aa, Homo sapiens
KELEVLSLHNVTFEDAGEYTC

SEQ ID NO: 40958 - protein, 18 aa, Homo sapiens
RMDKPANCTHDLYMIMRE

SEQ ID NO: 40959 - protein, 22 aa, Homo sapiens
DPSLVVAGEALDALFDVFADGK

SEQ ID NO: 40960 - protein, 10 aa, Homo sapiens
FIAYQETVEK

SEQ ID NO: 40961 - protein, 28 aa, Homo sapiens
CQAEAAAAANGTGGEEDDGPAAELLEKL

SEQ ID NO: 40962 - protein, 12 aa, Homo sapiens
KNLMNVSNARRP

SEQ ID NO: 40963 - protein, 11 aa, Homo sapiens
ENKLLLQERVK

SEQ ID NO: 40964 - protein, 12 aa, Homo sapiens
HDSGIKAKISMK

SEQ ID NO: 40965 - protein, 24 aa, Homo sapiens
KTTTRQLSSPNHSPSQSPNQSPRI

SEQ ID NO: 40966 - protein, 39 aa, Homo sapiens
GTTSAYPSHPMPYSSVLTQNSLGNNHSFSTANGLSVDRL

SEQ ID NO: 40967 - protein, 15 aa, Homo sapiens
FQQVSDPVAAEFSLN

SEQ ID NO: 40968 - protein, 18 aa, Homo sapiens
KTGSICASENINDTLTRY

SEQ ID NO: 40969 - protein, 23 aa, Homo sapiens
REGANATSDMFYFAVEDGGGNKL

SEQ ID NO: 40970 - protein, 27 aa, Homo sapiens
RLVLGTPQSNSPFGAAVGEQNETLIRI

SEQ ID NO: 40971 - protein, 14 aa, Homo sapiens
SLEFAFQPETEECR

SEQ ID NO: 40972 - protein, 13 aa, Homo sapiens
CQHAAEIITDLLR

SEQ ID NO: 40973 - protein, 26 aa, Homo sapiens
GRPAPGFHHGDGPGNAVQEIMIPASK

SEQ ID NO: 40974 - protein, 20 aa, Homo sapiens
IGGDAGTSLNSNDYGYGGQK

SEQ ID NO: 40975 - protein, 13 aa, Homo sapiens
IQFKPDDGTTPER

SEQ ID NO: 40976 - protein, 31 aa, Homo sapiens
KRPLEDGDQPDAKKVAPQNDSFGTQLPPMHQ

SEQ ID NO: 40977 - protein, 18 aa, Homo sapiens
MVMIQDGPQNTGADKPLR

SEQ ID NO: 40978 - protein, 24 aa, Homo sapiens
QQAAYYAQTSPQGMPQHPPAPQGQ

SEQ ID NO: 40979 - protein, 13 aa, Homo sapiens
ENLITANATEPQK

SEQ ID NO: 40980 - protein, 24 aa, Homo sapiens
RAPGDEEAQVENLITANATEPQKA

SEQ ID NO: 40981 - protein, 16 aa, Homo sapiens
CAQSVNDPGNMSFVKE

SEQ ID NO: 40982 - protein, 37 aa, Homo sapiens
HEWVTTENGIGTVGISNFAQEALGDVVYCSLPEVGTK

SEQ ID NO: 40983 - protein, 10 aa, Homo sapiens
SCYEDGWLIK

SEQ ID NO: 40984 - protein, 15 aa, Homo sapiens
KETNFSLASGLEAKD

SEQ ID NO: 40985 - protein, 13 aa, Homo sapiens
ELSAHTGYLSCCR

SEQ ID NO: 40986 - protein, 13 aa, Homo sapiens
FVCLNDNIDHNHK

SEQ ID NO: 40987 - protein, 25 aa, Homo sapiens
KLNNPKDFQELNKQTKKNMTIDGKE

SEQ ID NO: 40988 - protein, 11 aa, Homo sapiens
PSLIVPLESQM

SEQ ID NO: 40989 - protein, 16 aa, Homo sapiens
QKGYENLVSPITLLPE

SEQ ID NO: 40990 - protein, 17 aa, Homo sapiens
VTKEKPPSLIVPLESQM

SEQ ID NO: 40991 - protein, 14 aa, Homo sapiens
LLNFSQEEENMLKE

SEQ ID NO: 40992 - protein, 13 aa, Homo sapiens
LIEETISIAMATK

SEQ ID NO: 40993 - protein, 16 aa, Homo sapiens
YSSDTTPLLNGSSQDR

SEQ ID NO: 40994 - protein, 27 aa, Homo sapiens
RRHNSSDGFDSAIGRPNGGNFGRKEKN

SEQ ID NO: 40995 - protein, 15 aa, Homo sapiens
RTHGRNGTENINHRG

SEQ ID NO: 40996 - protein, 7 aa, Homo sapiens
DFLLSDK

SEQ ID NO: 40997 - protein, 24 aa, Homo sapiens
ISIENSEEALTVHAPFPAAHPASR

SEQ ID NO: 40998 - protein, 12 aa, Homo sapiens
SSLHYKPTPDLR

SEQ ID NO: 40999 - protein, 9 aa, Homo sapiens
FSHGTMPLR

SEQ ID NO: 41000 - protein, 10 aa, Homo sapiens
HYEVEILDAK

SEQ ID NO: 41001 - protein, 17 aa, Homo sapiens
LCFLDKVEPHATIAEIK

SEQ ID NO: 41002 - protein, 9 aa, Homo sapiens
LLETLFVHR

SEQ ID NO: 41003 - protein, 11 aa, Homo sapiens
VEPHATIAEIK

SEQ ID NO: 41004 - protein, 38 aa, Homo sapiens
MVVTLTELPSGNDTSGLENKTVVVTTILESPYVMMKKN

SEQ ID NO: 41005 - protein, 26 aa, Homo sapiens
KENITDPPRGCVGNTNIWKTGPLFKR

SEQ ID NO: 41006 - protein, 16 aa, Homo sapiens
QVGIYNGTHVIPNDRK

SEQ ID NO: 41007 - protein, 17 aa, Homo sapiens
RTMNFTYEVHLVADGKF

SEQ ID NO: 41008 - protein, 37 aa, Homo sapiens
KSLMDQLQGVVSNFSTAIPDFHAVLAGPGGPGNGLRS

SEQ ID NO: 41009 - protein, 25 aa, Homo sapiens
RNVNFNGSAGTPVMFNKNGDAPGRY

SEQ ID NO: 41010 - protein, 16 aa, Homo sapiens
FCDNVWTFVLNDVEFR

SEQ ID NO: 41011 - protein, 18 aa, Homo sapiens
KVKIVACDGKNTGSNTTE

SEQ ID NO: 41012 - protein, 35 aa, Homo sapiens
NTTLGNSLQESLDELIQSQQITPQLALQVLLQFDK

SEQ ID NO: 41013 - protein, 13 aa, Homo sapiens
IFTGNKFTKDTTK

SEQ ID NO: 41014 - protein, 13 aa, Homo sapiens
ILEASNSIQFVIK

SEQ ID NO: 41015 - protein, 12 aa, Homo sapiens
NFSIVAHVDHGK

SEQ ID NO: 41016 - protein, 19 aa, Homo sapiens
TYEVNEVGVLNPNEQPTHK

SEQ ID NO: 41017 - protein, 17 aa, Homo sapiens
YLFPLNEIVVDFYDSLK

SEQ ID NO: 41018 - protein, 24 aa, Homo sapiens
RTVELPEDNETAVYTLMPMVMADQ

SEQ ID NO: 41019 - protein, 19 aa, Homo sapiens
IWHPNISSVTGAICLDILK

SEQ ID NO: 41020 - protein, 18 aa, Homo sapiens
LWAHVYAGAPVSSPEYTK

SEQ ID NO: 41021 - protein, 31 aa, Homo sapiens
KFFPPVLNVTWLCNGELVTEGVAESLFLPRT

SEQ ID NO: 41022 - protein, 20 aa, Homo sapiens
RSNHTQATNDPPEVTVFPKE

SEQ ID NO: 41023 - protein, 10 aa, Homo sapiens
FLFCSEYRPK

SEQ ID NO: 41024 - protein, 13 aa, Homo sapiens
GEHPGLSIGDVAK

SEQ ID NO: 41025 - protein, 13 aa, Homo sapiens
HPDASVNFSEFSK

SEQ ID NO: 41026 - protein, 15 aa, Homo sapiens
IKGEHPGLSIGDVAK

SEQ ID NO: 41027 - protein, 14 aa, Homo sapiens
KHPDASVNFSEFSK

SEQ ID NO: 41028 - protein, 18 aa, Homo sapiens
LGEMWNNTAADDKQPYEK

SEQ ID NO: 41029 - protein, 16 aa, Homo sapiens
RPPSAFFLFCSEYRPK

SEQ ID NO: 41030 - protein, 14 aa, Homo sapiens
KNPEVPVNFAEFSK

SEQ ID NO: 41031 - protein, 16 aa, Homo sapiens
RPPSGFFLFCSEFRPK

SEQ ID NO: 41032 - protein, 13 aa, Homo sapiens
STNPGISIGDVAK

SEQ ID NO: 41033 - protein, 19 aa, Homo sapiens
EYFGGFGEVESIELPMDNK

SEQ ID NO: 41034 - protein, 10 aa, Homo sapiens
FGEVVDCTLK

SEQ ID NO: 41035 - protein, 8 aa, Homo sapiens
GFCFITFK

SEQ ID NO: 41036 - protein, 15 aa, Homo sapiens
GFCFITFKEEEPVKK

SEQ ID NO: 41037 - protein, 14 aa, Homo sapiens
IFVGGLSPDTPEEK

SEQ ID NO: 41038 - protein, 15 aa, Homo sapiens
IFVGGLSPDTPEEKI

SEQ ID NO: 41039 - protein, 9 aa, Homo sapiens
KYHNVGLSK

SEQ ID NO: 41040 - protein, 9 aa, Homo sapiens
RGFCFITFK

SEQ ID NO: 41041 - protein, 8 aa, Homo sapiens
YHNVGLSK

SEQ ID NO: 41042 - protein, 13 aa, Homo sapiens
DLNYCFSGMSDHR

SEQ ID NO: 41043 - protein, 6 aa, Homo sapiens
FFSDCK

SEQ ID NO: 41044 - protein, 16 aa, Homo sapiens
HTGPNSPDTANDGFVR

SEQ ID NO: 41045 - protein, 17 aa, Homo sapiens
STGEAFVQFASQEIAEK

SEQ ID NO: 41046 - protein, 10 aa, Homo sapiens
VHIEIGPDGR

SEQ ID NO: 41047 - protein, 17 aa, Homo sapiens
YGDGGSSFQSTTGHCVH

SEQ ID NO: 41048 - protein, 19 aa, Homo sapiens
DTPDSLSPETYGNFDSQSR

SEQ ID NO: 41049 - protein, 15 aa, Homo sapiens
QRPAAGAPPELHSLR

SEQ ID NO: 41050 - protein, 13 aa, Homo sapiens
DLNHVCVISETGK

SEQ ID NO: 41051 - protein, 10 aa, Homo sapiens
FFADLLDYIK

SEQ ID NO: 41052 - protein, 13 aa, Homo sapiens
NVLIVEDIIDTGK

SEQ ID NO: 41053 - protein, 30 aa, Homo sapiens
SPGVVISDDEPGYDLDLFCIPNHYAEDLER

SEQ ID NO: 41054 - protein, 16 aa, Homo sapiens
SVGYKPDFVGFEIPDK

SEQ ID NO: 41055 - protein, 10 aa, Homo sapiens
TMQTLLSLVR

SEQ ID NO: 41056 - protein, 11 aa, Homo sapiens
VFIPHGLIMDR

SEQ ID NO: 41057 - protein, 13 aa, Homo sapiens
VIGGDDLSTLTGK

SEQ ID NO: 41058 - protein, 14 aa, Homo sapiens
AGGIETIANEYSDR

SEQ ID NO: 41059 - protein, 14 aa, Homo sapiens
ELSTTLNADEAVTR

SEQ ID NO: 41060 - protein, 12 aa, Homo sapiens
ELTSTCSPIISK

SEQ ID NO: 41061 - protein, 14 aa, Homo sapiens
ELTSTCSPIISKPK

SEQ ID NO: 41062 - protein, 12 aa, Homo sapiens
EMLNLYIENEGK

SEQ ID NO: 41063 - protein, 22 aa, Homo sapiens
FGPKNRSIGAAAKSQVISNAKN

SEQ ID NO: 41064 - protein, 9 aa, Homo sapiens
FQESEERPK

SEQ ID NO: 41065 - protein, 14 aa, Homo sapiens
GCALQCAILSPAFK

SEQ ID NO: 41066 - protein, 16 aa, Homo sapiens
KFDEVLVNHFCEEFGK

SEQ ID NO: 41067 - protein, 19 aa, Homo sapiens
KPVVDCVVSVPCFYTDAER

SEQ ID NO: 41068 - protein, 10 aa, Homo sapiens
LKETAESVLK

SEQ ID NO: 41069 - protein, 14 aa, Homo sapiens
NFTTEQVTAMLLSK

SEQ ID NO: 41070 - protein, 18 aa, Homo sapiens
SNLAYDIVQLPTGLTGIK

SEQ ID NO: 41071 - protein, 18 aa, Homo sapiens
TSTVDLPIENQLLWQIDR

SEQ ID NO: 41072 - protein, 13 aa, Homo sapiens
VLATAFDTTLGGR

SEQ ID NO: 41073 - protein, 19 aa, Homo sapiens
VNVHGIFSVSSASLVEVHK

SEQ ID NO: 41074 - protein, 17 aa, Homo sapiens
WNSPAEEGSSDCEVFSK

SEQ ID NO: 41075 - protein, 26 aa, Homo sapiens
KKQPFSSASSQNGSLSPHYLSSVIKQ

SEQ ID NO: 41076 - protein, 13 aa, Homo sapiens
APLKPYPVSPSDK

SEQ ID NO: 41077 - protein, 27 aa, Homo sapiens
DSLPVCPVDASGCFTTEVTDFAGQYVK

SEQ ID NO: 41078 - protein, 13 aa, Homo sapiens
EIVVIHQDPEALK

SEQ ID NO: 41079 - protein, 16 aa, Homo sapiens
FGWDCHGLPVEYEIDK

SEQ ID NO: 41080 - protein, 8 aa, Homo sapiens
FLIQNVLR

SEQ ID NO: 41081 - protein, 16 aa, Homo sapiens
ILEFWTEFNCFQECLK

SEQ ID NO: 41082 - protein, 27 aa, Homo sapiens
KLKLFLNETQTQEITEDIPVKTLNMKT

SEQ ID NO: 41083 - protein, 16 aa, Homo sapiens
LLVATTFTHSYPFCWR

SEQ ID NO: 41084 - protein, 13 aa, Homo sapiens
NNDLCYWVPELVR

SEQ ID NO: 41085 - protein, 18 aa, Homo sapiens
STACNTPLSNFESHQNYK

SEQ ID NO: 41086 - protein, 17 aa, Homo sapiens
TGTIVVEGHELHDEDIR

SEQ ID NO: 41087 - protein, 23 aa, Homo sapiens
VLIDPVSVQDKDTLSIHYLMLPR

SEQ ID NO: 41088 - protein, 33 aa, Homo sapiens
YWGTPIPLWVSDDFEEVVCIGSVAELEELSGAK

SEQ ID NO: 41089 - protein, 15 aa, Homo sapiens
CYTAVVPLVYGGETK

SEQ ID NO: 41090 - protein, 11 aa, Homo sapiens
ENISDPTSPLR

SEQ ID NO: 41091 - protein, 13 aa, Homo sapiens
ENISDPTSPLRTR

SEQ ID NO: 41092 - protein, 10 aa, Homo sapiens
FVYHLSDLCK

SEQ ID NO: 41093 - protein, 11 aa, Homo sapiens
FVYHLSDLCKK

SEQ ID NO: 41094 - protein, 16 aa, Homo sapiens
ICDEDSATETCYTYDR

SEQ ID NO: 41095 - protein, 15 aa, Homo sapiens
IIRSSEDPNEDIVER

SEQ ID NO: 41096 - protein, 18 aa, Homo sapiens
IIRSSEDPNEDIVERNIR

SEQ ID NO: 41097 - protein, 8 aa, Homo sapiens
IIVPLNNR

SEQ ID NO: 41098 - protein, 13 aa, Homo sapiens
IIVPLNNRENISD

SEQ ID NO: 41099 - protein, 19 aa, Homo sapiens
IIVPLNNRENISDPTSPLR

SEQ ID NO: 41100 - protein, 7 aa, Homo sapiens
IVLVDNK

SEQ ID NO: 41101 - protein, 9 aa, Homo sapiens
IVLVDNKCK

SEQ ID NO: 41102 - protein, 36 aa, Homo sapiens
KCDPTEVELDNQIVTATQSNICDEDSATETCYTYDR

SEQ ID NO: 41103 - protein, 14 aa, Homo sapiens
MVETALTPDACYPD

SEQ ID NO: 41104 - protein, 17 aa, Homo sapiens
NKCYTAVVPLVYGGETK

SEQ ID NO: 41105 - protein, 19 aa, Homo sapiens
NKCYTAVVPLVYGGETKMV

SEQ ID NO: 41106 - protein, 13 aa, Homo sapiens
NRENISDPTSPLR

SEQ ID NO: 41107 - protein, 7 aa, Homo sapiens
PDACYPD

SEQ ID NO: 41108 - protein, 16 aa, Homo sapiens
PLNNRENISDPTSPLR

SEQ ID NO: 41109 - protein, 9 aa, Homo sapiens
PLVYGGETK

SEQ ID NO: 41110 - protein, 8 aa, Homo sapiens
PNEDIVER

SEQ ID NO: 41111 - protein, 13 aa, Homo sapiens
RENISDPTSPLRT

SEQ ID NO: 41112 - protein, 12 aa, Homo sapiens
SSEDPNEDIVER

SEQ ID NO: 41113 - protein, 15 aa, Homo sapiens
SSEDPNEDIVERNIR

SEQ ID NO: 41114 - protein, 13 aa, Homo sapiens
TAVVPLVYGGETK

SEQ ID NO: 41115 - protein, 12 aa, Homo sapiens
TRFVYHLSDLCK

SEQ ID NO: 41116 - protein, 13 aa, Homo sapiens
TRFVYHLSDLCKK

SEQ ID NO: 41117 - protein, 17 aa, Homo sapiens
VPLNNRENISDPTSPLR

SEQ ID NO: 41118 - protein, 8 aa, Homo sapiens
YHLSDLCK

SEQ ID NO: 41119 - protein, 14 aa, Homo sapiens
YTAVVPLVYGGETK

SEQ ID NO: 41120 - protein, 23 aa, Homo sapiens
RLALTPAHLLFTADNHTEPAARF

SEQ ID NO: 41121 - protein, 21 aa, Homo sapiens
EQVPSLGSNVACGLAYTDYHK

SEQ ID NO: 41122 - protein, 10 aa, Homo sapiens
VLHDAQQQCR

SEQ ID NO: 41123 - protein, 9 aa, Homo sapiens
EIQVIPLQR

SEQ ID NO: 41124 - protein, 11 aa, Homo sapiens
LQVSQQEDITK

SEQ ID NO: 41125 - protein, 8 aa, Homo sapiens
RVIAANNR

SEQ ID NO: 41126 - protein, 23 aa, Homo sapiens
SILTDNPTWIIDPIDGTTNFVHR

SEQ ID NO: 41127 - protein, 11 aa, Homo sapiens
SLLVTELGSSR

SEQ ID NO: 41128 - protein, 13 aa, Homo sapiens
SSPVDLVTATDQK

SEQ ID NO: 41129 - protein, 16 aa, Homo sapiens
SSPVDLVTATDQKVEK

SEQ ID NO: 41130 - protein, 17 aa, Homo sapiens
YPSHSFIGEESVAAGEK

SEQ ID NO: 41131 - protein, 37 aa, Homo sapiens
RQSKSESDYSDGDNDSINSTSNSNDTINCSSESSSRD

SEQ ID NO: 41132 - protein, 22 aa, Homo sapiens
RDGEQSPNVSLMQRMSDMLSRW

SEQ ID NO: 41133 - protein, 16 aa, Homo sapiens
KNAPQNSTQAHSENKC

SEQ ID NO: 41134 - protein, 19 aa, Homo sapiens
RFLALANGSLLVPLLSAKE

SEQ ID NO: 41135 - protein, 26 aa, Homo sapiens
RNGESMLNASLVNASSLSEAEQLQRE

SEQ ID NO: 41136 - protein, 25 aa, Homo sapiens
DDVNVEIVFLHNISPNLELEALFKR

SEQ ID NO: 41137 - protein, 20 aa, Homo sapiens
IPEIPADVVGALLFLEDYVR

SEQ ID NO: 41138 - protein, 31 aa, Homo sapiens
TVQLIQALEEVQEFHQLESNLQVCQFLADTR

SEQ ID NO: 41139 - protein, 15 aa, Homo sapiens
KGVSFNESAADNLKL

SEQ ID NO: 41140 - protein, 16 aa, Homo sapiens
KNLSCTNVLQSNSTKK

SEQ ID NO: 41141 - protein, 17 aa, Homo sapiens
RMKSDSFLQEMPNVTNI

SEQ ID NO: 41142 - protein, 15 aa, Homo sapiens
RNCQAIQQNHSCSKS

SEQ ID NO: 41143 - protein, 30 aa, Homo sapiens
PSSLIQANVTVGTCSGFCSQKEFPLAILRG

SEQ ID NO: 41144 - protein, 23 aa, Homo sapiens
RSLVPTLREMVAFLNVSVSEERL

SEQ ID NO: 41145 - protein, 13 aa, Homo sapiens
KGNKKNSTTNYRG

SEQ ID NO: 41146 - protein, 22 aa, Homo sapiens
KKQSNNDLFQVNSTSDDEIPRK

SEQ ID NO: 41147 - protein, 18 aa, Homo sapiens
KSIHEQDTNVNNSVLKKV

SEQ ID NO: 41148 - protein, 20 aa, Homo sapiens
MASQLQEKCIAFIVDNFSKI

SEQ ID NO: 41149 - protein, 12 aa, Homo sapiens
EYLDISFNILDK

SEQ ID NO: 41150 - protein, 35 aa, Homo sapiens
LSTCFNAFIAGIAQVMDYNINLGKHLLPLVVQVLK

SEQ ID NO: 41151 - protein, 27 aa, Homo sapiens
MVEMVCLHVISLMEALQECNSTIFVKL

SEQ ID NO: 41152 - protein, 17 aa, Homo sapiens
ESSSANVSPFAPGVSSR

SEQ ID NO: 41153 - protein, 19 aa, Homo sapiens
IINLCENADQAHFDLALAR

SEQ ID NO: 41154 - protein, 33 aa, Homo sapiens
RHVNLSSLVPSLCVHLCSSHLLLRRAAVACLRQ

SEQ ID NO: 41155 - protein, 26 aa, Homo sapiens
KEKRPVTRPDCMCDTFDQCAENISKK

SEQ ID NO: 41156 - protein, 28 aa, Homo sapiens
KVLLNSSVPPAGAEELSSAMANPPPKRP

SEQ ID NO: 41157 - protein, 39 aa, Homo sapiens
RNWVKIHFNRSNQNSSAGDNDADGQGSASAPLMAVPARY

SEQ ID NO: 41158 - protein, 13 aa, Homo sapiens
WGNPARAPRPGQR

SEQ ID NO: 41159 - protein, 24 aa, Homo sapiens
KFHHLIPAHTFTNISTKNPQGSKS

SEQ ID NO: 41160 - protein, 30 aa, Homo sapiens
RYFNPVDQENALIAAIANWSELASMPVGRS

SEQ ID NO: 41161 - protein, 37 aa, Homo sapiens
KIGLNIGQAIVNTSGTVPAIPSINILQNVTPKGEDKS

SEQ ID NO: 41162 - protein, 22 aa, Homo sapiens
KLMLVSAPSILSSGNGTAINMT

SEQ ID NO: 41163 - protein, 17 aa, Homo sapiens
CIIQMQGNSTSIINPKN

SEQ ID NO: 41164 - protein, 15 aa, Homo sapiens
ENNVSKGDNGELAKE

SEQ ID NO: 41165 - protein, 14 aa, Homo sapiens
KKHDNETNLSTEKV

SEQ ID NO: 41166 - protein, 19 aa, Homo sapiens
KVGSTNVSTLVNVHFAPRI

SEQ ID NO: 41167 - protein, 14 aa, Homo sapiens
SEEQVFEAALAWVR

SEQ ID NO: 41168 - protein, 11 aa, Homo sapiens
WTVVTSMSSNR

SEQ ID NO: 41169 - protein, 13 aa, Homo sapiens
ATLKDQLIYNLLK

SEQ ID NO: 41170 - protein, 21 aa, Homo sapiens
ATLKDQLIYNLLKEEQTPQNK

SEQ ID NO: 41171 - protein, 21 aa, Homo sapiens
DDVFLSVPCILGQNGISDLVK

SEQ ID NO: 41172 - protein, 15 aa, Homo sapiens
DLADELALVDVIEDK

SEQ ID NO: 41173 - protein, 17 aa, Homo sapiens
DLADELALVDVIEDKLK

SEQ ID NO: 41174 - protein, 9 aa, Homo sapiens
DQLIYNLLK

SEQ ID NO: 41175 - protein, 17 aa, Homo sapiens
DQLIYNLLKEEQTPQNK

SEQ ID NO: 41176 - protein, 9 aa, Homo sapiens
DYNVTANSK

SEQ ID NO: 41177 - protein, 8 aa, Homo sapiens
FIIPNVVK

SEQ ID NO: 41178 - protein, 14 aa, Homo sapiens
GEMMDLQHGSLFLR

SEQ ID NO: 41179 - protein, 27 aa, Homo sapiens
GLYGIKDDVFLSVPCILGQNGISDLVK

SEQ ID NO: 41180 - protein, 20 aa, Homo sapiens
GYTSWAIGLSVADLAESIMK

SEQ ID NO: 41181 - protein, 27 aa, Homo sapiens
HGWVLGEHGDSSVPVWSGMNVAGVSLK

SEQ ID NO: 41182 - protein, 11 aa, Homo sapiens
IGSGCNLDSAR

SEQ ID NO: 41183 - protein, 11 aa, Homo sapiens
LGVHPLSCHGW

SEQ ID NO: 41184 - protein, 28 aa, Homo sapiens
LGVHPLSCHGWVLGEHGDSSVPVWSGMN

SEQ ID NO: 41185 - protein, 35 aa, Homo sapiens
LGVHPLSCHGWVLGEHGDSSVPVWSGMNVAGVSLK

SEQ ID NO: 41186 - protein, 16 aa, Homo sapiens
LKGEMMDLQHGSLFLR

SEQ ID NO: 41187 - protein, 17 aa, Homo sapiens
LLIVSNPVDILTYVAWK

SEQ ID NO: 41188 - protein, 9 aa, Homo sapiens
LVIITAGAR

SEQ ID NO: 41189 - protein, 6 aa, Homo sapiens
NVNIFK

SEQ ID NO: 41190 - protein, 14 aa, Homo sapiens
PCILGQNGISDLVK

SEQ ID NO: 41191 - protein, 11 aa, Homo sapiens
QVVESAYEVIK

SEQ ID NO: 41192 - protein, 10 aa, Homo sapiens
RVHPVSTMIK

SEQ ID NO: 41193 - protein, 10 aa, Homo sapiens
SADTLWGIQK

SEQ ID NO: 41194 - protein, 29 aa, Homo sapiens
SCHGWVLGEHGDSSVPVWSGMNVAGVSLK

SEQ ID NO: 41195 - protein, 10 aa, Homo sapiens
TLHPDLGTDK

SEQ ID NO: 41196 - protein, 12 aa, Homo sapiens
TLHPDLGTDKDK

SEQ ID NO: 41197 - protein, 16 aa, Homo sapiens
TLHPDLGTDKDKEQWK

SEQ ID NO: 41198 - protein, 9 aa, Homo sapiens
VHPVSTMIK

SEQ ID NO: 41199 - protein, 12 aa, Homo sapiens
VIGSGCNLDSAR

SEQ ID NO: 41200 - protein, 10 aa, Homo sapiens
VTLTSEEEAR

SEQ ID NO: 41201 - protein, 21 aa, Homo sapiens
ADGYVDNLAEAVDLLLQHADK

SEQ ID NO: 41202 - protein, 22 aa, Homo sapiens
LGFDISEQEVTAPAPAACQILK

SEQ ID NO: 41203 - protein, 14 aa, Homo sapiens
DHPHTAAYLQELGR

SEQ ID NO: 41204 - protein, 30 aa, Homo sapiens
DLSQAPFSWPAGALVAQACHAATAALHTHR

SEQ ID NO: 41205 - protein, 25 aa, Homo sapiens
NIDHMLWLEQPENIATCIALRPYPK

SEQ ID NO: 41206 - protein, 33 aa, Homo sapiens
MKLGTEALSTNHSVIVNSPVITAAINKEFSNKV

SEQ ID NO: 41207 - protein, 7 aa, Homo sapiens
APAVFVK

SEQ ID NO: 41208 - protein, 13 aa, Homo sapiens
AQEHYPVSAGYTK

SEQ ID NO: 41209 - protein, 10 aa, Homo sapiens
CNNLGYEINK

SEQ ID NO: 41210 - protein, 8 aa, Homo sapiens
DFIDIESK

SEQ ID NO: 41211 - protein, 8 aa, Homo sapiens
EKVSHLQK

SEQ ID NO: 41212 - protein, 14 aa, Homo sapiens
EPDSNVIVVDWLSR

SEQ ID NO: 41213 - protein, 10 aa, Homo sapiens
GLGDVDQLVK

SEQ ID NO: 41214 - protein, 19 aa, Homo sapiens
ITGLDPAGPNFEYAEAPSR

SEQ ID NO: 41215 - protein, 7 aa, Homo sapiens
KVIFCSR

SEQ ID NO: 41216 - protein, 17 aa, Homo sapiens
LSPDDADFVDVLHTFTR

SEQ ID NO: 41217 - protein, 7 aa, Homo sapiens
LVAALYK

SEQ ID NO: 41218 - protein, 8 aa, Homo sapiens
LVGQDVAR

SEQ ID NO: 41219 - protein, 9 aa, Homo sapiens
RDFIDIESK

SEQ ID NO: 41220 - protein, 15 aa, Homo sapiens
REPDSNVIVVDWLSR

SEQ ID NO: 41221 - protein, 31 aa, Homo sapiens
SIGIQKPVGHVDIYPNGGTFQPGCNIGEAIR

SEQ ID NO: 41222 - protein, 17 aa, Homo sapiens
SIHLFIDSLLNEENPSK

SEQ ID NO: 41223 - protein, 7 aa, Homo sapiens
VFHYQVK

SEQ ID NO: 41224 - protein, 17 aa, Homo sapiens
CGAIAEQTPILLLFLLR

SEQ ID NO: 41225 - protein, 21 aa, Homo sapiens
DAGIEPGPDTYLALLNAYAEK

SEQ ID NO: 41226 - protein, 9 aa, Homo sapiens
DAHLLVESK

SEQ ID NO: 41227 - protein, 11 aa, Homo sapiens
DLLQIIFSFSK

SEQ ID NO: 41228 - protein, 18 aa, Homo sapiens
DLPVTEAVFSALVTGHAR

SEQ ID NO: 41229 - protein, 17 aa, Homo sapiens
DTTALSFFHMLNGAALR

SEQ ID NO: 41230 - protein, 18 aa, Homo sapiens
EEGFPIRPHYFWPLLVGR

SEQ ID NO: 41231 - protein, 25 aa, Homo sapiens
GPTEAVGYFLYNLIDSMSDSEVQAK

SEQ ID NO: 41232 - protein, 16 aa, Homo sapiens
HDKVEDALNLKEEFDR

SEQ ID NO: 41233 - protein, 17 aa, Homo sapiens
HSLNSSSASTTEPDFQK

SEQ ID NO: 41234 - protein, 7 aa, Homo sapiens
IHDVLCK

SEQ ID NO: 41235 - protein, 23 aa, Homo sapiens
LANQFAIYKPVTDFFLQLVDAGK

SEQ ID NO: 41236 - protein, 11 aa, Homo sapiens
LDSSAVLDTGK

SEQ ID NO: 41237 - protein, 16 aa, Homo sapiens
LIASYCNVGDIEGASK

SEQ ID NO: 41238 - protein, 13 aa, Homo sapiens
NLLESYHVPELIK

SEQ ID NO: 41239 - protein, 20 aa, Homo sapiens
NNNIDAAIENIENMLTSENK

SEQ ID NO: 41240 - protein, 29 aa, Homo sapiens
QLHEAIVTLGLAEPSTNISFPLVTVHLEK

SEQ ID NO: 41241 - protein, 10 aa, Homo sapiens
SCGSLLPELK

SEQ ID NO: 41242 - protein, 16 aa, Homo sapiens
SEAANGNLDFVLSFLK

SEQ ID NO: 41243 - protein, 14 aa, Homo sapiens
SGGLGGSHALLLLR

SEQ ID NO: 41244 - protein, 16 aa, Homo sapiens
SMNINLWSEITELLYK

SEQ ID NO: 41245 - protein, 17 aa, Homo sapiens
TVQLTSSELESTLETLK

SEQ ID NO: 41246 - protein, 14 aa, Homo sapiens
VIEPQYFGLAYLFR

SEQ ID NO: 41247 - protein, 23 aa, Homo sapiens
YAGEPVPFIEPPESFEFYAQQLR

SEQ ID NO: 41248 - protein, 18 aa, Homo sapiens
ALHLSDLFSPLPILELTR

SEQ ID NO: 41249 - protein, 19 aa, Homo sapiens
SPSAPAATSSASSSTSSYK

SEQ ID NO: 41250 - protein, 26 aa, Homo sapiens
KLEFLPEEIGQMQKLRVLNLSDNRLK

SEQ ID NO: 41251 - protein, 13 aa, Homo sapiens
LSQVPDNPPDYQK

SEQ ID NO: 41252 - protein, 10 aa, Homo sapiens
LYEHIVADDR

SEQ ID NO: 41253 - protein, 17 aa, Homo sapiens
WYVDGPASTAFQEHVSR

SEQ ID NO: 41254 - protein, 24 aa, Homo sapiens
NMINATIKQDDPFNIDLGQQSQRS

SEQ ID NO: 41255 - protein, 28 aa, Homo sapiens
KGRANHSAFLFGFGDGGGGPTQTMLDRL

SEQ ID NO: 41256 - protein, 11 aa, Homo sapiens
AAEEPSKVEEK

SEQ ID NO: 41257 - protein, 19 aa, Homo sapiens
GEAAAERPGEAAVASSPSK

SEQ ID NO: 41258 - protein, 18 aa, Homo sapiens
GEPAAAAAPEAGASPVEK

SEQ ID NO: 41259 - protein, 15 aa, Homo sapiens
INQELSSKENIVQER

SEQ ID NO: 41260 - protein, 18 aa, Homo sapiens
LNKEYSISNKENTHNGLR

SEQ ID NO: 41261 - protein, 8 aa, Homo sapiens
SQNYFTNR

SEQ ID NO: 41262 - protein, 11 aa, Homo sapiens
KHKEFVGNWNK

SEQ ID NO: 41263 - protein, 19 aa, Homo sapiens
KVAYSNDSANWTEYQDPRT

SEQ ID NO: 41264 - protein, 15 aa, Homo sapiens
TWGLHLFSWNPSYAR

SEQ ID NO: 41265 - protein, 23 aa, Homo sapiens
KQKNSSDQEGNNISSSSGHRVRL

SEQ ID NO: 41266 - protein, 26 aa, Homo sapiens
KVMPCLAPIAAKVGSVGHKMNLTGND

SEQ ID NO: 41267 - protein, 10 aa, Homo sapiens
KKDEGLYECR

SEQ ID NO: 41268 - protein, 14 aa, Homo sapiens
VQGNDISHKLQISK

SEQ ID NO: 41269 - protein, 13 aa, Homo sapiens
VTDANYGELQEHK

SEQ ID NO: 41270 - protein, 19 aa, Homo sapiens
VTDANYGELQEHKAQAYLK

SEQ ID NO: 41271 - protein, 27 aa, Homo sapiens
VTDANYGELQEHKAQAYLKVNANSHAR

SEQ ID NO: 41272 - protein, 33 aa, Homo sapiens
MFTRLSNCANRTILYDMYSYVWDIKSIMSMVKS

SEQ ID NO: 41273 - protein, 15 aa, Homo sapiens
STDPENGHIFNCIQR

SEQ ID NO: 41274 - protein, 22 aa, Homo sapiens
VEYPIMYSTDPENGHIFNCIQR

SEQ ID NO: 41275 - protein, 24 aa, Homo sapiens
YKVEYPIMYSTDPENGHIFNCIQR

SEQ ID NO: 41276 - protein, 28 aa, Homo sapiens
MKDLHSDDNEEESDEVEDNDNDSEMERP

SEQ ID NO: 41277 - protein, 31 aa, Homo sapiens
PRMSVLRSAETMQSALAAMQQFYGINMTGKV

SEQ ID NO: 41278 - protein, 26 aa, Homo sapiens
DLALPIGNELEEDLEILEEAALQVCK

SEQ ID NO: 41279 - protein, 14 aa, Homo sapiens
GIPIGMLVLGNKVK

SEQ ID NO: 41280 - protein, 24 aa, Homo sapiens
KVNGTITFIDEIHNDDGVWLRLND

SEQ ID NO: 41281 - protein, 33 aa, Homo sapiens
CLIPNETKTPGVMDHYLVMHQLRCNGVLEGIRI

SEQ ID NO: 41282 - protein, 7 aa, Homo sapiens
QRPSEER

SEQ ID NO: 41283 - protein, 26 aa, Homo sapiens
RRRINSSVTTETISETTEVLNEPFDN

SEQ ID NO: 41284 - protein, 12 aa, Homo sapiens
SLPPVSLLPHEK

SEQ ID NO: 41285 - protein, 30 aa, Homo sapiens
VTQQMSNISGSCSMLQQTSISSPPTCSVKS

SEQ ID NO: 41286 - protein, 22 aa, Homo sapiens
RNPDMEVDENGTLDLSMNKQRP

SEQ ID NO: 41287 - protein, 19 aa, Homo sapiens
AIIGLYNYAHEMTHGASDR

SEQ ID NO: 41288 - protein, 20 aa, Homo sapiens
NLITDICTEQCTLSDQLLPK

SEQ ID NO: 41289 - protein, 9 aa, Homo sapiens
AFLFQDTPR

SEQ ID NO: 41290 - protein, 19 aa, Homo sapiens
ALREDNAYCEDIDECAEGR

SEQ ID NO: 41291 - protein, 18 aa, Homo sapiens
KLSTLLNHNNDTEEEERL

SEQ ID NO: 41292 - protein, 38 aa, Homo sapiens
RSSDMDQQEDMISGVENSNVSENDIPFNVQYPGQTSKT

SEQ ID NO: 41293 - protein, 38 aa, Homo sapiens
GEQLLGAGEVFAIGPLQLYAVTEQLQQGKPTCASGDAK

SEQ ID NO: 41294 - protein, 25 aa, Homo sapiens
SIGSLPCLEHVSLLNNPLSIIPDYR

SEQ ID NO: 41295 - protein, 13 aa, Homo sapiens
SLHQVEISHCDAK

SEQ ID NO: 41296 - protein, 29 aa, Homo sapiens
FSGTNVETDFVEVPSQMLENWVWDVDSLR

SEQ ID NO: 41297 - protein, 12 aa, Homo sapiens
IVHLQETCDLGK

SEQ ID NO: 41298 - protein, 20 aa, Homo sapiens
YNHAACFGLQPGCLLPDGSR

SEQ ID NO: 41299 - protein, 30 aa, Homo sapiens
THLGHLLNPGDLVLGFDLANCNLNDEHVNK

SEQ ID NO: 41300 - protein, 35 aa, Homo sapiens
VTSAIHLIDPNTLQVADIDGSTFWSHPFNSLCHPK

SEQ ID NO: 41301 - protein, 16 aa, Homo sapiens
YFQPPGTWIQCALESR

SEQ ID NO: 41302 - protein, 23 aa, Homo sapiens
MVTEMYSGPCVAMEIQQNNATKT

SEQ ID NO: 41303 - protein, 28 aa, Homo sapiens
AVPLPPADCVLSTLCLDAACPDLPTYCR

SEQ ID NO: 41304 - protein, 17 aa, Homo sapiens
EIVVTDYSDQNLQELEK

SEQ ID NO: 41305 - protein, 21 aa, Homo sapiens
EPEAFDWSPVVTYVCDLEGNR

SEQ ID NO: 41306 - protein, 24 aa, Homo sapiens
GDLLIDIGSGPTIYQLLSACESFK

SEQ ID NO: 41307 - protein, 22 aa, Homo sapiens
KEPEAFDWSPVVTYVCDLEGNR

SEQ ID NO: 41308 - protein, 19 aa, Homo sapiens
NLGSLLKPGGFLVIMDALK

SEQ ID NO: 41309 - protein, 13 aa, Homo sapiens
GLLPGCVYHVQLK

SEQ ID NO: 41310 - protein, 16 aa, Homo sapiens
GRENVGIYNLSKGVNR

SEQ ID NO: 41311 - protein, 11 aa, Homo sapiens
IQSTVTQPGGK

SEQ ID NO: 41312 - protein, 12 aa, Homo sapiens
RENVGIYNLSKG

SEQ ID NO: 41313 - protein, 17 aa, Homo sapiens
RLENITTGTYTIHAQKE

SEQ ID NO: 41314 - protein, 32 aa, Homo sapiens
RVTNSNANAASPLIVAGYNVSGSVRSDGEPMK

SEQ ID NO: 41315 - protein, 18 aa, Homo sapiens
VLPGDYEILATHPTWALK

SEQ ID NO: 41316 - protein, 14 aa, Homo sapiens
LLSNKTNAVEENKA

SEQ ID NO: 41317 - protein, 22 aa, Homo sapiens
LNGCSMPSEKGPIKWVITDAEK

SEQ ID NO: 41318 - protein, 35 aa, Homo sapiens
RSPYNSHMGNNASRPHSANGEVYGLLGSVLTIKKE

SEQ ID NO: 41319 - protein, 12 aa, Homo sapiens
SAPALPVSEDFK

SEQ ID NO: 41320 - protein, 22 aa, Homo sapiens
SLERNNIKQAANNSLLLHLLKS

SEQ ID NO: 41321 - protein, 13 aa, Homo sapiens
KNSNLQHINFTRN

SEQ ID NO: 41322 - protein, 18 aa, Homo sapiens
KSSPDTQDLYCLNESSKN

SEQ ID NO: 41323 - protein, 13 aa, Homo sapiens
RITNISSDDSGKQ

SEQ ID NO: 41324 - protein, 22 aa, Homo sapiens
RLEPNSVDPENITEIFIANQKR

SEQ ID NO: 41325 - protein, 12 aa, Homo sapiens
RNLTIVDSGLKF

SEQ ID NO: 41326 - protein, 24 aa, Homo sapiens
LLEGQDSGNSNGNASINITDISRN

SEQ ID NO: 41327 - protein, 18 aa, Homo sapiens
DKELTGALIASLINCYIR

SEQ ID NO: 41328 - protein, 29 aa, Homo sapiens
DNAAVDGISLHLQDICPLLYSTDDAICSK

SEQ ID NO: 41329 - protein, 22 aa, Homo sapiens
EITAIESSVPCQLLESVLQELK

SEQ ID NO: 41330 - protein, 21 aa, Homo sapiens
ESQLALIVCPLEQLLQGINPR

SEQ ID NO: 41331 - protein, 25 aa, Homo sapiens
ILNILDSIDFSQEIPEPLQLDFFDR

SEQ ID NO: 41332 - protein, 18 aa, Homo sapiens
KPVSTTNLQDPGVLGCPR

SEQ ID NO: 41333 - protein, 12 aa, Homo sapiens
TCLHAILNILEK

SEQ ID NO: 41334 - protein, 29 aa, Homo sapiens
DTTQSKPVSSPFPTKPLEGQAEGDSGECK

SEQ ID NO: 41335 - protein, 15 aa, Homo sapiens
HVNTNPLCDLTPIFK

SEQ ID NO: 41336 - protein, 16 aa, Homo sapiens
NNVLIVCVPNPPIDEK

SEQ ID NO: 41337 - protein, 30 aa, Homo sapiens
KINSTADLDFIQQAISYSSFPFWMGLSRRN

SEQ ID NO: 41338 - protein, 24 aa, Homo sapiens
KVLSFYNVSQMGALLAGVSTQAFC

SEQ ID NO: 41339 - protein, 22 aa, Homo sapiens
LSELSNSQQSVQTLSLWLIHHR

SEQ ID NO: 41340 - protein, 15 aa, Homo sapiens
LTFLYLANDVIQNSK

SEQ ID NO: 41341 - protein, 24 aa, Homo sapiens
VDENENCSSLGSPSEPPQTLDLVR

SEQ ID NO: 41342 - protein, 11 aa, Homo sapiens
AAHLCAEAALR

SEQ ID NO: 41343 - protein, 12 aa, Homo sapiens
FTVLLMPNGPMR

SEQ ID NO: 41344 - protein, 21 aa, Homo sapiens
GIAFPTSISVNNCVCHFSPLK

SEQ ID NO: 41345 - protein, 13 aa, Homo sapiens
HELLQPFNVLYEK

SEQ ID NO: 41346 - protein, 31 aa, Homo sapiens
IDLGVHVDGFIANVAHTFVVDVAQGTQVTGR

SEQ ID NO: 41347 - protein, 22 aa, Homo sapiens
KGIAFPTSISVNNCVCHFSPLK

SEQ ID NO: 41348 - protein, 17 aa, Homo sapiens
LVKPGNQNTQVTEAWNK

SEQ ID NO: 41349 - protein, 10 aa, Homo sapiens
NCVCHFSPLK

SEQ ID NO: 41350 - protein, 18 aa, Homo sapiens
SLVEASSSGVSVLSLCEK

SEQ ID NO: 41351 - protein, 11 aa, Homo sapiens
TIIQNPTDQQK

SEQ ID NO: 41352 - protein, 19 aa, Homo sapiens
VAHSFNCTPIEGMLSHQLK

SEQ ID NO: 41353 - protein, 19 aa, Homo sapiens
DPLSANHSLKPLPSVPEEK

SEQ ID NO: 41354 - protein, 17 aa, Homo sapiens
ECLQALEFLHANQVIHR

SEQ ID NO: 41355 - protein, 35 aa, Homo sapiens
ERPEISPPSDFEHTIHVGFDAVTGEFTGMPEQWAR

SEQ ID NO: 41356 - protein, 11 aa, Homo sapiens
KNPQAVLDVLK

SEQ ID NO: 41357 - protein, 24 aa, Homo sapiens
ENAPNGTLVVTVNATDLDEGVNKD

SEQ ID NO: 41358 - protein, 13 aa, Homo sapiens
KEKGNSTTDNSDQ

SEQ ID NO: 41359 - protein, 29 aa, Homo sapiens
RVQALDPDEGSNGEVQYSLSNSTQAELRH

SEQ ID NO: 41360 - protein, 25 aa, Homo sapiens
RLVSNDSFISIQPSLSSCGQDLPRD

SEQ ID NO: 41361 - protein, 9 aa, Homo sapiens
EYAIKILEK

SEQ ID NO: 41362 - protein, 29 aa, Homo sapiens
MVDAASYAANLTDSAEAPKGSPGSWWKKE

SEQ ID NO: 41363 - protein, 25 aa, Homo sapiens
PNFNTSGGASAGGSDEGSSSSLGRK

SEQ ID NO: 41364 - protein, 31 aa, Homo sapiens
QSTMLDTNSWIFACINSTSMCLQGVDLSWKA

SEQ ID NO: 41365 - protein, 8 aa, Homo sapiens
DKEDKPLK

SEQ ID NO: 41366 - protein, 30 aa, Homo sapiens
KAKLLHYHMKYFHGMEKSLEPEESPGKRHV

SEQ ID NO: 41367 - protein, 8 aa, Homo sapiens
KATVNVKK

SEQ ID NO: 41368 - protein, 9 aa, Homo sapiens
LDKNSSQEK

SEQ ID NO: 41369 - protein, 36 aa, Homo sapiens
SLPKNEKEDKENISENDREYSGDAQVDKKPENDIVK

SEQ ID NO: 41370 - protein, 7 aa, Homo sapiens
SPQENLR

SEQ ID NO: 41371 - protein, 15 aa, Homo sapiens
WLNAQFDGNNETIKW

SEQ ID NO: 41372 - protein, 18 aa, Homo sapiens
AALAHSEEVTASQVAATK

SEQ ID NO: 41373 - protein, 36 aa, Homo sapiens
AFEETQIDIPGGGSHGGSTMSLWEVMQSDLIPEEQR

SEQ ID NO: 41374 - protein, 11 aa, Homo sapiens
AGLVGPEFHEK

SEQ ID NO: 41375 - protein, 21 aa, Homo sapiens
AGTLSITEFADMLSGNAGGFR

SEQ ID NO: 41376 - protein, 17 aa, Homo sapiens
AGVVGPELHEQLLSAEK

SEQ ID NO: 41377 - protein, 18 aa, Homo sapiens
AQAEAQQPTFDALRDELR

SEQ ID NO: 41378 - protein, 11 aa, Homo sapiens
AQLEPVASPAK

SEQ ID NO: 41379 - protein, 24 aa, Homo sapiens
ASWSDPTEETGPVAGILDTETLEK

SEQ ID NO: 41380 - protein, 19 aa, Homo sapiens
AYSDPSTGEPATYGELQQR

SEQ ID NO: 41381 - protein, 17 aa, Homo sapiens
CRPDQLTGLSLLPLSEK

SEQ ID NO: 41382 - protein, 17 aa, Homo sapiens
CVEDPETGLCLLPLTDK

SEQ ID NO: 41383 - protein, 15 aa, Homo sapiens
DDGTGQLLLPLSDAR

SEQ ID NO: 41384 - protein, 19 aa, Homo sapiens
DGHNLISLLEVLSGDSLPR

SEQ ID NO: 41385 - protein, 29 aa, Homo sapiens
DLLPSDMAVALLEAQAGTGHIIDPATSAR

SEQ ID NO: 41386 - protein, 15 aa, Homo sapiens
DPYTGQSVSLFQALK

SEQ ID NO: 41387 - protein, 10 aa, Homo sapiens
DYELQLVTYK

SEQ ID NO: 41388 - protein, 16 aa, Homo sapiens
EAQAVPATLPELEATK

SEQ ID NO: 41389 - protein, 19 aa, Homo sapiens
EQELQQTLQQEQSVLDQLR

SEQ ID NO: 41390 - protein, 25 aa, Homo sapiens
EYGSCSHHYQQLLQSLEQGAQEESR

SEQ ID NO: 41391 - protein, 17 aa, Homo sapiens
FLEGTSCIAGVFVDATK

SEQ ID NO: 41392 - protein, 17 aa, Homo sapiens
FPSSFEEIEILWSQFLK

SEQ ID NO: 41393 - protein, 16 aa, Homo sapiens
GDECQLVGPAQPSHWK

SEQ ID NO: 41394 - protein, 19 aa, Homo sapiens
GFFDPNTEENLTYLQLMER

SEQ ID NO: 41395 - protein, 19 aa, Homo sapiens
GFFDPNTHENLTYLQLLER

SEQ ID NO: 41396 - protein, 14 aa, Homo sapiens
GFFDPNTHENLTYR

SEQ ID NO: 41397 - protein, 8 aa, Homo sapiens
GHLSGLAK

SEQ ID NO: 41398 - protein, 26 aa, Homo sapiens
GIIRPGTAFELLEAQAATGYVIDPIK

SEQ ID NO: 41399 - protein, 16 aa, Homo sapiens
GIYQSLEGAVQAGQLK

SEQ ID NO: 41400 - protein, 19 aa, Homo sapiens
GLFDEEMNEILTDPSDDTK

SEQ ID NO: 41401 - protein, 10 aa, Homo sapiens
GLHQSIEEFR

SEQ ID NO: 41402 - protein, 10 aa, Homo sapiens
GLVGPELHDR

SEQ ID NO: 41403 - protein, 10 aa, Homo sapiens
HISDLYEDLR

SEQ ID NO: 41404 - protein, 10 aa, Homo sapiens
HKPLLIDMNK

SEQ ID NO: 41405 - protein, 27 aa, Homo sapiens
KGIIRPGTAFELLEAQAATGYVIDPIK

SEQ ID NO: 41406 - protein, 13 aa, Homo sapiens
LAQGHTTVDELAR

SEQ ID NO: 41407 - protein, 20 aa, Homo sapiens
LEAQHQALVTLWHQLHVDMK

SEQ ID NO: 41408 - protein, 19 aa, Homo sapiens
LEDLLQDAQDEKEQLNEYK

SEQ ID NO: 41409 - protein, 11 aa, Homo sapiens
LEQLFQDEVAK

SEQ ID NO: 41410 - protein, 8 aa, Homo sapiens
LFNAIIHR

SEQ ID NO: 41411 - protein, 13 aa, Homo sapiens
LGFHLPLEVAYQR

SEQ ID NO: 41412 - protein, 8 aa, Homo sapiens
LHVAILER

SEQ ID NO: 41413 - protein, 10 aa, Homo sapiens
LLAAGKVPQR

SEQ ID NO: 41414 - protein, 15 aa, Homo sapiens
LLDPEDVDVPQPDEK

SEQ ID NO: 41415 - protein, 10 aa, Homo sapiens
LLEAAAQSTK

SEQ ID NO: 41416 - protein, 19 aa, Homo sapiens
LLEAQACTGGIIDPSTGER

SEQ ID NO: 41417 - protein, 19 aa, Homo sapiens
LLEAQIATGGIIDPVHSHR

SEQ ID NO: 41418 - protein, 19 aa, Homo sapiens
LLEAQIATGGVIDPVHSHR

SEQ ID NO: 41419 - protein, 9 aa, Homo sapiens
LPLDKEPAR

SEQ ID NO: 41420 - protein, 10 aa, Homo sapiens
LPLLAVCDYK

SEQ ID NO: 41421 - protein, 21 aa, Homo sapiens
LQEDKEQMAQQLAEETQGFQR

SEQ ID NO: 41422 - protein, 13 aa, Homo sapiens
LREQLQLLEEQHR

SEQ ID NO: 41423 - protein, 11 aa, Homo sapiens
LRLPLDKEPAR

SEQ ID NO: 41424 - protein, 8 aa, Homo sapiens
LYVHEAVK

SEQ ID NO: 41425 - protein, 33 aa, Homo sapiens
MNEILTDPSDDTKGFFDPNTEENLTYLQLMERC

SEQ ID NO: 41426 - protein, 15 aa, Homo sapiens
QALHSLELHYQAFLR

SEQ ID NO: 41427 - protein, 26 aa, Homo sapiens
QLLSPGTALILLEAQAASGFLLDPVR

SEQ ID NO: 41428 - protein, 16 aa, Homo sapiens
QTNLENLDQAFSVAER

SEQ ID NO: 41429 - protein, 16 aa, Homo sapiens
RDDGTGQLLLPLSDAR

SEQ ID NO: 41430 - protein, 18 aa, Homo sapiens
RFPSSFEEIEILWSQFLK

SEQ ID NO: 41431 - protein, 17 aa, Homo sapiens
RQEQIQAMPLADSQAVR

SEQ ID NO: 41432 - protein, 20 aa, Homo sapiens
SHHYQQLLQSLEQGAQEESR

SEQ ID NO: 41433 - protein, 14 aa, Homo sapiens
SLESLHSFVAAATK

SEQ ID NO: 41434 - protein, 13 aa, Homo sapiens
SLQEEHVAVAQLR

SEQ ID NO: 41435 - protein, 8 aa, Homo sapiens
SWSLATFR

SEQ ID NO: 41436 - protein, 15 aa, Homo sapiens
THYSELTTLTSQYIK

SEQ ID NO: 41437 - protein, 18 aa, Homo sapiens
TLLQGSGCLAGIYLEDTK

SEQ ID NO: 41438 - protein, 27 aa, Homo sapiens
TQLASWSDPTEETGPVAGILDTETLEK

SEQ ID NO: 41439 - protein, 21 aa, Homo sapiens
VDGAEWGVDLPSVEAQLGSHR

SEQ ID NO: 41440 - protein, 31 aa, Homo sapiens
VLSSSGSEAAVPSVCFLVPPPNQEAQEAVTR

SEQ ID NO: 41441 - protein, 9 aa, Homo sapiens
VPLDVACAR

SEQ ID NO: 41442 - protein, 12 aa, Homo sapiens
VPPGYHPLDVEK

SEQ ID NO: 41443 - protein, 9 aa, Homo sapiens
VPVDVAYQR

SEQ ID NO: 41444 - protein, 8 aa, Homo sapiens
VPVDVAYR

SEQ ID NO: 41445 - protein, 16 aa, Homo sapiens
VQSGSESVIQEYVDLR

SEQ ID NO: 41446 - protein, 15 aa, Homo sapiens
YLQDLLAWVEENQHR

SEQ ID NO: 41447 - protein, 6 aa, Homo sapiens
YLTCPK

SEQ ID NO: 41448 - protein, 25 aa, Homo sapiens
EENTDDNITVQGEIRKEDGMENLKN

SEQ ID NO: 41449 - protein, 39 aa, Homo sapiens
RNPFHHSLPFSIPVHFTNGTYHVVGFDGSSTVDEFLQRL

SEQ ID NO: 41450 - protein, 13 aa, Homo sapiens
AGGSSRGCWYYLR

SEQ ID NO: 41451 - protein, 7 aa, Homo sapiens
REAEQLR

SEQ ID NO: 41452 - protein, 24 aa, Homo sapiens
KKRGTFIEFRNGMLNISPIGRSCT

SEQ ID NO: 41453 - protein, 19 aa, Homo sapiens
ELDSNPFASLVFYWEPLNR

SEQ ID NO: 41454 - protein, 19 aa, Homo sapiens
KKNEELEQLYQDQEVPKPK

SEQ ID NO: 41455 - protein, 14 aa, Homo sapiens
KLPEEEAECYFHSR

SEQ ID NO: 41456 - protein, 16 aa, Homo sapiens
KLPEEEAECYFHSRPK

SEQ ID NO: 41457 - protein, 13 aa, Homo sapiens
LPEEEAECYFHSR

SEQ ID NO: 41458 - protein, 15 aa, Homo sapiens
LPEEEAECYFHSRPK

SEQ ID NO: 41459 - protein, 17 aa, Homo sapiens
NEELEQLYQDQEVPKPK

SEQ ID NO: 41460 - protein, 18 aa, Homo sapiens
SSQIGAVVSHQSSVIPDR

SEQ ID NO: 41461 - protein, 14 aa, Homo sapiens
EVESVDLPHCHLIK

SEQ ID NO: 41462 - protein, 32 aa, Homo sapiens
HELLPSVNDITAVGPAHFYATNDHYFSDPFLK

SEQ ID NO: 41463 - protein, 36 aa, Homo sapiens
RIQNILSEKPTVTTVYANNGSVLQGSSVASVYDGKL

SEQ ID NO: 41464 - protein, 24 aa, Homo sapiens
TTVYANNGSVLQGSSVASVYDGKL

SEQ ID NO: 41465 - protein, 30 aa, Homo sapiens
VLELDTLVDNLSIDPSSGDIWVGCHPNGQK

SEQ ID NO: 41466 - protein, 36 aa, Homo sapiens
VVAEGFDSANGINISPDDKYIYVADILAHEIHVLEK

SEQ ID NO: 41467 - protein, 17 aa, Homo sapiens
YIYVADILAHEIHVLEK

SEQ ID NO: 41468 - protein, 12 aa, Homo sapiens
EACLSILGHFPR

SEQ ID NO: 41469 - protein, 19 aa, Homo sapiens
EDFLQLHEDWHYCGPQESK

SEQ ID NO: 41470 - protein, 22 aa, Homo sapiens
ITDQEASENHVAATGSHLCVLR

SEQ ID NO: 41471 - protein, 10 aa, Homo sapiens
KPDSVSLHCR

SEQ ID NO: 41472 - protein, 17 aa, Homo sapiens
KTHQPSDEVGTSIEHPR

SEQ ID NO: 41473 - protein, 21 aa, Homo sapiens
LGTLAPFCCPWEQLTQDWESR

SEQ ID NO: 41474 - protein, 9 aa, Homo sapiens
RLSNGSIDS

SEQ ID NO: 41475 - protein, 13 aa, Homo sapiens
DLECVTNLQEVAR

SEQ ID NO: 41476 - protein, 14 aa, Homo sapiens
DTVVVQDLGNIFTR

SEQ ID NO: 41477 - protein, 11 aa, Homo sapiens
EFSHIAFLTIK

SEQ ID NO: 41478 - protein, 30 aa, Homo sapiens
FSYSDDKFYATNDTEVAQSNFEALQDFFRL

SEQ ID NO: 41479 - protein, 11 aa, Homo sapiens
HLHYWFVESQK

SEQ ID NO: 41480 - protein, 14 aa, Homo sapiens
LWSSLQTHCCSQNK

SEQ ID NO: 41481 - protein, 23 aa, Homo sapiens
RMDPPCTNTTAASTYLNNPYVRK

SEQ ID NO: 41482 - protein, 13 aa, Homo sapiens
YGDSGEQIAGFVK

SEQ ID NO: 41483 - protein, 8 aa, Homo sapiens
ADEGISFR

SEQ ID NO: 41484 - protein, 11 aa, Homo sapiens
ATAVMPDGQFK

SEQ ID NO: 41485 - protein, 8 aa, Homo sapiens
DISLSDYK

SEQ ID NO: 41486 - protein, 11 aa, Homo sapiens
FCHLAWVNTPK

SEQ ID NO: 41487 - protein, 21 aa, Homo sapiens
GEVCPAGWKPGSDTIKPDVQK

SEQ ID NO: 41488 - protein, 8 aa, Homo sapiens
GLFIIDDK

SEQ ID NO: 41489 - protein, 12 aa, Homo sapiens
GLFIIDDKGILR

SEQ ID NO: 41490 - protein, 10 aa, Homo sapiens
HGEVCPAGWK

SEQ ID NO: 41491 - protein, 22 aa, Homo sapiens
HGEVCPAGWKPGSDTIKPDVQK

SEQ ID NO: 41492 - protein, 19 aa, Homo sapiens
IGASVDSHFCHLAWVNTPK

SEQ ID NO: 41493 - protein, 9 aa, Homo sapiens
IGHPAPNFK

SEQ ID NO: 41494 - protein, 25 aa, Homo sapiens
KLNCQVIGASVDSHFCHLAWVNTPK

SEQ ID NO: 41495 - protein, 13 aa, Homo sapiens
KPGSDTIKPDVQK

SEQ ID NO: 41496 - protein, 17 aa, Homo sapiens
KQGGLGPMNIPLVSDPK

SEQ ID NO: 41497 - protein, 18 aa, Homo sapiens
KQGGLGPMNIPLVSDPKR

SEQ ID NO: 41498 - protein, 16 aa, Homo sapiens
LNCQVIGASVDSHFCH

SEQ ID NO: 41499 - protein, 24 aa, Homo sapiens
LNCQVIGASVDSHFCHLAWVNTPK

SEQ ID NO: 41500 - protein, 10 aa, Homo sapiens
LVQAFQFTDK

SEQ ID NO: 41501 - protein, 16 aa, Homo sapiens
QGGLGPMNIPLVSDPK

SEQ ID NO: 41502 - protein, 11 aa, Homo sapiens
QITVNDLPVGR

SEQ ID NO: 41503 - protein, 21 aa, Homo sapiens
QVIGASVDSHFCHLAWVNTPK

SEQ ID NO: 41504 - protein, 7 aa, Homo sapiens
SVDETLR

SEQ ID NO: 41505 - protein, 16 aa, Homo sapiens
SVDSHFCHLAWVNTPK

SEQ ID NO: 41506 - protein, 10 aa, Homo sapiens
TIAQDYGVLK

SEQ ID NO: 41507 - protein, 25 aa, Homo sapiens
YVVFFFYPLDFTFVCPTEIIAFSDR

SEQ ID NO: 41508 - protein, 24 aa, Homo sapiens
AFQYVETHGEVCPANWTPDSPTIK

SEQ ID NO: 41509 - protein, 31 aa, Homo sapiens
AFQYVETHGEVCPANWTPDSPTIKPSPAASK

SEQ ID NO: 41510 - protein, 30 aa, Homo sapiens
ANEFHDVNCEVVAVSVDSHFSHLAWINTPR

SEQ ID NO: 41511 - protein, 8 aa, Homo sapiens
DLSLDDFK

SEQ ID NO: 41512 - protein, 20 aa, Homo sapiens
FYPLDFTFVCPTEIVAFSDK

SEQ ID NO: 41513 - protein, 11 aa, Homo sapiens
HLSVNDLPVGR

SEQ ID NO: 41514 - protein, 17 aa, Homo sapiens
NGGLGHMNIALLSDLTK

SEQ ID NO: 41515 - protein, 19 aa, Homo sapiens
STSSSCHAPAVTQHAPYFK

SEQ ID NO: 41516 - protein, 25 aa, Homo sapiens
YLVLFFYPLDFTFVCPTEIVAFSDK

SEQ ID NO: 41517 - protein, 12 aa, Homo sapiens
RCPLDALNTTKP

SEQ ID NO: 41518 - protein, 31 aa, Homo sapiens
RISLSDMPRSPMSTNSSVHTGSDVEQDAEKK

SEQ ID NO: 41519 - protein, 14 aa, Homo sapiens
GSFGKVMLAELKGK

SEQ ID NO: 41520 - protein, 11 aa, Homo sapiens
RLGLDEFNFIK

SEQ ID NO: 41521 - protein, 11 aa, Homo sapiens
AALSALESFLK

SEQ ID NO: 41522 - protein, 29 aa, Homo sapiens
AGLLHNILPSQSTDLHHSVGTELLSLVYK

SEQ ID NO: 41523 - protein, 36 aa, Homo sapiens
AHTNVELKKAALSALESFLKQVSNMVAKNAEMHKNK

SEQ ID NO: 41524 - protein, 12 aa, Homo sapiens
APPCEYKDWLTK

SEQ ID NO: 41525 - protein, 17 aa, Homo sapiens
ATQQQHDFTLTQTADGR

SEQ ID NO: 41526 - protein, 19 aa, Homo sapiens
AVAFFLESIAMHDIIAAEK

SEQ ID NO: 41527 - protein, 13 aa, Homo sapiens
DFSAFINLVEFCR

SEQ ID NO: 41528 - protein, 18 aa, Homo sapiens
DFWELASLDCYNHLAEWK

SEQ ID NO: 41529 - protein, 15 aa, Homo sapiens
DPESETDNDSQEIFK

SEQ ID NO: 41530 - protein, 19 aa, Homo sapiens
DVLIQGLIDENPGLQLIIR

SEQ ID NO: 41531 - protein, 36 aa, Homo sapiens
DVLKEEGVSFLINTFEGGGCGQPSGILAQPTLLYLR

SEQ ID NO: 41532 - protein, 32 aa, Homo sapiens
EEGVSFLINTFEGGGCGQPSGILAQPTLLYLR

SEQ ID NO: 41533 - protein, 18 aa, Homo sapiens
ELLNPVVEFVSHPSTTCR

SEQ ID NO: 41534 - protein, 14 aa, Homo sapiens
EMKPVIFLDVFLPR

SEQ ID NO: 41535 - protein, 30 aa, Homo sapiens
EQMYNILMWIHDNYRDPESETDNDSQEIFK

SEQ ID NO: 41536 - protein, 15 aa, Homo sapiens
EQQHVMEELFQSSFR

SEQ ID NO: 41537 - protein, 10 aa, Homo sapiens
ESKVPADLLK

SEQ ID NO: 41538 - protein, 26 aa, Homo sapiens
FESQDTVALLEAILDGIVDPVDSTLR

SEQ ID NO: 41539 - protein, 15 aa, Homo sapiens
GFPPSASLCLLDLVK

SEQ ID NO: 41540 - protein, 25 aa, Homo sapiens
GLGQECVLSSSPAVLALQTSLVFSR

SEQ ID NO: 41541 - protein, 11 aa, Homo sapiens
GLSSLLCNFTK

SEQ ID NO: 41542 - protein, 18 aa, Homo sapiens
GSCVTQVGLLESVYEMFR

SEQ ID NO: 41543 - protein, 14 aa, Homo sapiens
HSSLITPLQAVAQR

SEQ ID NO: 41544 - protein, 10 aa, Homo sapiens
ICSKPVVLPK

SEQ ID NO: 41545 - protein, 20 aa, Homo sapiens
IIANALSSEPACLAEIEEDK

SEQ ID NO: 41546 - protein, 22 aa, Homo sapiens
IIANALSSEPACLAEIEEDKAR

SEQ ID NO: 41547 - protein, 18 aa, Homo sapiens
INQVFHGSCITEGNELTK

SEQ ID NO: 41548 - protein, 23 aa, Homo sapiens
ITAQSIEELCAVNLYGPDAQVDR

SEQ ID NO: 41549 - protein, 27 aa, Homo sapiens
KFESQDTVALLEAILDGIVDPVDSTLR

SEQ ID NO: 41550 - protein, 14 aa, Homo sapiens
KNILEESLCELVAK

SEQ ID NO: 41551 - protein, 13 aa, Homo sapiens
KQNNFSLAMKLLK

SEQ ID NO: 41552 - protein, 9 aa, Homo sapiens
LAAVVSACK

SEQ ID NO: 41553 - protein, 10 aa, Homo sapiens
LACDVDQVTR

SEQ ID NO: 41554 - protein, 20 aa, Homo sapiens
LAGANPAVITCDELLLGHEK

SEQ ID NO: 41555 - protein, 25 aa, Homo sapiens
LDQGGVIQDFINALDQLSNPELLFK

SEQ ID NO: 41556 - protein, 14 aa, Homo sapiens
LGLIEWLENTVTLK

SEQ ID NO: 41557 - protein, 25 aa, Homo sapiens
LGLSYTPLAEVGLNALEEWSIYIDR

SEQ ID NO: 41558 - protein, 9 aa, Homo sapiens
LPVLAGCLK

SEQ ID NO: 41559 - protein, 19 aa, Homo sapiens
LQSVQALTEIQEFISFISK

SEQ ID NO: 41560 - protein, 21 aa, Homo sapiens
LTPLPEDNSMNVDQDGDPSDR

SEQ ID NO: 41561 - protein, 13 aa, Homo sapiens
NCISTVVHQGLIR

SEQ ID NO: 41562 - protein, 13 aa, Homo sapiens
NILEESLCELVAK

SEQ ID NO: 41563 - protein, 12 aa, Homo sapiens
NLLIFENLIDLK

SEQ ID NO: 41564 - protein, 9 aa, Homo sapiens
NTCTSVYTK

SEQ ID NO: 41565 - protein, 31 aa, Homo sapiens
QDWVDGEPTEAEKDFWELASLDCYNHLAEWK

SEQ ID NO: 41566 - protein, 12 aa, Homo sapiens
RAVFRHNLEIIK

SEQ ID NO: 41567 - protein, 27 aa, Homo sapiens
SKLDQGGVIQDFINALDQLSNPELLFK

SEQ ID NO: 41568 - protein, 20 aa, Homo sapiens
SLEYCSTASIDSENPPDLNK

SEQ ID NO: 41569 - protein, 17 aa, Homo sapiens
SLGTIQQCCDAIDHLCR

SEQ ID NO: 41570 - protein, 30 aa, Homo sapiens
SSFDWLTGSSTDPLVDHTSPSSDSLLFAHK

SEQ ID NO: 41571 - protein, 15 aa, Homo sapiens
TRDDWLVSWVQSYCR

SEQ ID NO: 41572 - protein, 8 aa, Homo sapiens
VCLDIIYK

SEQ ID NO: 41573 - protein, 25 aa, Homo sapiens
VYELLGLLGEVHPSEMINNAENLFR

SEQ ID NO: 41574 - protein, 27 aa, Homo sapiens
CIVMVPQWGTHQTVHLPGQLPQHEYLK

SEQ ID NO: 41575 - protein, 17 aa, Homo sapiens
DINLQDEDWNEFNDINK

SEQ ID NO: 41576 - protein, 24 aa, Homo sapiens
EVGIEFMDLYSHLVPVYDVEPLEK

SEQ ID NO: 41577 - protein, 10 aa, Homo sapiens
QNPFWWTHQR

SEQ ID NO: 41578 - protein, 20 aa, Homo sapiens
TDMIQALGGVEGILEHTLFK

SEQ ID NO: 41579 - protein, 21 aa, Homo sapiens
TEDPDLPAFYFDPLINPISHR

SEQ ID NO: 41580 - protein, 20 aa, Homo sapiens
TTITEPHHIWPTLTDEEWIK

SEQ ID NO: 41581 - protein, 19 aa, Homo sapiens
YLTEHPDPNNENIVGYNNK

SEQ ID NO: 41582 - protein, 10 aa, Homo sapiens
AQSELAAHQK

SEQ ID NO: 41583 - protein, 22 aa, Homo sapiens
DLEFTIYDDDDVSPFLEGLEER

SEQ ID NO: 41584 - protein, 25 aa, Homo sapiens
DLEFTIYDDDDVSPFLEGLEERPQR

SEQ ID NO: 41585 - protein, 12 aa, Homo sapiens
ETLPAEQDLTTK

SEQ ID NO: 41586 - protein, 15 aa, Homo sapiens
HMSEFMECNLNELVK

SEQ ID NO: 41587 - protein, 12 aa, Homo sapiens
IHQIEYAMEAVK

SEQ ID NO: 41588 - protein, 20 aa, Homo sapiens
ILHVDNHIGISIAGLTADAR

SEQ ID NO: 41589 - protein, 8 aa, Homo sapiens
LVSLIGSK

SEQ ID NO: 41590 - protein, 15 aa, Homo sapiens
NQYDNDVTVWSPQGR

SEQ ID NO: 41591 - protein, 9 aa, Homo sapiens
NVSIGIVGK

SEQ ID NO: 41592 - protein, 9 aa, Homo sapiens
QGSATVGLK

SEQ ID NO: 41593 - protein, 32 aa, Homo sapiens
RPYGVGLLIAGYDDMGPHIFQTCPSANYFDCR

SEQ ID NO: 41594 - protein, 10 aa, Homo sapiens
SQSARTYLER

SEQ ID NO: 41595 - protein, 9 aa, Homo sapiens
THAVLVALK

SEQ ID NO: 41596 - protein, 22 aa, Homo sapiens
DVPGFLQQSQSSGPGQPAVWHR

SEQ ID NO: 41597 - protein, 22 aa, Homo sapiens
ETIEDVEEMLNNLPGVTSVHSR

SEQ ID NO: 41598 - protein, 9 aa, Homo sapiens
LEFWCTDVK

SEQ ID NO: 41599 - protein, 26 aa, Homo sapiens
LWHQLTLQVLDFVQDPCFAQGDGLIK

SEQ ID NO: 41600 - protein, 15 aa, Homo sapiens
VNPLSLVEIILHVVR

SEQ ID NO: 41601 - protein, 13 aa, Homo sapiens
YYQTIGNHASYYK

SEQ ID NO: 41602 - protein, 22 aa, Homo sapiens
DFLLPFLEEPMDTEADLQFRPR

SEQ ID NO: 41603 - protein, 15 aa, Homo sapiens
ELDTVTLEDIKEHVK

SEQ ID NO: 41604 - protein, 15 aa, Homo sapiens
HDADGQATLLNLLLR

SEQ ID NO: 41605 - protein, 8 aa, Homo sapiens
LNHYVLYK

SEQ ID NO: 41606 - protein, 13 aa, Homo sapiens
NYLHYSLYDQAEK

SEQ ID NO: 41607 - protein, 12 aa, Homo sapiens
APLDIPVPDPVK

SEQ ID NO: 41608 - protein, 19 aa, Homo sapiens
DVIEQLNLVTTWLQLQIPR

SEQ ID NO: 41609 - protein, 23 aa, Homo sapiens
KISELDAFLKEPALNEANLSNLK

SEQ ID NO: 41610 - protein, 10 aa, Homo sapiens
LEGFHTQISK

SEQ ID NO: 41611 - protein, 12 aa, Homo sapiens
NAYAVLYDIILK

SEQ ID NO: 41612 - protein, 12 aa, Homo sapiens
QLVHELDEAEYR

SEQ ID NO: 41613 - protein, 11 aa, Homo sapiens
VFELMTSLHTK

SEQ ID NO: 41614 - protein, 29 aa, Homo sapiens
KPPRPGAPGHLGSLASLSSPADSYNEGVK

SEQ ID NO: 41615 - protein, 26 aa, Homo sapiens
MADLIDGYCRLVNGTSQSFIIRPQKE

SEQ ID NO: 41616 - protein, 7 aa, Homo sapiens
QFANLNR

SEQ ID NO: 41617 - protein, 11 aa, Homo sapiens
LTKPKPQAESK

SEQ ID NO: 41618 - protein, 18 aa, Homo sapiens
KSSINFTVNCSWFSDTNG

SEQ ID NO: 41619 - protein, 15 aa, Homo sapiens
ATISHVSPDSLYLFR

SEQ ID NO: 41620 - protein, 13 aa, Homo sapiens
DNSALDPIIHGLK

SEQ ID NO: 41621 - protein, 10 aa, Homo sapiens
ETFLDPFVLR

SEQ ID NO: 41622 - protein, 13 aa, Homo sapiens
HQSPIDILDQYAR

SEQ ID NO: 41623 - protein, 18 aa, Homo sapiens
KNRNSSVVPSERARVGLA

SEQ ID NO: 41624 - protein, 23 aa, Homo sapiens
KVEFHWGHSNGSAGSEHSINGRR

SEQ ID NO: 41625 - protein, 17 aa, Homo sapiens
RSDFSQTMLFQANTTRI

SEQ ID NO: 41626 - protein, 22 aa, Homo sapiens
RVGEEYQELQLDGFDNESSNKT

SEQ ID NO: 41627 - protein, 15 aa, Homo sapiens
SDFSQTMLFQANTTR

SEQ ID NO: 41628 - protein, 25 aa, Homo sapiens
SGVTHAAEERNQTEPSPTPSSPNRT

SEQ ID NO: 41629 - protein, 18 aa, Homo sapiens
GAPISAYQIVVEELHPHR

SEQ ID NO: 41630 - protein, 20 aa, Homo sapiens
KAPQHVVNHLPPYTNVSLKM

SEQ ID NO: 41631 - protein, 18 aa, Homo sapiens
KGPLANPIWNVTGFTGRD

SEQ ID NO: 41632 - protein, 24 aa, Homo sapiens
LWNSTHHVFMHLHPGTTYQFFIRA

SEQ ID NO: 41633 - protein, 16 aa, Homo sapiens
RIAVDWESLGYNITRC

SEQ ID NO: 41634 - protein, 23 aa, Homo sapiens
RLGDVEVNAGQNATFQCIATGRD

SEQ ID NO: 41635 - protein, 27 aa, Homo sapiens
SYADQSTLHAEDPLSITFMDQHNFSPR

SEQ ID NO: 41636 - protein, 20 aa, Homo sapiens
YLCEGTESPYQTGQLHPAIR

SEQ ID NO: 41637 - protein, 23 aa, Homo sapiens
IWCEDFLVRSFYLKNLQTNETRT

SEQ ID NO: 41638 - protein, 24 aa, Homo sapiens
KAENSHSHSDYINASPIMDHDPRN

SEQ ID NO: 41639 - protein, 22 aa, Homo sapiens
KSEHPESSLSSEEETAGVENVK

SEQ ID NO: 41640 - protein, 15 aa, Homo sapiens
LSATLGGLLQDHGSR

SEQ ID NO: 41641 - protein, 12 aa, Homo sapiens
KKQINDSANLRE

SEQ ID NO: 41642 - protein, 16 aa, Homo sapiens
DFGPIDPECTCPTCQK

SEQ ID NO: 41643 - protein, 16 aa, Homo sapiens
DVPGFAIGGLSGGESK

SEQ ID NO: 41644 - protein, 20 aa, Homo sapiens
ICLGNTYHLGLRPGPELIQK

SEQ ID NO: 41645 - protein, 11 aa, Homo sapiens
AFLTLAEDILR

SEQ ID NO: 41646 - protein, 12 aa, Homo sapiens
NIDEHANEDVER

SEQ ID NO: 41647 - protein, 19 aa, Homo sapiens
MHSSNFSSSNGSTEDLFRD

SEQ ID NO: 41648 - protein, 20 aa, Homo sapiens
AIGTEPDSDVLSEIMHSFAK

SEQ ID NO: 41649 - protein, 17 aa, Homo sapiens
ATAAFILANEHNVALFK

SEQ ID NO: 41650 - protein, 31 aa, Homo sapiens
EEAVQTFNYLCDLIESNHPIVLGPNNTNLPK

SEQ ID NO: 41651 - protein, 15 aa, Homo sapiens
ENVNATENCISAVGK

SEQ ID NO: 41652 - protein, 14 aa, Homo sapiens
FLFDSVSSQNVGLR

SEQ ID NO: 41653 - protein, 18 aa, Homo sapiens
GPEYLTQMWHFMCDALIK

SEQ ID NO: 41654 - protein, 26 aa, Homo sapiens
HFADLLPGFLQAVNDSCYQNDDSVLK

SEQ ID NO: 41655 - protein, 9 aa, Homo sapiens
HIVENAVQK

SEQ ID NO: 41656 - protein, 9 aa, Homo sapiens
HLHSIMVLK

SEQ ID NO: 41657 - protein, 22 aa, Homo sapiens
LLSSAFDEVYPALPSDVQTAIK

SEQ ID NO: 41658 - protein, 20 aa, Homo sapiens
LVLEQVVTSIASVADTAEEK

SEQ ID NO: 41659 - protein, 20 aa, Homo sapiens
QWGLCIFDDVIEHCSPASFK

SEQ ID NO: 41660 - protein, 14 aa, Homo sapiens
TIECISLIGLAVGK

SEQ ID NO: 41661 - protein, 17 aa, Homo sapiens
TKENVNATENCISAVGK

SEQ ID NO: 41662 - protein, 18 aa, Homo sapiens
VQAHAAAALINFTEDCPK

SEQ ID NO: 41663 - protein, 13 aa, Homo sapiens
VSDILHSIFSSYK

SEQ ID NO: 41664 - protein, 34 aa, Homo sapiens
EGYGLSWNPNLSGHLLSASDDHTICLWDISAVPK

SEQ ID NO: 41665 - protein, 16 aa, Homo sapiens
HPSKPDPSGECNPDLR

SEQ ID NO: 41666 - protein, 27 aa, Homo sapiens
IGEEQSPEDAEDGPPELLFIHGGHTAK

SEQ ID NO: 41667 - protein, 31 aa, Homo sapiens
LHSFESHKDEIFQVQWSPHNETILASSGTDR

SEQ ID NO: 41668 - protein, 33 aa, Homo sapiens
NTPFLYDLVMTHALEWPSLTAQWLPDVTRPEGK

SEQ ID NO: 41669 - protein, 32 aa, Homo sapiens
PSHSVDAHTAEVNCLSFNPYSEFILATGSADK

SEQ ID NO: 41670 - protein, 14 aa, Homo sapiens
SKPDPSGECNPDLR

SEQ ID NO: 41671 - protein, 24 aa, Homo sapiens
TAEVNCLSFNPYSEFILATGSADK

SEQ ID NO: 41672 - protein, 31 aa, Homo sapiens
TIFTGHTAVVEDVSWHLLHESLFGSVADDQK

SEQ ID NO: 41673 - protein, 27 aa, Homo sapiens
KKPALVSIPEDVVQAEAGGMHTVCLSK

SEQ ID NO: 41674 - protein, 17 aa, Homo sapiens
SGQVYSFGCNDEGALGR

SEQ ID NO: 41675 - protein, 29 aa, Homo sapiens
SHSTEPGLVLTLGQGDVGQLGLGENVMER

SEQ ID NO: 41676 - protein, 20 aa, Homo sapiens
SWVGFSGGQHHTVCMDSEGK

SEQ ID NO: 41677 - protein, 17 aa, Homo sapiens
VVLSVSSGGQHTVLLVK

SEQ ID NO: 41678 - protein, 12 aa, Homo sapiens
MDGNDSDYDPKK

SEQ ID NO: 41679 - protein, 15 aa, Homo sapiens
KGTNSSASSNFRCRS

SEQ ID NO: 41680 - protein, 34 aa, Homo sapiens
KLEWMNNGYSGVGNSSVSGHGILPSYQELVEDRF

SEQ ID NO: 41681 - protein, 16 aa, Homo sapiens
RGLGMNNLPSNYTARM

SEQ ID NO: 41682 - protein, 21 aa, Homo sapiens
FSGISGCSDGVSQEGSASSTK

SEQ ID NO: 41683 - protein, 17 aa, Homo sapiens
INEALITTILHLLNHPK

SEQ ID NO: 41684 - protein, 21 aa, Homo sapiens
LPLPVVTEEFIEALLSVDPGR

SEQ ID NO: 41685 - protein, 13 aa, Homo sapiens
MRKLGHLNNFTKL

SEQ ID NO: 41686 - protein, 7 aa, Homo sapiens
NHLSLSK

SEQ ID NO: 41687 - protein, 37 aa, Homo sapiens
RSMPEASDQEEHLSPLDFLHSANFSLGSINQRLNKRE

SEQ ID NO: 41688 - protein, 9 aa, Homo sapiens
DLCGIVASK

SEQ ID NO: 41689 - protein, 10 aa, Homo sapiens
DSPCQLEALK

SEQ ID NO: 41690 - protein, 14 aa, Homo sapiens
ELCQGLGQPGSVLR

SEQ ID NO: 41691 - protein, 22 aa, Homo sapiens
ELDLSNNCLGDAGILQLVESVR

SEQ ID NO: 41692 - protein, 15 aa, Homo sapiens
ELTVSNNDINEAGVR

SEQ ID NO: 41693 - protein, 12 aa, Homo sapiens
LESCGVTSDNCR

SEQ ID NO: 41694 - protein, 19 aa, Homo sapiens
LGDVGMAELCPGLLHPSSR

SEQ ID NO: 41695 - protein, 19 aa, Homo sapiens
LLCETLLEPGCQLESLWVK

SEQ ID NO: 41696 - protein, 21 aa, Homo sapiens
LQLEYCSLSAASCEPLASVLR

SEQ ID NO: 41697 - protein, 24 aa, Homo sapiens
LSDNLLGDAGLQLLCEGLLDPQCR

SEQ ID NO: 41698 - protein, 21 aa, Homo sapiens
LSLQNCCLTGAGCGVLSSTLR

SEQ ID NO: 41699 - protein, 23 aa, Homo sapiens
QPGCLLEQLVLYDIYWSEEMEDR

SEQ ID NO: 41700 - protein, 20 aa, Homo sapiens
SCSFTAACCSHFSSVLAQNR

SEQ ID NO: 41701 - protein, 22 aa, Homo sapiens
SNELGDVGVHCVLQGLQTPSCK

SEQ ID NO: 41702 - protein, 16 aa, Homo sapiens
TAACCSHFSSVLAQNR

SEQ ID NO: 41703 - protein, 33 aa, Homo sapiens
TLPTLQELHLSDNLLGDAGLQLLCEGLLDPQCR

SEQ ID NO: 41704 - protein, 12 aa, Homo sapiens
TLWIWECGITAK

SEQ ID NO: 41705 - protein, 28 aa, Homo sapiens
VLWLADCDVSDSSCSSLAATLLANHSLR

SEQ ID NO: 41706 - protein, 15 aa, Homo sapiens
WAELLPLLQQCQVVR

SEQ ID NO: 41707 - protein, 12 aa, Homo sapiens
AFFPCFDTPAVK

SEQ ID NO: 41708 - protein, 11 aa, Homo sapiens
AIEAVAISPWK

SEQ ID NO: 41709 - protein, 25 aa, Homo sapiens
ETFASTASQLHSNVVNYVQQIVAPK

SEQ ID NO: 41710 - protein, 23 aa, Homo sapiens
GFCFVSYLAHLVGDQDQFDSFLK

SEQ ID NO: 41711 - protein, 18 aa, Homo sapiens
IEPGVDPDDTYNETPYEK

SEQ ID NO: 41712 - protein, 15 aa, Homo sapiens
KKPFVYTQGQAVLNR

SEQ ID NO: 41713 - protein, 15 aa, Homo sapiens
LDSHPCLEVTAAALR

SEQ ID NO: 41714 - protein, 14 aa, Homo sapiens
MASGEHSPGSGAAR

SEQ ID NO: 41715 - protein, 18 aa, Homo sapiens
RPLHSAQAVDVASASNFR

SEQ ID NO: 41716 - protein, 12 aa, Homo sapiens
RVDIIPGFEFDR

SEQ ID NO: 41717 - protein, 16 aa, Homo sapiens
SHYGQALCVSFPQPCR

SEQ ID NO: 41718 - protein, 19 aa, Homo sapiens
SILADDFLDFYLEYFPELK

SEQ ID NO: 41719 - protein, 10 aa, Homo sapiens
TYQLVYFLDK

SEQ ID NO: 41720 - protein, 18 aa, Homo sapiens
VGEGPGVCWLAPEQTAGK

SEQ ID NO: 41721 - protein, 21 aa, Homo sapiens
YTLPLYHAMMGGSEVAQTLAK

SEQ ID NO: 41722 - protein, 13 aa, Homo sapiens
AVDIPHMDIEALK

SEQ ID NO: 41723 - protein, 14 aa, Homo sapiens
AVDIPHMDIEALKK

SEQ ID NO: 41724 - protein, 14 aa, Homo sapiens
FPSLLTHNENMVAK

SEQ ID NO: 41725 - protein, 16 aa, Homo sapiens
FSVCVLGDQQHCDEAK

SEQ ID NO: 41726 - protein, 13 aa, Homo sapiens
KYDAFLASESLIK

SEQ ID NO: 41727 - protein, 9 aa, Homo sapiens
HMYHSLYLK

SEQ ID NO: 41728 - protein, 8 aa, Homo sapiens
ILMEHIHK

SEQ ID NO: 41729 - protein, 17 aa, Homo sapiens
VWLDPNETNEIANANSR

SEQ ID NO: 41730 - protein, 13 aa, Homo sapiens
AGNLGGGVVTIER

SEQ ID NO: 41731 - protein, 26 aa, Homo sapiens
FTLDCTHPVEDGIMDAANFEQFLQER

SEQ ID NO: 41732 - protein, 13 aa, Homo sapiens
AITGASLADIMAK

SEQ ID NO: 41733 - protein, 10 aa, Homo sapiens
VELCSFSGYK

SEQ ID NO: 41734 - protein, 8 aa, Homo sapiens
VFQFLNAK

SEQ ID NO: 41735 - protein, 12 aa, Homo sapiens
IEEIKDFLLTAR

SEQ ID NO: 41736 - protein, 13 aa, Homo sapiens
KIEEIKDFLLTAR

SEQ ID NO: 41737 - protein, 12 aa, Homo sapiens
YLYTLVITDKEK

SEQ ID NO: 41738 - protein, 15 aa, Homo sapiens
ASITPGTILIILTGR

SEQ ID NO: 41739 - protein, 8 aa, Homo sapiens
FVIATSTK

SEQ ID NO: 41740 - protein, 8 aa, Homo sapiens
HLTDAYFK

SEQ ID NO: 41741 - protein, 8 aa, Homo sapiens
KPFSQHVR

SEQ ID NO: 41742 - protein, 17 aa, Homo sapiens
QLASGLLLVTGPLVLNR

SEQ ID NO: 41743 - protein, 13 aa, Homo sapiens
VLATVTKPVGGDK

SEQ ID NO: 41744 - protein, 18 aa, Homo sapiens
VLATVTKPVGGDKNGGTR

SEQ ID NO: 41745 - protein, 9 aa, Homo sapiens
YYPTEDVPR

SEQ ID NO: 41746 - protein, 13 aa, Homo sapiens
AGVNTVTTLVENK

SEQ ID NO: 41747 - protein, 14 aa, Homo sapiens
AGVNTVTTLVENKK

SEQ ID NO: 41748 - protein, 24 aa, Homo sapiens
AQLVVIAHDVDPIELVVFLPALCR

SEQ ID NO: 41749 - protein, 10 aa, Homo sapiens
HWGGNVLGPK

SEQ ID NO: 41750 - protein, 16 aa, Homo sapiens
KTCTTVAFTQVNSEDK

SEQ ID NO: 41751 - protein, 16 aa, Homo sapiens
LKVPPAINQFTQALDR

SEQ ID NO: 41752 - protein, 15 aa, Homo sapiens
TCTTVAFTQVNSEDK

SEQ ID NO: 41753 - protein, 17 aa, Homo sapiens
TCTTVAFTQVNSEDKGA

SEQ ID NO: 41754 - protein, 20 aa, Homo sapiens
TCTTVAFTQVNSEDKGALAK

SEQ ID NO: 41755 - protein, 9 aa, Homo sapiens
VAPAPAVVK

SEQ ID NO: 41756 - protein, 14 aa, Homo sapiens
VPPAINQFTQALDR

SEQ ID NO: 41757 - protein, 31 aa, Homo sapiens
AFLADPSAFVAAAPVAAATTAAPAAAAAPAK

SEQ ID NO: 41758 - protein, 22 aa, Homo sapiens
AGAIAPCEVTVPAQNTGLGPEK

SEQ ID NO: 41759 - protein, 7 aa, Homo sapiens
AVVLMGK

SEQ ID NO: 41760 - protein, 12 aa, Homo sapiens
CFIVGADNVGSK

SEQ ID NO: 41761 - protein, 29 aa, Homo sapiens
GLVIQQVFDNGSIYNPEVLDITEETLHSR

SEQ ID NO: 41762 - protein, 10 aa, Homo sapiens
IIQLLDDYPK

SEQ ID NO: 41763 - protein, 29 aa, Homo sapiens
LADPSAFVAAAPVAAATTAAPAAAAAPAK

SEQ ID NO: 41764 - protein, 19 aa, Homo sapiens
NVASVCLQIGYPTVASVPH

SEQ ID NO: 41765 - protein, 26 aa, Homo sapiens
NVASVCLQIGYPTVASVPHSIINGYK

SEQ ID NO: 41766 - protein, 17 aa, Homo sapiens
PCEVTVPAQNTGLGPEK

SEQ ID NO: 41767 - protein, 31 aa, Homo sapiens
SFGLVIQQVFDNGSIYNPEVLDITEETLHSR

SEQ ID NO: 41768 - protein, 12 aa, Homo sapiens
TSFFQALGITTK

SEQ ID NO: 41769 - protein, 17 aa, Homo sapiens
VLALSVETDYTFPLAEK

SEQ ID NO: 41770 - protein, 22 aa, Homo sapiens
DNYVPEVSALDQEIIEVDPDTK

SEQ ID NO: 41771 - protein, 9 aa, Homo sapiens
LGNDFHTNK

SEQ ID NO: 41772 - protein, 10 aa, Homo sapiens
LGNDFHTNKR

SEQ ID NO: 41773 - protein, 22 aa, Homo sapiens
LLDFGSLSNLQVTQPTVGMNFK

SEQ ID NO: 41774 - protein, 18 aa, Homo sapiens
PEVSALDQEIIEVDPDTK

SEQ ID NO: 41775 - protein, 23 aa, Homo sapiens
RDNYVPEVSALDQEIIEVDPDTK

SEQ ID NO: 41776 - protein, 17 aa, Homo sapiens
AFVAIGDYNGHVGLGVK

SEQ ID NO: 41777 - protein, 14 aa, Homo sapiens
ESEIIDFFLGASLK

SEQ ID NO: 41778 - protein, 19 aa, Homo sapiens
ESEIIDFFLGASLKDEVLK

SEQ ID NO: 41779 - protein, 11 aa, Homo sapiens
GCTATLGNFAK

SEQ ID NO: 41780 - protein, 11 aa, Homo sapiens
GTGIVSAPVPK

SEQ ID NO: 41781 - protein, 10 aa, Homo sapiens
IGKPHTVPCK

SEQ ID NO: 41782 - protein, 13 aa, Homo sapiens
SLEEIYLFSLPIK

SEQ ID NO: 41783 - protein, 12 aa, Homo sapiens
SPYQEFTDHLVK

SEQ ID NO: 41784 - protein, 10 aa, Homo sapiens
ECLPLIIFLR

SEQ ID NO: 41785 - protein, 13 aa, Homo sapiens
ERHPGSFDVVHVK

SEQ ID NO: 41786 - protein, 17 aa, Homo sapiens
FDTGNLCMVTGGANLGR

SEQ ID NO: 41787 - protein, 11 aa, Homo sapiens
GIPHLVTHDAR

SEQ ID NO: 41788 - protein, 10 aa, Homo sapiens
GNKPWISLPR

SEQ ID NO: 41789 - protein, 9 aa, Homo sapiens
GSFDVVHVK

SEQ ID NO: 41790 - protein, 11 aa, Homo sapiens
HPGSFDVVHVK

SEQ ID NO: 41791 - protein, 6 aa, Homo sapiens
IFVGTK

SEQ ID NO: 41792 - protein, 7 aa, Homo sapiens
KIFVGTK

SEQ ID NO: 41793 - protein, 12 aa, Homo sapiens
LRECLPLIIFLR

SEQ ID NO: 41794 - protein, 9 aa, Homo sapiens
PHLVTHDAR

SEQ ID NO: 41795 - protein, 17 aa, Homo sapiens
TDITYPAGFMDVISIDK

SEQ ID NO: 41796 - protein, 9 aa, Homo sapiens
YALTGDEVK

SEQ ID NO: 41797 - protein, 10 aa, Homo sapiens
YALTGDEVKK

SEQ ID NO: 41798 - protein, 13 aa, Homo sapiens
DALNQATSQVESK

SEQ ID NO: 41799 - protein, 17 aa, Homo sapiens
EAEETQSTLQAECDQYR

SEQ ID NO: 41800 - protein, 13 aa, Homo sapiens
ELCHTQSSHASLR

SEQ ID NO: 41801 - protein, 15 aa, Homo sapiens
HPPAPAEPSSDLASK

SEQ ID NO: 41802 - protein, 13 aa, Homo sapiens
LLATEQEDAAVAK

SEQ ID NO: 41803 - protein, 20 aa, Homo sapiens
KWTPNQLMNGSVGDLDYEKS

SEQ ID NO: 41804 - protein, 16 aa, Homo sapiens
CPLDQAIGLLVAIFHK

SEQ ID NO: 41805 - protein, 25 aa, Homo sapiens
DQEVNFQEYVTFLGALALIYNEALK

SEQ ID NO: 41806 - protein, 26 aa, Homo sapiens
DQEVNFQEYVTFLGALALIYNEALKG

SEQ ID NO: 41807 - protein, 27 aa, Homo sapiens
NKDQEVNFQEYVTFLGALALIYNEALK

SEQ ID NO: 41808 - protein, 28 aa, Homo sapiens
NKDQEVNFQEYVTFLGALALIYNEALKG

SEQ ID NO: 41809 - protein, 15 aa, Homo sapiens
PLDQAIGLLVAIFHK

SEQ ID NO: 41810 - protein, 10 aa, Homo sapiens
ILDILGETCK

SEQ ID NO: 41811 - protein, 15 aa, Homo sapiens
KFDFDACNEVPPAPK

SEQ ID NO: 41812 - protein, 19 aa, Homo sapiens
RKRNVDSSGNKSVLMERLK

SEQ ID NO: 41813 - protein, 25 aa, Homo sapiens
KVARLEQNGSPMGARGRPNGAVAKA

SEQ ID NO: 41814 - protein, 22 aa, Homo sapiens
RSMNPNVSMVSSASSSPSSSRT

SEQ ID NO: 41815 - protein, 17 aa, Homo sapiens
DLDEVLQTHSVFVNVSK

SEQ ID NO: 41816 - protein, 18 aa, Homo sapiens
KEDLISAFGTDDQTEICK

SEQ ID NO: 41817 - protein, 8 aa, Homo sapiens
RFEIACYK

SEQ ID NO: 41818 - protein, 10 aa, Homo sapiens
RPYTVILIER

SEQ ID NO: 41819 - protein, 14 aa, Homo sapiens
RNSNVSQASMSSRM

SEQ ID NO: 41820 - protein, 9 aa, Homo sapiens
EATWVVDVK

SEQ ID NO: 41821 - protein, 8 aa, Homo sapiens
IGGIFAFK

SEQ ID NO: 41822 - protein, 11 aa, Homo sapiens
KLEEEGEQFVK

SEQ ID NO: 41823 - protein, 12 aa, Homo sapiens
KLEEEGEQFVKK

SEQ ID NO: 41824 - protein, 11 aa, Homo sapiens
LEEEGEQFVKK

SEQ ID NO: 41825 - protein, 17 aa, Homo sapiens
ERPDLPPIQYEPVLCSR

SEQ ID NO: 41826 - protein, 17 aa, Homo sapiens
HLLQAPVDDAQEILHSR

SEQ ID NO: 41827 - protein, 29 aa, Homo sapiens
ICGLSPTTTLAIYFEVVNQHNAPIPQGGR

SEQ ID NO: 41828 - protein, 13 aa, Homo sapiens
MVVPVAALFTPLK

SEQ ID NO: 41829 - protein, 29 aa, Homo sapiens
GPQSNYGGPYPAAPTFGSQPGPPQPLPPK

SEQ ID NO: 41830 - protein, 24 aa, Homo sapiens
VDAYDRPELSLGSYEFLATVDYCK

SEQ ID NO: 41831 - protein, 15 aa, Homo sapiens
LSIIGYNTTSTVPKE

SEQ ID NO: 41832 - protein, 18 aa, Homo sapiens
ALALSHLALGAQNHTLQR

SEQ ID NO: 41833 - protein, 12 aa, Homo sapiens
ALGAQNHTLQRL

SEQ ID NO: 41834 - protein, 16 aa, Homo sapiens
ALSHLALGAQNHTLQR

SEQ ID NO: 41835 - protein, 7 aa, Homo sapiens
DFLQSLK

SEQ ID NO: 41836 - protein, 9 aa, Homo sapiens
DPTPEQTHR

SEQ ID NO: 41837 - protein, 19 aa, Homo sapiens
DSFHLDEQFTVPVEMMQAR

SEQ ID NO: 41838 - protein, 14 aa, Homo sapiens
EDFLEQSEQLFGAK

SEQ ID NO: 41839 - protein, 12 aa, Homo sapiens
ELKEQQDSPGNK

SEQ ID NO: 41840 - protein, 19 aa, Homo sapiens
ELKEQQDSPGNKDFLQSLK

SEQ ID NO: 41841 - protein, 23 aa, Homo sapiens
ELKEQQDSPGNKDFLQSLKGFPR

SEQ ID NO: 41842 - protein, 16 aa, Homo sapiens
EQQDSPGNKDFLQSLK

SEQ ID NO: 41843 - protein, 8 aa, Homo sapiens
FDPSLTQR

SEQ ID NO: 41844 - protein, 17 aa, Homo sapiens
FIFEDTTGLPLFVGSVR

SEQ ID NO: 41845 - protein, 10 aa, Homo sapiens
GDKLFGPDLK

SEQ ID NO: 41846 - protein, 16 aa, Homo sapiens
GFPIKEDFLEQSEQLF

SEQ ID NO: 41847 - protein, 19 aa, Homo sapiens
GFPIKEDFLEQSEQLFGAK

SEQ ID NO: 41848 - protein, 26 aa, Homo sapiens
GFPIKEDFLEQSEQLFGAKPVSLTGK

SEQ ID NO: 41849 - protein, 14 aa, Homo sapiens
GFPRGDKLFGPDLK

SEQ ID NO: 41850 - protein, 14 aa, Homo sapiens
GISEQSLVVSGVQH

SEQ ID NO: 41851 - protein, 15 aa, Homo sapiens
GISEQSLVVSGVQHQ

SEQ ID NO: 41852 - protein, 16 aa, Homo sapiens
GISEQSLVVSGVQHQS

SEQ ID NO: 41853 - protein, 37 aa, Homo sapiens
GISEQSLVVSGVQHQSTLELSEVGVEAAAATSIAMSR

SEQ ID NO: 41854 - protein, 18 aa, Homo sapiens
HQMDLVATLSQLGLQELF

SEQ ID NO: 41855 - protein, 24 aa, Homo sapiens
HQMDLVATLSQLGLQELFQAPDLR

SEQ ID NO: 41856 - protein, 16 aa, Homo sapiens
IFEDTTGLPLFVGSVR

SEQ ID NO: 41857 - protein, 18 aa, Homo sapiens
IQEFLSGLPEDTVLLLLN

SEQ ID NO: 41858 - protein, 27 aa, Homo sapiens
IQEFLSGLPEDTVLLLLNAIHFQGFWR

SEQ ID NO: 41859 - protein, 42 aa, Homo sapiens
KNNMSFVVLVPTHFEWNVSQVLANLSWDTLHPPLVWERPTKV

SEQ ID NO: 41860 - protein, 12 aa, Homo sapiens
LALGAQNHTLQR

SEQ ID NO: 41861 - protein, 11 aa, Homo sapiens
LCQDLGPGAFR

SEQ ID NO: 41862 - protein, 19 aa, Homo sapiens
LFFIFEDTTGLPLFVGSVR

SEQ ID NO: 41863 - protein, 7 aa, Homo sapiens
LFGPDLK

SEQ ID NO: 41864 - protein, 23 aa, Homo sapiens
LFGPDLKLVPPMEEDYPQFGSPK

SEQ ID NO: 41865 - protein, 13 aa, Homo sapiens
LGNQEPGGQTALK

SEQ ID NO: 41866 - protein, 15 aa, Homo sapiens
LLEQPEIQVAHFPFK

SEQ ID NO: 41867 - protein, 19 aa, Homo sapiens
LQQVLHAGSGPCLPHLLSR

SEQ ID NO: 41868 - protein, 16 aa, Homo sapiens
LSQLGLQELFQAPDLR

SEQ ID NO: 41869 - protein, 22 aa, Homo sapiens
LSVALALSHLALGAQNHTLQRL

SEQ ID NO: 41870 - protein, 16 aa, Homo sapiens
LVPPMEEDYPQFGSPK

SEQ ID NO: 41871 - protein, 28 aa, Homo sapiens
LYLKHQMDLVATLSQLGLQELFQAPDLR

SEQ ID NO: 41872 - protein, 10 aa, Homo sapiens
MSLSSFSVNR

SEQ ID NO: 41873 - protein, 31 aa, Homo sapiens
MSLSSFSVNRPFLFFIFEDTTGLPLFVGSVR

SEQ ID NO: 41874 - protein, 10 aa, Homo sapiens
NKFDPSLTQR

SEQ ID NO: 41875 - protein, 42 aa, Homo sapiens
NNMSFVVLVPTHFEWNVSQVLANLSWDTLHPPLVWERPTKVR

SEQ ID NO: 41876 - protein, 8 aa, Homo sapiens
NPNPSAPR

SEQ ID NO: 41877 - protein, 12 aa, Homo sapiens
NQEQVSPLTLLK

SEQ ID NO: 41878 - protein, 11 aa, Homo sapiens
PGNKDFLQSLK

SEQ ID NO: 41879 - protein, 22 aa, Homo sapiens
PLSVALALSHLALGAQNHTLQR

SEQ ID NO: 41880 - protein, 14 aa, Homo sapiens
PPMEEDYPQFGSPK

SEQ ID NO: 41881 - protein, 7 aa, Homo sapiens
PVSLTGK

SEQ ID NO: 41882 - protein, 13 aa, Homo sapiens
QEDDLANINQWVK

SEQ ID NO: 41883 - protein, 18 aa, Homo sapiens
QLTSGPNQEQVSPLTLLK

SEQ ID NO: 41884 - protein, 12 aa, Homo sapiens
QPEIQVAHFPFK

SEQ ID NO: 41885 - protein, 14 aa, Homo sapiens
SHLALGAQNHTLQR

SEQ ID NO: 41886 - protein, 8 aa, Homo sapiens
SPPGVCSR

SEQ ID NO: 41887 - protein, 17 aa, Homo sapiens
SPPGVCSRDPTPEQTHR

SEQ ID NO: 41888 - protein, 20 aa, Homo sapiens
SVALALSHLALGAQNHTLQR

SEQ ID NO: 41889 - protein, 25 aa, Homo sapiens
SVNRPFLFFIFEDTTGLPLFVGSVR

SEQ ID NO: 41890 - protein, 22 aa, Homo sapiens
TYPLRWFLLEQPEIQVAHFPFK

SEQ ID NO: 41891 - protein, 33 aa, Homo sapiens
VRLPKLYLKHQMDLVATLSQLGLQELFQAPDLR

SEQ ID NO: 41892 - protein, 16 aa, Homo sapiens
WFLLEQPEIQVAHFPF

SEQ ID NO: 41893 - protein, 17 aa, Homo sapiens
WFLLEQPEIQVAHFPFK

SEQ ID NO: 41894 - protein, 31 aa, Homo sapiens
MQNNWCFPACSFNGTSAQEWFMAQDCPYRKR

SEQ ID NO: 41895 - protein, 28 aa, Homo sapiens
AALDEAQGVGLDSTGYYDQEIYGGSDSR

SEQ ID NO: 41896 - protein, 16 aa, Homo sapiens
AIGPHDVLATLLNNLK

SEQ ID NO: 41897 - protein, 15 aa, Homo sapiens
DDDDYSSSTSLLGQK

SEQ ID NO: 41898 - protein, 25 aa, Homo sapiens
EFGAGPLFNQILPLLMSPTLEDQER

SEQ ID NO: 41899 - protein, 27 aa, Homo sapiens
HAPVALLNDIPQSTEQYDPFAEHRPPK

SEQ ID NO: 41900 - protein, 10 aa, Homo sapiens
ICFELLELLK

SEQ ID NO: 41901 - protein, 14 aa, Homo sapiens
IVDDLKDEAEQYRK

SEQ ID NO: 41902 - protein, 18 aa, Homo sapiens
IWDPTPSHTPAGAATPGR

SEQ ID NO: 41903 - protein, 19 aa, Homo sapiens
IYNSIYIGSQDALIAHYPR

SEQ ID NO: 41904 - protein, 15 aa, Homo sapiens
KLLLKIKNGTPPMRK

SEQ ID NO: 41905 - protein, 31 aa, Homo sapiens
KPGYHAPVALLNDIPQSTEQYDPFAEHRPPK

SEQ ID NO: 41906 - protein, 36 aa, Homo sapiens
LEEQLIDGILYAFQEQTTEDSVMLNGFGTVVNALGK

SEQ ID NO: 41907 - protein, 16 aa, Homo sapiens
LLVDVDESTLSPEEQK

SEQ ID NO: 41908 - protein, 17 aa, Homo sapiens
LSSWDQAETPGHTPSLR

SEQ ID NO: 41909 - protein, 31 aa, Homo sapiens
TISALAIAALAEAATPYGIESFDSVLKPLWK

SEQ ID NO: 41910 - protein, 15 aa, Homo sapiens
VKPYLPQICGTVLWR

SEQ ID NO: 41911 - protein, 13 aa, Homo sapiens
VVNGAAASQPPSK

SEQ ID NO: 41912 - protein, 26 aa, Homo sapiens
ENSTDNPDLWFLHDQNSSAFKFYRKK

SEQ ID NO: 41913 - protein, 14 aa, Homo sapiens
GADQKPTSADCAVR

SEQ ID NO: 41914 - protein, 36 aa, Homo sapiens
SEGSTPADGLPGEAAEDDLAGAPALSQASSGTCFPR

SEQ ID NO: 41915 - protein, 9 aa, Homo sapiens
GHYAYDCHR

SEQ ID NO: 41916 - protein, 14 aa, Homo sapiens
NPPGFAFVEFEDPR

SEQ ID NO: 41917 - protein, 13 aa, Homo sapiens
AALEALGSCLNNK

SEQ ID NO: 41918 - protein, 21 aa, Homo sapiens
GWTGQESLSDSDPEMWELLQR

SEQ ID NO: 41919 - protein, 21 aa, Homo sapiens
GYSLVSGGTDNHLVLVDLRPK

SEQ ID NO: 41920 - protein, 11 aa, Homo sapiens
HADIVTTTTHK

SEQ ID NO: 41921 - protein, 21 aa, Homo sapiens
IMGLDLPDGGHLTHGYMSDVK

SEQ ID NO: 41922 - protein, 26 aa, Homo sapiens
INFAVFPSLQGGPHNHAIAAVAVALK

SEQ ID NO: 41923 - protein, 14 aa, Homo sapiens
ISATSIFFESMPYK

SEQ ID NO: 41924 - protein, 19 aa, Homo sapiens
SGSPANLAVYTALLQPHDR

SEQ ID NO: 41925 - protein, 11 aa, Homo sapiens
VLELVSITANK

SEQ ID NO: 41926 - protein, 17 aa, Homo sapiens
YYGGAEVVDEIELLCQR

SEQ ID NO: 41927 - protein, 12 aa, Homo sapiens
RGTANLSEAIRV

SEQ ID NO: 41928 - protein, 23 aa, Homo sapiens
RESIASYLSLTSEDNTSFDRKKK

SEQ ID NO: 41929 - protein, 21 aa, Homo sapiens
RKGIIDVNLYNETVETLMAGE

SEQ ID NO: 41930 - protein, 27 aa, Homo sapiens
RNPVTSTNVLGMMTAILGVFLYNKTKY

SEQ ID NO: 41931 - protein, 34 aa, Homo sapiens
DVNLSKTEKMGNTVESEHLSELTEEEYEAHYIRR

SEQ ID NO: 41932 - protein, 19 aa, Homo sapiens
TLAGLVVQLLQFQEDAFGK

SEQ ID NO: 41933 - protein, 15 aa, Homo sapiens
VREEVPLELVEAHVK

SEQ ID NO: 41934 - protein, 18 aa, Homo sapiens
DVLILGGGDGGILCEIVK

SEQ ID NO: 41935 - protein, 28 aa, Homo sapiens
EFDYVINDLTAVPISTSPEEDSTWEFLR

SEQ ID NO: 41936 - protein, 16 aa, Homo sapiens
GDCYQVLIEDCIPVLK

SEQ ID NO: 41937 - protein, 30 aa, Homo sapiens
GLQSIFQEQGMAESVHTWQDHGYLATYTNK

SEQ ID NO: 41938 - protein, 11 aa, Homo sapiens
HSTLDFMLGAK

SEQ ID NO: 41939 - protein, 30 aa, Homo sapiens
IYPHGLVLLDLQSYDGDAQGKEEIDSILNK

SEQ ID NO: 41940 - protein, 8 aa, Homo sapiens
LILDLSMK

SEQ ID NO: 41941 - protein, 21 aa, Homo sapiens
LVEYDIDEVVYDEDSPYQNIK

SEQ ID NO: 41942 - protein, 9 aa, Homo sapiens
LYCPVEFSK

SEQ ID NO: 41943 - protein, 11 aa, Homo sapiens
MKELSQDSTGR

SEQ ID NO: 41944 - protein, 8 aa, Homo sapiens
NGSFANLR

SEQ ID NO: 41945 - protein, 7 aa, Homo sapiens
RLPPIVR

SEQ ID NO: 41946 - protein, 23 aa, Homo sapiens
YFTQGNCVNLTEALSLYEEQLGR

SEQ ID NO: 41947 - protein, 14 aa, Homo sapiens
LPKNPEHFVVCNRS

SEQ ID NO: 41948 - protein, 9 aa, Homo sapiens
QTDPMIMLK

SEQ ID NO: 41949 - protein, 27 aa, Homo sapiens
RAAIAQALAGEVSVVPPSRLMALLGQA

SEQ ID NO: 41950 - protein, 15 aa, Homo sapiens
DVLQAETSQQLCCQK

SEQ ID NO: 41951 - protein, 18 aa, Homo sapiens
IGSSLYALGTQDSTDICK

SEQ ID NO: 41952 - protein, 22 aa, Homo sapiens
SQDSSPLLNEVSSSLIGTDSQA

SEQ ID NO: 41953 - protein, 8 aa, Homo sapiens
YSFSEDTK

SEQ ID NO: 41954 - protein, 24 aa, Homo sapiens
FSSSDFSDLSNGEELQETCSSSLR

SEQ ID NO: 41955 - protein, 27 aa, Homo sapiens
TFNLPVLEALFSDVNMQEYPDLIHIYK

SEQ ID NO: 41956 - protein, 10 aa, Homo sapiens
DEDNNLLTEK

SEQ ID NO: 41957 - protein, 12 aa, Homo sapiens
ERDEDNNLLTEK

SEQ ID NO: 41958 - protein, 11 aa, Homo sapiens
FFETCDLDNDK

SEQ ID NO: 41959 - protein, 25 aa, Homo sapiens
FFETCDLDNDKYIALDEWAGCFGIK

SEQ ID NO: 41960 - protein, 22 aa, Homo sapiens
FGQLDQHPIDGYLSHTELAPLR

SEQ ID NO: 41961 - protein, 20 aa, Homo sapiens
IHENEKRLEAGDHPVELLAR

SEQ ID NO: 41962 - protein, 24 aa, Homo sapiens
IHENEKRLEAGDHPVELLARDFEK

SEQ ID NO: 41963 - protein, 13 aa, Homo sapiens
LEAGDHPVELLAR

SEQ ID NO: 41964 - protein, 17 aa, Homo sapiens
LEAGDHPVELLARDFEK

SEQ ID NO: 41965 - protein, 10 aa, Homo sapiens
LHLDYIGPCK

SEQ ID NO: 41966 - protein, 9 aa, Homo sapiens
NVLVTLYER

SEQ ID NO: 41967 - protein, 19 aa, Homo sapiens
NVLVTLYERDEDNNLLTEK

SEQ ID NO: 41968 - protein, 21 aa, Homo sapiens
NVLVTLYERDEDNNLLTEKQK

SEQ ID NO: 41969 - protein, 8 aa, Homo sapiens
PMEHCTTR

SEQ ID NO: 41970 - protein, 14 aa, Homo sapiens
RLEAGDHPVELLAR

SEQ ID NO: 41971 - protein, 18 aa, Homo sapiens
RLEAGDHPVELLARDFEK

SEQ ID NO: 41972 - protein, 12 aa, Homo sapiens
TFDSSCHFFATK

SEQ ID NO: 41973 - protein, 23 aa, Homo sapiens
VKKIHENEKRLEAGDHPVELLAR

SEQ ID NO: 41974 - protein, 27 aa, Homo sapiens
VKKIHENEKRLEAGDHPVELLARDFEK

SEQ ID NO: 41975 - protein, 13 aa, Homo sapiens
YERDEDNNLLTEK

SEQ ID NO: 41976 - protein, 14 aa, Homo sapiens
YIALDEWAGCFGIK

SEQ ID NO: 41977 - protein, 27 aa, Homo sapiens
RIAQKGGAEAMLVVNNSVLFPPSGNRS

SEQ ID NO: 41978 - protein, 10 aa, Homo sapiens
AALLELWELR

SEQ ID NO: 41979 - protein, 26 aa, Homo sapiens
AGTFQAFEQFGQQLLAHGHYASPEIK

SEQ ID NO: 41980 - protein, 21 aa, Homo sapiens
ALINADELASDVAGAEALLDR

SEQ ID NO: 41981 - protein, 12 aa, Homo sapiens
ALSSEGKPYVTK

SEQ ID NO: 41982 - protein, 14 aa, Homo sapiens
AQLADSFHLQQFFR

SEQ ID NO: 41983 - protein, 20 aa, Homo sapiens
ASAFNSWFENAEEDLTDPVR

SEQ ID NO: 41984 - protein, 21 aa, Homo sapiens
DLNSQADSLMTSSAFDTSQVK

SEQ ID NO: 41985 - protein, 21 aa, Homo sapiens
EAALTSEEVGADLEQVEVLQK

SEQ ID NO: 41986 - protein, 21 aa, Homo sapiens
EAFLNTEDKGDSLDSVEALIK

SEQ ID NO: 41987 - protein, 21 aa, Homo sapiens
EAIVTSEELGQDLEHVEVLQK

SEQ ID NO: 41988 - protein, 23 aa, Homo sapiens
EKEPIVGSTDYGKDEDSAEALLK

SEQ ID NO: 41989 - protein, 22 aa, Homo sapiens
ENSLKTDDYGRDLSSVQTLLTK

SEQ ID NO: 41990 - protein, 14 aa, Homo sapiens
HALLEADVAAHQDR

SEQ ID NO: 41991 - protein, 14 aa, Homo sapiens
HQALQAEIAGHEPR

SEQ ID NO: 41992 - protein, 14 aa, Homo sapiens
HQLLEADISAHEDR

SEQ ID NO: 41993 - protein, 19 aa, Homo sapiens
IAALQAFADQLIAAGHYAK

SEQ ID NO: 41994 - protein, 20 aa, Homo sapiens
KHEALMSDLSAYGSSIQALR

SEQ ID NO: 41995 - protein, 15 aa, Homo sapiens
KHQLLEADISAHEDR

SEQ ID NO: 41996 - protein, 13 aa, Homo sapiens
LIQEQHPEEELIK

SEQ ID NO: 41997 - protein, 15 aa, Homo sapiens
LIQNNHYAMEDVATR

SEQ ID NO: 41998 - protein, 9 aa, Homo sapiens
LLEAQSHFR

SEQ ID NO: 41999 - protein, 18 aa, Homo sapiens
LQIASDENYKDPTNLQGK

SEQ ID NO: 42000 - protein, 15 aa, Homo sapiens
LQQSHPLSATQIQVK

SEQ ID NO: 42001 - protein, 21 aa, Homo sapiens
MTLVASEDYGDTLAAIQGLLK

SEQ ID NO: 42002 - protein, 21 aa, Homo sapiens
NQALNTDNYGHDLASVQALQR

SEQ ID NO: 42003 - protein, 23 aa, Homo sapiens
NVEDIELWLYEVEGHLASDDYGK

SEQ ID NO: 42004 - protein, 18 aa, Homo sapiens
QEFAQHANAFHQWIQETR

SEQ ID NO: 42005 - protein, 15 aa, Homo sapiens
QVEELYHSLLELGEK

SEQ ID NO: 42006 - protein, 12 aa, Homo sapiens
REELITNWEQIR

SEQ ID NO: 42007 - protein, 21 aa, Homo sapiens
RLEAELAAHEPAIQGVLDTGK

SEQ ID NO: 42008 - protein, 22 aa, Homo sapiens
RLEAELAAHEPAIQGVLDTGKK

SEQ ID NO: 42009 - protein, 21 aa, Homo sapiens
SADESGQALLAAGHYASDEVR

SEQ ID NO: 42010 - protein, 29 aa, Homo sapiens
SLGYDLPMVEEGEPDPEFEAILDTVDPNR

SEQ ID NO: 42011 - protein, 12 aa, Homo sapiens
SQLLGSAHEVQR

SEQ ID NO: 42012 - protein, 13 aa, Homo sapiens
VNDVCTNGQDLIK

SEQ ID NO: 42013 - protein, 22 aa, Homo sapiens
YTEHSTVGLAQQWDQLDQLGMR

SEQ ID NO: 42014 - protein, 15 aa, Homo sapiens
FAALEKPTTLELKER

SEQ ID NO: 42015 - protein, 10 aa, Homo sapiens
FLDLLEPLGR

SEQ ID NO: 42016 - protein, 14 aa, Homo sapiens
FQIQDIVVQTQEGR

SEQ ID NO: 42017 - protein, 24 aa, Homo sapiens
INARWDAPDDELDNDNSSARLFER

SEQ ID NO: 42018 - protein, 11 aa, Homo sapiens
KQFGHPQIEAR

SEQ ID NO: 42019 - protein, 16 aa, Homo sapiens
LIDAGHSEAATIAEWK

SEQ ID NO: 42020 - protein, 19 aa, Homo sapiens
LQGQVDKHYAGLKDVAEER

SEQ ID NO: 42021 - protein, 21 aa, Homo sapiens
LQGQVDKHYAGLKDVAEERKR

SEQ ID NO: 42022 - protein, 36 aa, Homo sapiens
VKESGEKVIQGQTDPEYLLLGQRLEGLDTGWNALGR

SEQ ID NO: 42023 - protein, 23 aa, Homo sapiens
CLNNAEAAEEIVDCITESLSILK

SEQ ID NO: 42024 - protein, 14 aa, Homo sapiens
KPGQSFQEQVEHYR

SEQ ID NO: 42025 - protein, 13 aa, Homo sapiens
LCQIFSDLNATYR

SEQ ID NO: 42026 - protein, 33 aa, Homo sapiens
KEPEERPTFEYLQAFLEDYFTSTEPQYQPGENL

SEQ ID NO: 42027 - protein, 17 aa, Homo sapiens
LTTVCPTSKPQTQGLAK

SEQ ID NO: 42028 - protein, 32 aa, Homo sapiens
SLEPAENVHGAGGGAFPASQTPSKPASADGHR

SEQ ID NO: 42029 - protein, 21 aa, Homo sapiens
KGLFKGGDMSKNVSQSQMAKL

SEQ ID NO: 42030 - protein, 40 aa, Homo sapiens
KAGYFNFTSATITYLAQEDGPVVIGSTSAPGQGGILAQRE

SEQ ID NO: 42031 - protein, 19 aa, Homo sapiens
RIAPASNVSHTVVLRPLKA

SEQ ID NO: 42032 - protein, 12 aa, Homo sapiens
HTDTDVLEACSK

SEQ ID NO: 42033 - protein, 15 aa, Homo sapiens
TYHALCNEEFTIFNR

SEQ ID NO: 42034 - protein, 17 aa, Homo sapiens
AAYIYFTDFCPDNLFNK

SEQ ID NO: 42035 - protein, 34 aa, Homo sapiens
EINISFIPHESQVYTLDVPDAFYYCYSPDPGNAK

SEQ ID NO: 42036 - protein, 15 aa, Homo sapiens
SCEVIIGSTHVLTPK

SEQ ID NO: 42037 - protein, 12 aa, Homo sapiens
SVDCFLHDFASK

SEQ ID NO: 42038 - protein, 7 aa, Homo sapiens
LHEKIQE

SEQ ID NO: 42039 - protein, 16 aa, Homo sapiens
ANRTGSVEAQTALKKR

SEQ ID NO: 42040 - protein, 20 aa, Homo sapiens
RSTEEPTAPASPQPPNDSRL

SEQ ID NO: 42041 - protein, 16 aa, Homo sapiens
LIHNSHDPSYFACLIK

SEQ ID NO: 42042 - protein, 11 aa, Homo sapiens
SALLQTVEELR

SEQ ID NO: 42043 - protein, 23 aa, Homo sapiens
AKPVATAPIPGTPWCVVWTGDER

SEQ ID NO: 42044 - protein, 11 aa, Homo sapiens
LIVAYVDDLDR

SEQ ID NO: 42045 - protein, 16 aa, Homo sapiens
KADEGSLKNISIYTKS

SEQ ID NO: 42046 - protein, 15 aa, Homo sapiens
GYYANFCSGPCPYLR

SEQ ID NO: 42047 - protein, 10 aa, Homo sapiens
VEQLSNMVVK

SEQ ID NO: 42048 - protein, 34 aa, Homo sapiens
RSLCCGDISQSAVLFLCQGTLAMLDWQNGSMGRS

SEQ ID NO: 42049 - protein, 14 aa, Homo sapiens
MLFNVENGTPASRE

SEQ ID NO: 42050 - protein, 33 aa, Homo sapiens
VPTVFAFQDPTQQVRENTDPASERGNASSSQKE

SEQ ID NO: 42051 - protein, 11 aa, Homo sapiens
MKYLNLSSTRI

SEQ ID NO: 42052 - protein, 25 aa, Homo sapiens
KIFQIYKGNFTGSVEPEPSTLTPRT

SEQ ID NO: 42053 - protein, 24 aa, Homo sapiens
ALPAKPALPAKPSLLVPVGPRPPR

SEQ ID NO: 42054 - protein, 30 aa, Homo sapiens
APVIRPGGTLGLSEAADSDAHLFQDSTEPR

SEQ ID NO: 42055 - protein, 17 aa, Homo sapiens
DLEVTCDPDSGGSQGLR

SEQ ID NO: 42056 - protein, 38 aa, Homo sapiens
DLQSEFGITGDPQPSSFSPSSWCQGASQDYGLGGASPR

SEQ ID NO: 42057 - protein, 24 aa, Homo sapiens
DMNLTGCLESGGSEEPGGIGVGEK

SEQ ID NO: 42058 - protein, 20 aa, Homo sapiens
DSLGAYASQDANEQGQDLGK

SEQ ID NO: 42059 - protein, 18 aa, Homo sapiens
DTQSPSTCSEGLLGWSQK

SEQ ID NO: 42060 - protein, 16 aa, Homo sapiens
EHGVGGVSQCPEPGLR

SEQ ID NO: 42061 - protein, 19 aa, Homo sapiens
ESGVGQTDWSGVEAGEFLK

SEQ ID NO: 42062 - protein, 34 aa, Homo sapiens
GDGESQPQFPAVPLEPLPTTEGTPGLPLQQAEER

SEQ ID NO: 42063 - protein, 21 aa, Homo sapiens
GSGGLFSPSTAHVPDGALGQR

SEQ ID NO: 42064 - protein, 17 aa, Homo sapiens
NLEVSSCVGSGGSSEAR

SEQ ID NO: 42065 - protein, 29 aa, Homo sapiens
PDQPCVLFADAPEPGQALPVEEEAVTLAR

SEQ ID NO: 42066 - protein, 35 aa, Homo sapiens
RDMNLTGCLESGGSEEPGGIGVGEKDWTSDVNVKS

SEQ ID NO: 42067 - protein, 12 aa, Homo sapiens
VVGKPAQLGTQR

SEQ ID NO: 42068 - protein, 28 aa, Homo sapiens
KGRIGVVISSYMHFTNVSASADQALDRF

SEQ ID NO: 42069 - protein, 14 aa, Homo sapiens
DLISHDEMFSDIYK

SEQ ID NO: 42070 - protein, 13 aa, Homo sapiens
EIADGLCLEVEGK

SEQ ID NO: 42071 - protein, 7 aa, Homo sapiens
HILANFK

SEQ ID NO: 42072 - protein, 22 aa, Homo sapiens
NYQFFIGENMNPDGMVALLDYR

SEQ ID NO: 42073 - protein, 13 aa, Homo sapiens
VKPFMTGAAEQIK

SEQ ID NO: 42074 - protein, 18 aa, Homo sapiens
EGHPVTSEPSRPEPAVFK

SEQ ID NO: 42075 - protein, 14 aa, Homo sapiens
HVPGASFFDIEECR

SEQ ID NO: 42076 - protein, 13 aa, Homo sapiens
KVDLSQPLIATCR

SEQ ID NO: 42077 - protein, 25 aa, Homo sapiens
AFTELFQVACAKPPPLGLCDYPSSR

SEQ ID NO: 42078 - protein, 22 aa, Homo sapiens
ESGLQAAHPNSIFLIDHAWTCR

SEQ ID NO: 42079 - protein, 15 aa, Homo sapiens
FNQTYQLAHGTAEEK

SEQ ID NO: 42080 - protein, 20 aa, Homo sapiens
FTLTQSEADADILFNFSHFK

SEQ ID NO: 42081 - protein, 23 aa, Homo sapiens
IQHADVPSFATAPFFYMPQQVAY

SEQ ID NO: 42082 - protein, 17 aa, Homo sapiens
LPLDINPVVHPHGHIFK

SEQ ID NO: 42083 - protein, 22 aa, Homo sapiens
LSQERPGVLLNQFPCENLLTVK

SEQ ID NO: 42084 - protein, 17 aa, Homo sapiens
PGVLLNQFPCENLLTVK

SEQ ID NO: 42085 - protein, 13 aa, Homo sapiens
QVHCEEFIPEFEK

SEQ ID NO: 42086 - protein, 22 aa, Homo sapiens
RFTLTQSEADADILFNFSHFKD

SEQ ID NO: 42087 - protein, 12 aa, Homo sapiens
SIFLIDHAWTCR

SEQ ID NO: 42088 - protein, 26 aa, Homo sapiens
SSPGQTPEEGAQALAEFAALHGPALR

SEQ ID NO: 42089 - protein, 16 aa, Homo sapiens
VYTDVQQVASSLTHPR

SEQ ID NO: 42090 - protein, 16 aa, Homo sapiens
WGEDNHWICKPWNLAR

SEQ ID NO: 42091 - protein, 27 aa, Homo sapiens
YHPTFFNDVFSTLFLDQPGGCHVTCLV

SEQ ID NO: 42092 - protein, 15 aa, Homo sapiens
ALTVPELTQQMFDAK

SEQ ID NO: 42093 - protein, 17 aa, Homo sapiens
MSSTFIGNSTAIQELFK

SEQ ID NO: 42094 - protein, 26 aa, Homo sapiens
SGAFGHLFRPDNFIFGQSGAGNNWAK

SEQ ID NO: 42095 - protein, 17 aa, Homo sapiens
SINFLHQVCHDQTPTTK

SEQ ID NO: 42096 - protein, 12 aa, Homo sapiens
TLAALVDHCQGR

SEQ ID NO: 42097 - protein, 9 aa, Homo sapiens
EGIPPDQQR

SEQ ID NO: 42098 - protein, 9 aa, Homo sapiens
ESTLHLVLR

SEQ ID NO: 42099 - protein, 13 aa, Homo sapiens
IQDKEGIPPDQQR

SEQ ID NO: 42100 - protein, 16 aa, Homo sapiens
TITLEVEPSDTIENVK

SEQ ID NO: 42101 - protein, 9 aa, Homo sapiens
TLSDYNIQK

SEQ ID NO: 42102 - protein, 18 aa, Homo sapiens
ALDCELAEAQLHTTAIDK

SEQ ID NO: 42103 - protein, 12 aa, Homo sapiens
ILTCMQGMEEIR

SEQ ID NO: 42104 - protein, 16 aa, Homo sapiens
EEDAFHFVSYVPVNGR

SEQ ID NO: 42105 - protein, 24 aa, Homo sapiens
EGPIDLGACNQDDWISAVRPVIEK

SEQ ID NO: 42106 - protein, 12 aa, Homo sapiens
LKPVHGLIFLFK

SEQ ID NO: 42107 - protein, 34 aa, Homo sapiens
QVINNACATQAIVSVLLNCTHQDVHLGETLSEFK

SEQ ID NO: 42108 - protein, 20 aa, Homo sapiens
IIGVHQEDELLECLSPATSR

SEQ ID NO: 42109 - protein, 28 aa, Homo sapiens
KVLKNSSLAEFVQSLSQTMGFPQDQIRL

SEQ ID NO: 42110 - protein, 15 aa, Homo sapiens
SLNYCGHIYTPISCK

SEQ ID NO: 42111 - protein, 32 aa, Homo sapiens
TMIELSDNENPWTIFLETVDPELAASGATLPK

SEQ ID NO: 42112 - protein, 20 aa, Homo sapiens
ASYDTLCVLDGDKDSVNCAR

SEQ ID NO: 42113 - protein, 21 aa, Homo sapiens
EQHDALEFFNSLVDSLDEALK

SEQ ID NO: 42114 - protein, 14 aa, Homo sapiens
GDLLEGANAYHCEK

SEQ ID NO: 42115 - protein, 18 aa, Homo sapiens
LAWDFSPEQLDHLFDCFK

SEQ ID NO: 42116 - protein, 19 aa, Homo sapiens
LQVNQVVIHEDFIQSCFDR

SEQ ID NO: 42117 - protein, 14 aa, Homo sapiens
NHQNLLDSLEQYVK

SEQ ID NO: 42118 - protein, 13 aa, Homo sapiens
FGGDQPVYINIIR

SEQ ID NO: 42119 - protein, 6 aa, Homo sapiens
FLLDLR

SEQ ID NO: 42120 - protein, 13 aa, Homo sapiens
TRLTKNEQMELIK

SEQ ID NO: 42121 - protein, 20 aa, Homo sapiens
DGVLLCQLLHNLSPGSIDLK

SEQ ID NO: 42122 - protein, 18 aa, Homo sapiens
KFDSLLELVEYYQCHSLK

SEQ ID NO: 42123 - protein, 20 aa, Homo sapiens
LVLSPADMAAVFINLEDLIK

SEQ ID NO: 42124 - protein, 22 aa, Homo sapiens
RDGVLLCQLLHNLSPGSIDLKD

SEQ ID NO: 42125 - protein, 26 aa, Homo sapiens
SGYFPSSSVKPCPVDGRPPISRPPSR

SEQ ID NO: 42126 - protein, 16 aa, Homo sapiens
VVWPSAVVFDLAQALR

SEQ ID NO: 42127 - protein, 19 aa, Homo sapiens
EHINLGCDMDFDIAGPSIR

SEQ ID NO: 42128 - protein, 18 aa, Homo sapiens
KLETAVNLAWTAGNSNTR

SEQ ID NO: 42129 - protein, 13 aa, Homo sapiens
LTFDSSFSPNTGK

SEQ ID NO: 42130 - protein, 9 aa, Homo sapiens
PPTYADLGK

SEQ ID NO: 42131 - protein, 19 aa, Homo sapiens
SENGLEFTSSGSANTETTK

SEQ ID NO: 42132 - protein, 23 aa, Homo sapiens
TDEFQLHTNVNDGTEFGGSIYQK

SEQ ID NO: 42133 - protein, 20 aa, Homo sapiens
VNNSSLIGLGYTQTLKPGIK

SEQ ID NO: 42134 - protein, 11 aa, Homo sapiens
VTQSNFAVGYK

SEQ ID NO: 42135 - protein, 19 aa, Homo sapiens
WNTDNTLGTEITVEDQLAR

SEQ ID NO: 42136 - protein, 12 aa, Homo sapiens
YQIDPDACFSAK

SEQ ID NO: 42137 - protein, 14 aa, Homo sapiens
AFVLSSVDELEQQR

SEQ ID NO: 42138 - protein, 9 aa, Homo sapiens
AFVVDMMER

SEQ ID NO: 42139 - protein, 8 aa, Homo sapiens
ALSVVWDR

SEQ ID NO: 42140 - protein, 11 aa, Homo sapiens
APTCGLCEVAR

SEQ ID NO: 42141 - protein, 17 aa, Homo sapiens
ASPPSSSCNISSGEMQK

SEQ ID NO: 42142 - protein, 18 aa, Homo sapiens
CERMEACMLNGTVIGPGK

SEQ ID NO: 42143 - protein, 12 aa, Homo sapiens
DETHFEVVESGR

SEQ ID NO: 42144 - protein, 17 aa, Homo sapiens
ECLCGALASYAAACAGR

SEQ ID NO: 42145 - protein, 20 aa, Homo sapiens
EQAPNLVYMVTGNPASDEIK

SEQ ID NO: 42146 - protein, 18 aa, Homo sapiens
EQDLEVILHNGACSPGAR

SEQ ID NO: 42147 - protein, 24 aa, Homo sapiens
FNHLGHIFTFTPQNNEFQLQLSPK

SEQ ID NO: 42148 - protein, 19 aa, Homo sapiens
FSEEACAVLTSPTFEACHR

SEQ ID NO: 42149 - protein, 21 aa, Homo sapiens
GLQPTLTNPGECRPNFTCACR

SEQ ID NO: 42150 - protein, 14 aa, Homo sapiens
GLRPSCPNSQSPVK

SEQ ID NO: 42151 - protein, 17 aa, Homo sapiens
GLRVAQCSQKPCEDSCR

SEQ ID NO: 42152 - protein, 10 aa, Homo sapiens
GLWEQCQLLK

SEQ ID NO: 42153 - protein, 12 aa, Homo sapiens
GLYLETEAGYYK

SEQ ID NO: 42154 - protein, 16 aa, Homo sapiens
GQVYLQCGTPCNLTCR

SEQ ID NO: 42155 - protein, 7 aa, Homo sapiens
GVCVDWR

SEQ ID NO: 42156 - protein, 23 aa, Homo sapiens
HCDGNVSSCGDHPSEGCFCPPDK

SEQ ID NO: 42157 - protein, 11 aa, Homo sapiens
HIVTFDGQNFK

SEQ ID NO: 42158 - protein, 9 aa, Homo sapiens
HLSISVVLK

SEQ ID NO: 42159 - protein, 14 aa, Homo sapiens
IDGSGNFQVLLSDR

SEQ ID NO: 42160 - protein, 18 aa, Homo sapiens
IFTFTPQNNEFQLQLSPK

SEQ ID NO: 42161 - protein, 18 aa, Homo sapiens
IGWPNAPILIQDFETLPR

SEQ ID NO: 42162 - protein, 13 aa, Homo sapiens
ILAGPAGDSNVVK

SEQ ID NO: 42163 - protein, 16 aa, Homo sapiens
ILAGPAGDSNVVKLQR

SEQ ID NO: 42164 - protein, 20 aa, Homo sapiens
IPGTCCDTCEEPECNDITAR

SEQ ID NO: 42165 - protein, 18 aa, Homo sapiens
KGQVYLQCGTPCNLTCRS

SEQ ID NO: 42166 - protein, 23 aa, Homo sapiens
KTTCNPCPLGYKEENNTGECCGR

SEQ ID NO: 42167 - protein, 24 aa, Homo sapiens
KTTCNPCPLGYKEENNTGECCGRC

SEQ ID NO: 42168 - protein, 16 aa, Homo sapiens
KVIVIPVGIGPHANLK

SEQ ID NO: 42169 - protein, 21 aa, Homo sapiens
KWNCTDHVCDATCSTIGMAHY

SEQ ID NO: 42170 - protein, 10 aa, Homo sapiens
LIEKQAPENK

SEQ ID NO: 42171 - protein, 10 aa, Homo sapiens
LSEAEFEVLK

SEQ ID NO: 42172 - protein, 11 aa, Homo sapiens
LSGEAYGFVAR

SEQ ID NO: 42173 - protein, 14 aa, Homo sapiens
LSYGEDLQMDWDGR

SEQ ID NO: 42174 - protein, 13 aa, Homo sapiens
LTGSCSYVLFQNK

SEQ ID NO: 42175 - protein, 15 aa, Homo sapiens
MEACMLNGTVIGPGK

SEQ ID NO: 42176 - protein, 24 aa, Homo sapiens
NSQWICSNEECPGECLVTGQSHFK

SEQ ID NO: 42177 - protein, 16 aa, Homo sapiens
PLGYKEENNTGECCGR

SEQ ID NO: 42178 - protein, 15 aa, Homo sapiens
RDETLQDGCDTHFCK

SEQ ID NO: 42179 - protein, 23 aa, Homo sapiens
RGLQPTLTNPGECRPNFTCACRK

SEQ ID NO: 42180 - protein, 25 aa, Homo sapiens
RHCDGNVSSCGDHPSEGCFCPPDKV

SEQ ID NO: 42181 - protein, 17 aa, Homo sapiens
RMEACMLNGTVIGPGKT

SEQ ID NO: 42182 - protein, 26 aa, Homo sapiens
RPGDVWTLPDQCHTVTCQPDGQTLLK

SEQ ID NO: 42183 - protein, 29 aa, Homo sapiens
RTEPMQVALHCTNGSVVYHEVLNAMECKC

SEQ ID NO: 42184 - protein, 13 aa, Homo sapiens
SEVEVDIHYCQGK

SEQ ID NO: 42185 - protein, 12 aa, Homo sapiens
SFSIIGDFQNGK

SEQ ID NO: 42186 - protein, 15 aa, Homo sapiens
SGFTYVLHEGECCGR

SEQ ID NO: 42187 - protein, 11 aa, Homo sapiens
SKEFMEEVIQR

SEQ ID NO: 42188 - protein, 20 aa, Homo sapiens
SVGSQWASPENPCLINECVR

SEQ ID NO: 42189 - protein, 27 aa, Homo sapiens
TEPMQVALHCTNGSVVYHEVLNAMECK

SEQ ID NO: 42190 - protein, 21 aa, Homo sapiens
TLCECAGGLECACPALLEYAR

SEQ ID NO: 42191 - protein, 11 aa, Homo sapiens
TTCNPCPLGYK

SEQ ID NO: 42192 - protein, 22 aa, Homo sapiens
TTCNPCPLGYKEENNTGECCGR

SEQ ID NO: 42193 - protein, 11 aa, Homo sapiens
TVMIDVCTTCR

SEQ ID NO: 42194 - protein, 13 aa, Homo sapiens
VAVVEYHDGSHAY

SEQ ID NO: 42195 - protein, 17 aa, Homo sapiens
VAVVEYHDGSHAYIGLK

SEQ ID NO: 42196 - protein, 9 aa, Homo sapiens
VEDFGNAWK

SEQ ID NO: 42197 - protein, 11 aa, Homo sapiens
VIVIPVGIGPH

SEQ ID NO: 42198 - protein, 15 aa, Homo sapiens
VIVIPVGIGPHANLK

SEQ ID NO: 42199 - protein, 10 aa, Homo sapiens
VKEEVFIQQR

SEQ ID NO: 42200 - protein, 11 aa, Homo sapiens
VTVFPIGIGDR

SEQ ID NO: 42201 - protein, 14 aa, Homo sapiens
YAGSQVASTSEVLK

SEQ ID NO: 42202 - protein, 8 aa, Homo sapiens
YIILLLGK

SEQ ID NO: 42203 - protein, 14 aa, Homo sapiens
YLSDHSFLVSQGDR

SEQ ID NO: 42204 - protein, 18 aa, Homo sapiens
LDNNLDSVSLLIDHVCSR

SEQ ID NO: 42205 - protein, 19 aa, Homo sapiens
SCFGGHNEDFIASGSEDHK

SEQ ID NO: 42206 - protein, 12 aa, Homo sapiens
AVGHPFVIQLGR

SEQ ID NO: 42207 - protein, 19 aa, Homo sapiens
DDEQNFIQNLSLFLCTFLK

SEQ ID NO: 42208 - protein, 14 aa, Homo sapiens
FLNWIPLGYIFETK

SEQ ID NO: 42209 - protein, 15 aa, Homo sapiens
ICLEYWNHLAAELYR

SEQ ID NO: 42210 - protein, 26 aa, Homo sapiens
ISTSLNPGNPVNNQIFLQEYVANLLK

SEQ ID NO: 42211 - protein, 26 aa, Homo sapiens
LAYSNGKDDEQNFIQNLSLFLCTFLK

SEQ ID NO: 42212 - protein, 22 aa, Homo sapiens
LDINLLDNVVNCLYHGEGAQQR

SEQ ID NO: 42213 - protein, 17 aa, Homo sapiens
LDNVVNCLYHGEGAQQR

SEQ ID NO: 42214 - protein, 22 aa, Homo sapiens
LGGHITAEIPQIFDAVFECTLN

SEQ ID NO: 42215 - protein, 23 aa, Homo sapiens
NLNTLCWAIGSISGAMHEEDEKR

SEQ ID NO: 42216 - protein, 12 aa, Homo sapiens
SAFPHLQDAQVK

SEQ ID NO: 42217 - protein, 18 aa, Homo sapiens
YMLLPNQVWDSIIQQATK

SEQ ID NO: 42218 - protein, 16 aa, Homo sapiens
KGQGNKVQNGSVHQKD

SEQ ID NO: 42219 - protein, 12 aa, Homo sapiens
DICNDVLSLLEK

SEQ ID NO: 42220 - protein, 18 aa, Homo sapiens
GIVDQSQQAYQEAFEISK

SEQ ID NO: 42221 - protein, 19 aa, Homo sapiens
KGIVDQSQQAYQEAFEISK

SEQ ID NO: 42222 - protein, 22 aa, Homo sapiens
RLGLALNFSVFYYEILNSPEKA

SEQ ID NO: 42223 - protein, 14 aa, Homo sapiens
SVTEQGAELSNEER

SEQ ID NO: 42224 - protein, 28 aa, Homo sapiens
SVTEQGAELSNEERNLLSVAYKNVVGAR

SEQ ID NO: 42225 - protein, 19 aa, Homo sapiens
TAFDEAIAELDTLSEESYK

SEQ ID NO: 42226 - protein, 29 aa, Homo sapiens
TAFDEAIAELDTLSEESYKDSTLIMQLLR

SEQ ID NO: 42227 - protein, 26 aa, Homo sapiens
TEQGAELSNEERNLLSVAYKNVVGAR

SEQ ID NO: 42228 - protein, 8 aa, Homo sapiens
VVSSIEQK

SEQ ID NO: 42229 - protein, 20 aa, Homo sapiens
VVSSIEQKTEGAEKKQQMAR

SEQ ID NO: 42230 - protein, 12 aa, Homo sapiens
YLAEVAAGDDKK

SEQ ID NO: 42231 - protein, 20 aa, Homo sapiens
DKMIENHNISTPFSCQFCKE

SEQ ID NO: 42232 - protein, 13 aa, Homo sapiens
LIHPDEDISLEER

SEQ ID NO: 42233 - protein, 16 aa, Homo sapiens
LYTGPGLAIHCMQVHK

SEQ ID NO: 42234 - protein, 13 aa, Homo sapiens
DFTATDLSEFAAK

SEQ ID NO: 42235 - protein, 28 aa, Homo sapiens
DGTVTAGNASGVADGAGAVIIASEDAVK

SEQ ID NO: 42236 - protein, 20 aa, Homo sapiens
DMDLVEVNEAFAPQYLAVER

SEQ ID NO: 42237 - protein, 10 aa, Homo sapiens
ITAHLVHELR

SEQ ID NO: 42238 - protein, 19 aa, Homo sapiens
LCGSGFQSIVNGCQEICVK

SEQ ID NO: 42239 - protein, 20 aa, Homo sapiens
TNVNGGAIALGHPLGGSGSR

SEQ ID NO: 42240 - protein, 25 aa, Homo sapiens
ADRQALNEHFQSILQTLEEQVSGER

SEQ ID NO: 42241 - protein, 8 aa, Homo sapiens
AKMDLEER

SEQ ID NO: 42242 - protein, 12 aa, Homo sapiens
DELAPAGTGVSR

SEQ ID NO: 42243 - protein, 14 aa, Homo sapiens
EWAMADNQSKNLPK

SEQ ID NO: 42244 - protein, 11 aa, Homo sapiens
GFPFHSSEIQR

SEQ ID NO: 42245 - protein, 14 aa, Homo sapiens
GSTEQDAASPEKEK

SEQ ID NO: 42246 - protein, 23 aa, Homo sapiens
GSTEQDAASPEKEKMNPLEQYER

SEQ ID NO: 42247 - protein, 26 aa, Homo sapiens
GVEYVCCPPPGTPDPSGTAVGDPSTR

SEQ ID NO: 42248 - protein, 28 aa, Homo sapiens
HQEAQEACSSQGLILHGSGMLLPCGSDR

SEQ ID NO: 42249 - protein, 21 aa, Homo sapiens
HTLRHYQHVAAVDPEKAQQMR

SEQ ID NO: 42250 - protein, 12 aa, Homo sapiens
HYQHVAAVDPEK

SEQ ID NO: 42251 - protein, 17 aa, Homo sapiens
HYQHVAAVDPEKAQQMR

SEQ ID NO: 42252 - protein, 9 aa, Homo sapiens
MNPLEQYER

SEQ ID NO: 42253 - protein, 9 aa, Homo sapiens
MRQINEVMR

SEQ ID NO: 42254 - protein, 19 aa, Homo sapiens
MRQINEVMREWAMADNQSK

SEQ ID NO: 42255 - protein, 19 aa, Homo sapiens
PELQIARVEQATQAIPMER

SEQ ID NO: 42256 - protein, 17 aa, Homo sapiens
QINEVMREWAMADNQSK

SEQ ID NO: 42257 - protein, 10 aa, Homo sapiens
QMYPELQIAR

SEQ ID NO: 42258 - protein, 20 aa, Homo sapiens
RAALEGFLAALQADPPQAER

SEQ ID NO: 42259 - protein, 10 aa, Homo sapiens
RKVNASVPRG

SEQ ID NO: 42260 - protein, 15 aa, Homo sapiens
RVNQSLGLLDQNPHL

SEQ ID NO: 42261 - protein, 15 aa, Homo sapiens
SGSCAHPHHQVVPFR

SEQ ID NO: 42262 - protein, 10 aa, Homo sapiens
TGRWEPDPQR

SEQ ID NO: 42263 - protein, 12 aa, Homo sapiens
TGRWEPDPQRSR

SEQ ID NO: 42264 - protein, 12 aa, Homo sapiens
VEQATQAIPMER

SEQ ID NO: 42265 - protein, 10 aa, Homo sapiens
VIALINDQRR

SEQ ID NO: 42266 - protein, 7 aa, Homo sapiens
IHEKIQE

SEQ ID NO: 42267 - protein, 26 aa, Homo sapiens
RGFNMSIPMPGHPVNFSSVTLEQARR

SEQ ID NO: 42268 - protein, 21 aa, Homo sapiens
DQMVDIMRASQDNPQDGIMVK

SEQ ID NO: 42269 - protein, 12 aa, Homo sapiens
GCCSQTDGLNSK

SEQ ID NO: 42270 - protein, 25 aa, Homo sapiens
GVEEGTVLSVGGQVNLLIQQAIDPK

SEQ ID NO: 42271 - protein, 21 aa, Homo sapiens
ISMDHPHHTLFIILALANANR

SEQ ID NO: 42272 - protein, 7 aa, Homo sapiens
KMMEVQK

SEQ ID NO: 42273 - protein, 13 aa, Homo sapiens
SVKENGLEPHLVK

SEQ ID NO: 42274 - protein, 7 aa, Homo sapiens
YLVIDNK

SEQ ID NO: 42275 - protein, 17 aa, Homo sapiens
YLVIDNKDNENLYITIK

SEQ ID NO: 42276 - protein, 18 aa, Homo sapiens
EEYKNYLDAANMSMRVRR

SEQ ID NO: 42277 - protein, 12 aa, Homo sapiens
THGTLESVNGPK

SEQ ID NO: 42278 - protein, 16 aa, Homo sapiens
THGTLESVNGPKAGSR

SEQ ID NO: 42279 - protein, 28 aa, Homo sapiens
LAVNNIAGIEEVNMIKDDGTVIHFNNPK

SEQ ID NO: 42280 - protein, 22 aa, Homo sapiens
PITEMLPGILSQLGADSLTSLR

SEQ ID NO: 42281 - protein, 15 aa, Homo sapiens
TATADDKKLQSSLKK

SEQ ID NO: 42282 - protein, 28 aa, Homo sapiens
MLTGVLLANGTLNASILNSLYNENLVKE

SEQ ID NO: 42283 - protein, 25 aa, Homo sapiens
KFLMSNETVLLAKHNIFTLALMIVN

SEQ ID NO: 42284 - protein, 16 aa, Homo sapiens
KNESSPAPPDSDADKL

SEQ ID NO: 42285 - protein, 32 aa, Homo sapiens
RGSGAVAEGNRTEAGSQDYSLLQAYYSQESKV

SEQ ID NO: 42286 - protein, 12 aa, Homo sapiens
HLNDSGQLGLRM

SEQ ID NO: 42287 - protein, 14 aa, Homo sapiens
KFLSNDTVQLNVKH

SEQ ID NO: 42288 - protein, 19 aa, Homo sapiens
MSLANPLPTNYTWYHNGKE

SEQ ID NO: 42289 - protein, 25 aa, Homo sapiens
RALDGDLESFILFHNPEYNKNTSKF

SEQ ID NO: 42290 - protein, 22 aa, Homo sapiens
KAEDCEISFLPFNSSDDVQERR

SEQ ID NO: 42291 - protein, 10 aa, Homo sapiens
DLFDPIIEDR

SEQ ID NO: 42292 - protein, 13 aa, Homo sapiens
FCTGLTQIETLFK

SEQ ID NO: 42293 - protein, 19 aa, Homo sapiens
FPAEDEFPDLSAHNNHMAK

SEQ ID NO: 42294 - protein, 7 aa, Homo sapiens
FSEVLKR

SEQ ID NO: 42295 - protein, 21 aa, Homo sapiens
GTGGVDTAAVGGVFDVSNADR

SEQ ID NO: 42296 - protein, 11 aa, Homo sapiens
HGGYKPSDEHK

SEQ ID NO: 42297 - protein, 16 aa, Homo sapiens
LAVEALSSLDGDLAGR

SEQ ID NO: 42298 - protein, 15 aa, Homo sapiens
LEQGQAIDDLMPAQK

SEQ ID NO: 42299 - protein, 8 aa, Homo sapiens
LLIEMEQR

SEQ ID NO: 42300 - protein, 21 aa, Homo sapiens
LRFPAEDEFPDLSAHNNHMAK

SEQ ID NO: 42301 - protein, 10 aa, Homo sapiens
PFSNSHNALK

SEQ ID NO: 42302 - protein, 22 aa, Homo sapiens
RGTGGVDTAAVGGVFDVSNADR

SEQ ID NO: 42303 - protein, 11 aa, Homo sapiens
VLTPELYAELR

SEQ ID NO: 42304 - protein, 17 aa, Homo sapiens
GSSCFECTHYQSFLEYR

SEQ ID NO: 42305 - protein, 20 aa, Homo sapiens
GTVLLADNVICPGAPDFLAH

SEQ ID NO: 42306 - protein, 22 aa, Homo sapiens
GTVLLADNVICPGAPDFLAHVR

SEQ ID NO: 42307 - protein, 28 aa, Homo sapiens
ILNHVLQHAEPGNAQSVLEAIDTYCEQK

SEQ ID NO: 42308 - protein, 23 aa, Homo sapiens
IVDAVIQEHQPSVLLELGAYCGY

SEQ ID NO: 42309 - protein, 27 aa, Homo sapiens
IVDAVIQEHQPSVLLELGAYCGYSAVR

SEQ ID NO: 42310 - protein, 16 aa, Homo sapiens
KYDVDTLDMVFLDHWK

SEQ ID NO: 42311 - protein, 16 aa, Homo sapiens
LITIEINPDCAAITQR

SEQ ID NO: 42312 - protein, 27 aa, Homo sapiens
MVDFAGVKDKVTLVVGASQDIIPQLKK

SEQ ID NO: 42313 - protein, 13 aa, Homo sapiens
PDTLLLEECGLLR

SEQ ID NO: 42314 - protein, 15 aa, Homo sapiens
YDVDTLDMVFLDHWK

SEQ ID NO: 42315 - protein, 15 aa, Homo sapiens
YLPDTLLLEECGLLR

SEQ ID NO: 42316 - protein, 13 aa, Homo sapiens
CLFTLLGHLDYIR

SEQ ID NO: 42317 - protein, 14 aa, Homo sapiens
GHYNNVSCAVFHPR

SEQ ID NO: 42318 - protein, 21 aa, Homo sapiens
GVNWAAFHPTMPLIVSGADDR

SEQ ID NO: 42319 - protein, 13 aa, Homo sapiens
KLDALCNIHENIR

SEQ ID NO: 42320 - protein, 12 aa, Homo sapiens
LDALCNIHENIR

SEQ ID NO: 42321 - protein, 15 aa, Homo sapiens
LLELGPKPEVAQQTR

SEQ ID NO: 42322 - protein, 15 aa, Homo sapiens
LLHDQVGVIQFGPYK

SEQ ID NO: 42323 - protein, 22 aa, Homo sapiens
LLQPPAPIMPLDTNWPLLTVSK

SEQ ID NO: 42324 - protein, 20 aa, Homo sapiens
SLAYLTAATHGLDEEAESLK

SEQ ID NO: 42325 - protein, 27 aa, Homo sapiens
SLAYLTAATHGLDEEAESLKETFDPEK

SEQ ID NO: 42326 - protein, 20 aa, Homo sapiens
VQVPNCDEIFYAGTGNLLLR

SEQ ID NO: 42327 - protein, 15 aa, Homo sapiens
EHEEHVCSILASLLR

SEQ ID NO: 42328 - protein, 20 aa, Homo sapiens
ELLGELDGIDVLLQQLSVFK

SEQ ID NO: 42329 - protein, 21 aa, Homo sapiens
VGTTEKEHEEHVCSILASLLR

SEQ ID NO: 42330 - protein, 22 aa, Homo sapiens
RGLDIPLLDNVINYSFPAKGKL

SEQ ID NO: 42331 - protein, 26 aa, Homo sapiens
RSRATIFEINASSRDLCSQVMRAKRQ

SEQ ID NO: 42332 - protein, 10 aa, Homo sapiens
ILQIITELIK

SEQ ID NO: 42333 - protein, 20 aa, Homo sapiens
KKPPVATEGESALNFNLFEK

SEQ ID NO: 42334 - protein, 19 aa, Homo sapiens
KGLGAQTGVLRMKGVNLSC

SEQ ID NO: 42335 - protein, 21 aa, Homo sapiens
RDPNIEALNGNCSDTEIHEKE

SEQ ID NO: 42336 - protein, 16 aa, Homo sapiens
GQTCVVHYTGMLEDGK

SEQ ID NO: 42337 - protein, 17 aa, Homo sapiens
GQTCVVHYTGMLEDGKK

SEQ ID NO: 42338 - protein, 13 aa, Homo sapiens
GVQVETISPGDGR

SEQ ID NO: 42339 - protein, 14 aa, Homo sapiens
GWEEGVAQMSVGQR

SEQ ID NO: 42340 - protein, 32 aa, Homo sapiens
LTISPDYAYGATGHPGIIPPHATLVFDVELLK

SEQ ID NO: 42341 - protein, 17 aa, Homo sapiens
RGQTCVVHYTGMLEDGK

SEQ ID NO: 42342 - protein, 18 aa, Homo sapiens
RGQTCVVHYTGMLEDGKK

SEQ ID NO: 42343 - protein, 10 aa, Homo sapiens
DFLLQQTMLR

SEQ ID NO: 42344 - protein, 7 aa, Homo sapiens
FEELGVK

SEQ ID NO: 42345 - protein, 17 aa, Homo sapiens
GFGHIGIAVPDVYSACK

SEQ ID NO: 42346 - protein, 20 aa, Homo sapiens
GLAFIQDPDGYWIEILNPNK

SEQ ID NO: 42347 - protein, 7 aa, Homo sapiens
IAWALSR

SEQ ID NO: 42348 - protein, 8 aa, Homo sapiens
KSLDFYTR

SEQ ID NO: 42349 - protein, 8 aa, Homo sapiens
RFEELGVK

SEQ ID NO: 42350 - protein, 9 aa, Homo sapiens
VLGMTLIQK

SEQ ID NO: 42351 - protein, 19 aa, Homo sapiens
QIVIKMFQNISNIIKSGKM

SEQ ID NO: 42352 - protein, 12 aa, Homo sapiens
EFRPEDQPWLLR

SEQ ID NO: 42353 - protein, 20 aa, Homo sapiens
GNSRPGTPSAEGGSTSSTLR

SEQ ID NO: 42354 - protein, 25 aa, Homo sapiens
ALQEASEAYLVGLFEDTNLCAIHAK

SEQ ID NO: 42355 - protein, 7 aa, Homo sapiens
EIAQDFK

SEQ ID NO: 42356 - protein, 32 aa, Homo sapiens
FQSAAIGALQEASEAYLVGLFEDTNLCAIHAK

SEQ ID NO: 42357 - protein, 26 aa, Homo sapiens
GALQEASEAYLVGLFEDTNLCAIHAK

SEQ ID NO: 42358 - protein, 16 aa, Homo sapiens
LVGLFEDTNLCAIHAK

SEQ ID NO: 42359 - protein, 13 aa, Homo sapiens
RVTIMPKDIQLAR

SEQ ID NO: 42360 - protein, 11 aa, Homo sapiens
RYQKSTELLIR

SEQ ID NO: 42361 - protein, 30 aa, Homo sapiens
SAAIGALQEASEAYLVGLFEDTNLCAIHAK

SEQ ID NO: 42362 - protein, 7 aa, Homo sapiens
STELLIR

SEQ ID NO: 42363 - protein, 10 aa, Homo sapiens
YQKSTELLIR

SEQ ID NO: 42364 - protein, 9 aa, Homo sapiens
YRPGTVALR

SEQ ID NO: 42365 - protein, 11 aa, Homo sapiens
CMFNHVAVAAR

SEQ ID NO: 42366 - protein, 24 aa, Homo sapiens
LVLPIAYEFNPELVLVSAGFDAAR

SEQ ID NO: 42367 - protein, 20 aa, Homo sapiens
PATEAELLTCHSAEYVGHLR

SEQ ID NO: 42368 - protein, 22 aa, Homo sapiens
SAQASVSCALEALEPFWEVLVR

SEQ ID NO: 42369 - protein, 17 aa, Homo sapiens
RTGEGFLCVFAINNTKS

SEQ ID NO: 42370 - protein, 25 aa, Homo sapiens
SALTIQLIQNHFVDEYDPTIEDSYR

SEQ ID NO: 42371 - protein, 15 aa, Homo sapiens
TGEGFLCVFAINNTK

SEQ ID NO: 42372 - protein, 22 aa, Homo sapiens
AAAIGIDLGTTYSCVGVFQHGK

SEQ ID NO: 42373 - protein, 26 aa, Homo sapiens
AEAYLGYPVTNAVITVPAYFNDSQRQ

SEQ ID NO: 42374 - protein, 14 aa, Homo sapiens
AQIHDLVLVGGSTR

SEQ ID NO: 42375 - protein, 12 aa, Homo sapiens
ARFEELCSDLFR

SEQ ID NO: 42376 - protein, 16 aa, Homo sapiens
ATAGDTHLGGEDFDNR

SEQ ID NO: 42377 - protein, 22 aa, Homo sapiens
CQEVISWLDANTLAEKDEFEHK

SEQ ID NO: 42378 - protein, 12 aa, Homo sapiens
DAGVIAGLNVLR

SEQ ID NO: 42379 - protein, 27 aa, Homo sapiens
EIAEAYLGYPVTNAVITVPAYFNDSQR

SEQ ID NO: 42380 - protein, 31 aa, Homo sapiens
ELEQVCNPIISGLYQGAGGPGPGGFGAQGPK

SEQ ID NO: 42381 - protein, 10 aa, Homo sapiens
FEELCSDLFR

SEQ ID NO: 42382 - protein, 14 aa, Homo sapiens
GKVEIIANDQGNRT

SEQ ID NO: 42383 - protein, 24 aa, Homo sapiens
GVPQIEVTFDIDANGILNVTATDK

SEQ ID NO: 42384 - protein, 14 aa, Homo sapiens
HWPFQVINDGDKPK

SEQ ID NO: 42385 - protein, 16 aa, Homo sapiens
IINEPTAAAIAYGLDR

SEQ ID NO: 42386 - protein, 7 aa, Homo sapiens
ITITNDK

SEQ ID NO: 42387 - protein, 9 aa, Homo sapiens
ITITNDKGR

SEQ ID NO: 42388 - protein, 9 aa, Homo sapiens
LLQDFFNGR

SEQ ID NO: 42389 - protein, 8 aa, Homo sapiens
LSKEEIER

SEQ ID NO: 42390 - protein, 10 aa, Homo sapiens
LVNHFVEEFK

SEQ ID NO: 42391 - protein, 11 aa, Homo sapiens
LVNHFVEEFKR

SEQ ID NO: 42392 - protein, 15 aa, Homo sapiens
NAVITVPAYFNDSQR

SEQ ID NO: 42393 - protein, 15 aa, Homo sapiens
NQVALNPQNTVFDAK

SEQ ID NO: 42394 - protein, 16 aa, Homo sapiens
NQVALNPQNTVFDAKR

SEQ ID NO: 42395 - protein, 11 aa, Homo sapiens
PSYVAFTDTER

SEQ ID NO: 42396 - protein, 10 aa, Homo sapiens
SCVGVFQHGK

SEQ ID NO: 42397 - protein, 16 aa, Homo sapiens
SDNQPGVLIQVYEGER

SEQ ID NO: 42398 - protein, 31 aa, Homo sapiens
SENVQDLLLLDVAPLSLGLETAGGVMTALIK

SEQ ID NO: 42399 - protein, 13 aa, Homo sapiens
TTPSYVAFTDTER

SEQ ID NO: 42400 - protein, 11 aa, Homo sapiens
VEIIANDQGNR

SEQ ID NO: 42401 - protein, 9 aa, Homo sapiens
YKAEDEVQR

SEQ ID NO: 42402 - protein, 7 aa, Homo sapiens
APSFWYK

SEQ ID NO: 42403 - protein, 21 aa, Homo sapiens
CYLITVTPVYADGPGSPESIK

SEQ ID NO: 42404 - protein, 12 aa, Homo sapiens
DNMLWVEWTTPR

SEQ ID NO: 42405 - protein, 11 aa, Homo sapiens
ETHLETNFTLK

SEQ ID NO: 42406 - protein, 21 aa, Homo sapiens
GYWSDWSEEASGITYEDRPSK

SEQ ID NO: 42407 - protein, 10 aa, Homo sapiens
IDPSHTQGYR

SEQ ID NO: 42408 - protein, 10 aa, Homo sapiens
ILDYEVTLTR

SEQ ID NO: 42409 - protein, 14 aa, Homo sapiens
KSHLQNYTVNATKL

SEQ ID NO: 42410 - protein, 24 aa, Homo sapiens
KVKPNPPHNLSVINSEELSSILKL

SEQ ID NO: 42411 - protein, 9 aa, Homo sapiens
LTWTNPSIK

SEQ ID NO: 42412 - protein, 13 aa, Homo sapiens
RETHLETNFTLKS

SEQ ID NO: 42413 - protein, 19 aa, Homo sapiens
RTIIGNETAVNVDSSHTEY

SEQ ID NO: 42414 - protein, 23 aa, Homo sapiens
SDAAVLTIPACDFQATHPVMDLK

SEQ ID NO: 42415 - protein, 17 aa, Homo sapiens
SSFTVQDLKPFTEYVFR

SEQ ID NO: 42416 - protein, 8 aa, Homo sapiens
TNHFTIPK

SEQ ID NO: 42417 - protein, 7 aa, Homo sapiens
TVQLVWK

SEQ ID NO: 42418 - protein, 13 aa, Homo sapiens
VTSDHINFDPVYK

SEQ ID NO: 42419 - protein, 8 aa, Homo sapiens
YLATLTVR

SEQ ID NO: 42420 - protein, 31 aa, Homo sapiens
RSASLSSLLITPFPSPNSSLTRSCASSYQRR

SEQ ID NO: 42421 - protein, 19 aa, Homo sapiens
ALELNLTDSENATCLYAKW

SEQ ID NO: 42422 - protein, 9 aa, Homo sapiens
CNSLSTLEK

SEQ ID NO: 42423 - protein, 12 aa, Homo sapiens
GILTVDELLAIR

SEQ ID NO: 42424 - protein, 17 aa, Homo sapiens
IAVQFGPGFSWIANFTK

SEQ ID NO: 42425 - protein, 8 aa, Homo sapiens
IPLNDLFR

SEQ ID NO: 42426 - protein, 23 aa, Homo sapiens
ISDHGTVTYNGSICGDDQNGPKI

SEQ ID NO: 42427 - protein, 30 aa, Homo sapiens
KAASTYSIDSVSFSYNTGDNTTFPDAEDKG

SEQ ID NO: 42428 - protein, 19 aa, Homo sapiens
KIAVQFGPGFSWIANFTKA

SEQ ID NO: 42429 - protein, 21 aa, Homo sapiens
KVASVININPNTTHSTGSCRS

SEQ ID NO: 42430 - protein, 10 aa, Homo sapiens
KWQMNFTVRY

SEQ ID NO: 42431 - protein, 12 aa, Homo sapiens
RVQPFNVTQGKY

SEQ ID NO: 42432 - protein, 7 aa, Homo sapiens
SHTALLR

SEQ ID NO: 42433 - protein, 19 aa, Homo sapiens
VASVININPNTTHSTGSCR

SEQ ID NO: 42434 - protein, 8 aa, Homo sapiens
WQMNFTVR

SEQ ID NO: 42435 - protein, 9 aa, Homo sapiens
YLDFVFAVK

SEQ ID NO: 42436 - protein, 14 aa, Homo sapiens
RKVLINNSLDEPRA

SEQ ID NO: 42437 - protein, 13 aa, Homo sapiens
AVTVMVAWMPQGR

SEQ ID NO: 42438 - protein, 20 aa, Homo sapiens
SEGTPEKPLYHPCVCTGSIK

SEQ ID NO: 42439 - protein, 28 aa, Homo sapiens
RLGKPSVMTPTEGLDTGEMSNSTSSLKR

SEQ ID NO: 42440 - protein, 13 aa, Homo sapiens
ASGSPEPAISWFR

SEQ ID NO: 42441 - protein, 14 aa, Homo sapiens
GQHGSSSLHIKDVK

SEQ ID NO: 42442 - protein, 18 aa, Homo sapiens
IEVKGQHGSSSLHIKDVK

SEQ ID NO: 42443 - protein, 14 aa, Homo sapiens
KLVLPAKNTTNLKT

SEQ ID NO: 42444 - protein, 15 aa, Homo sapiens
LTIYNANIEDAGIYR

SEQ ID NO: 42445 - protein, 11 aa, Homo sapiens
QCGLLMCITRR

SEQ ID NO: 42446 - protein, 18 aa, Homo sapiens
RFAMLANNNLQILNINKS

SEQ ID NO: 42447 - protein, 24 aa, Homo sapiens
RSHGVQTMVVLNNLEPNTTYEIRV

SEQ ID NO: 42448 - protein, 14 aa, Homo sapiens
RYNCTATNHIGTRF

SEQ ID NO: 42449 - protein, 10 aa, Homo sapiens
SNPPASIHWR

SEQ ID NO: 42450 - protein, 9 aa, Homo sapiens
VELSVGESK

SEQ ID NO: 42451 - protein, 21 aa, Homo sapiens
DVPNPNQDDDDDEGFSFNPLK

SEQ ID NO: 42452 - protein, 22 aa, Homo sapiens
ILDIVPPTFSALCPANPTCIYK

SEQ ID NO: 42453 - protein, 24 aa, Homo sapiens
SACSLESNLEGLAGVLEADLPNYK

SEQ ID NO: 42454 - protein, 30 aa, Homo sapiens
THVPMLQVWTADKPHPQEEYLDCLWAQIQK

SEQ ID NO: 42455 - protein, 17 aa, Homo sapiens
TSDANETEDHLESLICK

SEQ ID NO: 42456 - protein, 12 aa, Homo sapiens
APGFAHLAGLDK

SEQ ID NO: 42457 - protein, 22 aa, Homo sapiens
ETAHWKPPPWNDVDPPKDTIVK

SEQ ID NO: 42458 - protein, 23 aa, Homo sapiens
IRPGGVHQDLPLGLMDDIYQFSK

SEQ ID NO: 42459 - protein, 18 aa, Homo sapiens
NITLNFGPQHPAAHGVLR

SEQ ID NO: 42460 - protein, 19 aa, Homo sapiens
TQPYDVYDQVEFDVPVGSR

SEQ ID NO: 42461 - protein, 11 aa, Homo sapiens
TSMESLIHHFK

SEQ ID NO: 42462 - protein, 19 aa, Homo sapiens
VWIKPGAEQSFLYGNHVLK

SEQ ID NO: 42463 - protein, 20 aa, Homo sapiens
YIGENLQLLVDRPDGTYCFR

SEQ ID NO: 42464 - protein, 28 aa, Homo sapiens
RFPGVMENLTISAAHWLTAPAPRPRPRR

SEQ ID NO: 42465 - protein, 17 aa, Homo sapiens
LPGGELNPGEDEVEGLK

SEQ ID NO: 42466 - protein, 18 aa, Homo sapiens
LPGGELNPGEDEVEGLKR

SEQ ID NO: 42467 - protein, 15 aa, Homo sapiens
LPHVLLLQLGTTFFK

SEQ ID NO: 42468 - protein, 19 aa, Homo sapiens
PNFEPPQYPYIPAHITKPK

SEQ ID NO: 42469 - protein, 19 aa, Homo sapiens
QDGVLQDWVIDDCIGNWWR

SEQ ID NO: 42470 - protein, 12 aa, Homo sapiens
TVEGVLIVHEHR

SEQ ID NO: 42471 - protein, 24 aa, Homo sapiens
HAAWYPSEILDPHVVLLTSDNVIR

SEQ ID NO: 42472 - protein, 17 aa, Homo sapiens
LLHSFHSELPVLSDSER

SEQ ID NO: 42473 - protein, 15 aa, Homo sapiens
GFGFVCFSSPEEATK

SEQ ID NO: 42474 - protein, 15 aa, Homo sapiens
GYGFVHFETQEAAER

SEQ ID NO: 42475 - protein, 24 aa, Homo sapiens
ITGMLLEIDNSELLHMLESPESLR

SEQ ID NO: 42476 - protein, 14 aa, Homo sapiens
IVATKPLYVALAQR

SEQ ID NO: 42477 - protein, 15 aa, Homo sapiens
LFPLIQAMHPTLAGK

SEQ ID NO: 42478 - protein, 16 aa, Homo sapiens
SKVDEAVAVLQAHQAK

SEQ ID NO: 42479 - protein, 17 aa, Homo sapiens
SLGYAYVNFQQPADAER

SEQ ID NO: 42480 - protein, 14 aa, Homo sapiens
VDEAVAVLQAHQAK

SEQ ID NO: 42481 - protein, 13 aa, Homo sapiens
ADFAQACQDAGVR

SEQ ID NO: 42482 - protein, 9 aa, Homo sapiens
AGTHILCIK

SEQ ID NO: 42483 - protein, 38 aa, Homo sapiens
AIAIAAGVPVVPGTDAPITSLHEAHEFSNTYGFPIIFK

SEQ ID NO: 42484 - protein, 24 aa, Homo sapiens
HGEEVTPEDVLSAAMYPDVFAHFK

SEQ ID NO: 42485 - protein, 24 aa, Homo sapiens
ATFHTPFSHLGQSPEGCSSYTFPK

SEQ ID NO: 42486 - protein, 15 aa, Homo sapiens
LHAVNAEECNVLQGR

SEQ ID NO: 42487 - protein, 23 aa, Homo sapiens
LTAGEACAQGLVTEVFPDSTFQK

SEQ ID NO: 42488 - protein, 17 aa, Homo sapiens
RRNASGLTNGLSSQERP

SEQ ID NO: 42489 - protein, 14 aa, Homo sapiens
ADLDKLNIDSIIQR

SEQ ID NO: 42490 - protein, 14 aa, Homo sapiens
AHQVVEDGYEFFAK

SEQ ID NO: 42491 - protein, 12 aa, Homo sapiens
AVAHHTTAAFIR

SEQ ID NO: 42492 - protein, 13 aa, Homo sapiens
ELLKPNASVALHK

SEQ ID NO: 42493 - protein, 18 aa, Homo sapiens
ENAPAIIFIDEIDAIATK

SEQ ID NO: 42494 - protein, 33 aa, Homo sapiens
IQSIPLVIGQFLEAVDQNTAIVGSTTGSNYYVR

SEQ ID NO: 42495 - protein, 20 aa, Homo sapiens
LQQELEFLEVQEEYIKDEQK

SEQ ID NO: 42496 - protein, 18 aa, Homo sapiens
MNLSEEVDLEDYVARPDK

SEQ ID NO: 42497 - protein, 21 aa, Homo sapiens
PQTGLSFLGPEPEDLEDLYSR

SEQ ID NO: 42498 - protein, 16 aa, Homo sapiens
MEVNGQNFENITFMKA

SEQ ID NO: 42499 - protein, 24 aa, Homo sapiens
DQFPEVYVPTVFENYIADIEVDGK

SEQ ID NO: 42500 - protein, 14 aa, Homo sapiens
HFCPNVPIILVGNK

SEQ ID NO: 42501 - protein, 15 aa, Homo sapiens
HFCPNVPIILVGNKK

SEQ ID NO: 42502 - protein, 12 aa, Homo sapiens
ISAFGYLECSAK

SEQ ID NO: 42503 - protein, 15 aa, Homo sapiens
KHFCPNVPIILVGNK

SEQ ID NO: 42504 - protein, 16 aa, Homo sapiens
LRPLSYPDTDVILMCF

SEQ ID NO: 42505 - protein, 30 aa, Homo sapiens
LRPLSYPDTDVILMCFSIDSPDSLENIPEK

SEQ ID NO: 42506 - protein, 11 aa, Homo sapiens
LVIVGDGACGK

SEQ ID NO: 42507 - protein, 26 aa, Homo sapiens
RGSCQRSGPLGDQPFAGLLPKNLSRE

SEQ ID NO: 42508 - protein, 8 aa, Homo sapiens
KHRDVIEK

SEQ ID NO: 42509 - protein, 33 aa, Homo sapiens
DHLSFRSYYFPVKNVIDGDLCEQFNSMEPNKQK

SEQ ID NO: 42510 - protein, 24 aa, Homo sapiens
ELAAEMAAAFLNENLPESIFGAPK

SEQ ID NO: 42511 - protein, 25 aa, Homo sapiens
FVIHPESNNLIIIETDHNAYTEATK

SEQ ID NO: 42512 - protein, 15 aa, Homo sapiens
HIANYISGIQTIGHR

SEQ ID NO: 42513 - protein, 26 aa, Homo sapiens
KFVIHPESNNLIIIETDHNAYTEATK

SEQ ID NO: 42514 - protein, 36 aa, Homo sapiens
YSEPLEEHGNFLITVPGGSDGPSGVLICSENYITYK

SEQ ID NO: 42515 - protein, 16 aa, Homo sapiens
DIPFSAIYFPVYAHCK

SEQ ID NO: 42516 - protein, 20 aa, Homo sapiens
HLNYTEFTQFLQELQLEHAR

SEQ ID NO: 42517 - protein, 24 aa, Homo sapiens
YGQVTPLEIDILYQLADLYNASGR

SEQ ID NO: 42518 - protein, 17 aa, Homo sapiens
KDSNKDGNGDLKGIQDK

SEQ ID NO: 42519 - protein, 36 aa, Homo sapiens
KSPMQWDNSSNAGFSEASNTWLPTNSDYHTVNVDVQ

SEQ ID NO: 42520 - protein, 13 aa, Homo sapiens
RIVDVNLTSEGKV

SEQ ID NO: 42521 - protein, 26 aa, Homo sapiens
SISHYHETLGEALQGVELEFSGLDIK

SEQ ID NO: 42522 - protein, 16 aa, Homo sapiens
VNGYFGGSLYARQGGR

SEQ ID NO: 42523 - protein, 24 aa, Homo sapiens
FSFCCSPEPEAEAEAAAGPGPCER

SEQ ID NO: 42524 - protein, 18 aa, Homo sapiens
LAFPSPFGHLSEGFSHSR

SEQ ID NO: 42525 - protein, 18 aa, Homo sapiens
VAALFPALRPGGFQAHYR

SEQ ID NO: 42526 - protein, 14 aa, Homo sapiens
VICDGCNGPVVGTR

SEQ ID NO: 42527 - protein, 14 aa, Homo sapiens
MNNTAASPMSTATS

SEQ ID NO: 42528 - protein, 9 aa, Homo sapiens
AAQASDLEK

SEQ ID NO: 42529 - protein, 15 aa, Homo sapiens
AAQASDLEKIHLDEK

SEQ ID NO: 42530 - protein, 18 aa, Homo sapiens
AAQASDLEKIHLDEKSFR

SEQ ID NO: 42531 - protein, 13 aa, Homo sapiens
ALAGCDFLTISPK

SEQ ID NO: 42532 - protein, 11 aa, Homo sapiens
ILDWHVANTDK

SEQ ID NO: 42533 - protein, 12 aa, Homo sapiens
ILDWHVANTDKK

SEQ ID NO: 42534 - protein, 11 aa, Homo sapiens
LFVLFGAEILK

SEQ ID NO: 42535 - protein, 10 aa, Homo sapiens
LGGSQEDQIK

SEQ ID NO: 42536 - protein, 11 aa, Homo sapiens
LLGELLQDNAK

SEQ ID NO: 42537 - protein, 11 aa, Homo sapiens
LSFDKDAMVAR

SEQ ID NO: 42538 - protein, 8 aa, Homo sapiens
LVPVLSAK

SEQ ID NO: 42539 - protein, 11 aa, Homo sapiens
SYEPLEDPGVK

SEQ ID NO: 42540 - protein, 12 aa, Homo sapiens
WLHNEDQMAVEK

SEQ ID NO: 42541 - protein, 23 aa, Homo sapiens
MYKNTLWIESANNTGNIITRDRT

SEQ ID NO: 42542 - protein, 14 aa, Homo sapiens
AIIVDGHSVEELCK

SEQ ID NO: 42543 - protein, 9 aa, Homo sapiens
AVELAANTK

SEQ ID NO: 42544 - protein, 21 aa, Homo sapiens
CEAFGWHAIIVDGHSVEELCK

SEQ ID NO: 42545 - protein, 8 aa, Homo sapiens
DAIAQAVR

SEQ ID NO: 42546 - protein, 24 aa, Homo sapiens
DDQVTVIGAGVTLHEALAAAELLK

SEQ ID NO: 42547 - protein, 10 aa, Homo sapiens
ESWHGKPLPK

SEQ ID NO: 42548 - protein, 17 aa, Homo sapiens
GAGVTLHEALAAAELLK

SEQ ID NO: 42549 - protein, 18 aa, Homo sapiens
GITGVEDKESWHGKPLPK

SEQ ID NO: 42550 - protein, 17 aa, Homo sapiens
GWHAIIVDGHSVEELCK

SEQ ID NO: 42551 - protein, 9 aa, Homo sapiens
HQPTAIIAK

SEQ ID NO: 42552 - protein, 9 aa, Homo sapiens
IIALDGDTK

SEQ ID NO: 42553 - protein, 19 aa, Homo sapiens
ILATPPQEDAPSVDIANIR

SEQ ID NO: 42554 - protein, 36 aa, Homo sapiens
ILTVEDHYYEGGIGEAVSSAVVGEPGITVTHLAVNR

SEQ ID NO: 42555 - protein, 12 aa, Homo sapiens
ISSDLDGHPVPK

SEQ ID NO: 42556 - protein, 18 aa, Homo sapiens
ISSIQATTAAGSGHPTSC

SEQ ID NO: 42557 - protein, 34 aa, Homo sapiens
ISSIQATTAAGSGHPTSCCSAAEIMAVLFFHTMR

SEQ ID NO: 42558 - protein, 9 aa, Homo sapiens
KAYGQALAK

SEQ ID NO: 42559 - protein, 21 aa, Homo sapiens
KKILATPPQEDAPSVDIANIR

SEQ ID NO: 42560 - protein, 8 aa, Homo sapiens
KLILDSAR

SEQ ID NO: 42561 - protein, 12 aa, Homo sapiens
LDNLVAILDINR

SEQ ID NO: 42562 - protein, 18 aa, Homo sapiens
LGQSDPAPLQHQMDIYQK

SEQ ID NO: 42563 - protein, 37 aa, Homo sapiens
MAAISESNINLCGSHCGVSIGEDGPSQMALEDLAMFR

SEQ ID NO: 42564 - protein, 6 aa, Homo sapiens
MFGIDR

SEQ ID NO: 42565 - protein, 14 aa, Homo sapiens
MFGIDRDAIAQAVR

SEQ ID NO: 42566 - protein, 17 aa, Homo sapiens
NMAEQIIQEIYSQIQSK

SEQ ID NO: 42567 - protein, 10 aa, Homo sapiens
NSTFSEIFKK

SEQ ID NO: 42568 - protein, 12 aa, Homo sapiens
PFCSTFAAFFTR

SEQ ID NO: 42569 - protein, 15 aa, Homo sapiens
PPQEDAPSVDIANIR

SEQ ID NO: 42570 - protein, 16 aa, Homo sapiens
PTSTVFYPSDGVATEK

SEQ ID NO: 42571 - protein, 26 aa, Homo sapiens
QAFTDVATGSLGQGLGAACGMAYTGK

SEQ ID NO: 42572 - protein, 22 aa, Homo sapiens
RCEAFGWHAIIVDGHSVEELCK

SEQ ID NO: 42573 - protein, 9 aa, Homo sapiens
SGKPAELLK

SEQ ID NO: 42574 - protein, 26 aa, Homo sapiens
SKDDQVTVIGAGVTLHEALAAAELLK

SEQ ID NO: 42575 - protein, 18 aa, Homo sapiens
SVPTSTVFYPSDGVATEK

SEQ ID NO: 42576 - protein, 27 aa, Homo sapiens
SVPTSTVFYPSDGVATEKAVELAANTK

SEQ ID NO: 42577 - protein, 22 aa, Homo sapiens
TSRPENAIIYNNNEDFQVGQAK

SEQ ID NO: 42578 - protein, 14 aa, Homo sapiens
TVPFCSTFAAFFTR

SEQ ID NO: 42579 - protein, 12 aa, Homo sapiens
VLDPFTIKPLDR

SEQ ID NO: 42580 - protein, 19 aa, Homo sapiens
LKMKFTNILESSFLMNNKS

SEQ ID NO: 42581 - protein, 27 aa, Homo sapiens
KDLKSWVQGNLTACGRSLFLFDEMDKM

SEQ ID NO: 42582 - protein, 15 aa, Homo sapiens
ILTNWGHPEYTCIYR

SEQ ID NO: 42583 - protein, 13 aa, Homo sapiens
IRPTAVTLEHVPK

SEQ ID NO: 42584 - protein, 18 aa, Homo sapiens
AGAKPDQIGIITPYEGQR

SEQ ID NO: 42585 - protein, 17 aa, Homo sapiens
DGPLGETVLECYNCGCR

SEQ ID NO: 42586 - protein, 16 aa, Homo sapiens
DINWDSSQWQPLIQDR

SEQ ID NO: 42587 - protein, 25 aa, Homo sapiens
DLPIHACSYCGIHDPACVVYCNTSK

SEQ ID NO: 42588 - protein, 11 aa, Homo sapiens
EKDFIILSCVR

SEQ ID NO: 42589 - protein, 25 aa, Homo sapiens
ENPSATLEDLEKPGVDEEPQHVLLR

SEQ ID NO: 42590 - protein, 18 aa, Homo sapiens
FTAQGLPDLNHSQVYAVK

SEQ ID NO: 42591 - protein, 11 aa, Homo sapiens
NVFLLGFIPAK

SEQ ID NO: 42592 - protein, 22 aa, Homo sapiens
QGNGPVLVCAPSNIAVDQLTEK

SEQ ID NO: 42593 - protein, 24 aa, Homo sapiens
SILIDESTQATEPECMVPVVLGAK

SEQ ID NO: 42594 - protein, 22 aa, Homo sapiens
AYVESICSNNFDSFLHETHENK

SEQ ID NO: 42595 - protein, 15 aa, Homo sapiens
DQVYPQYVIEYTEDK

SEQ ID NO: 42596 - protein, 19 aa, Homo sapiens
EHGLNPDVVQNIQDICNSK

SEQ ID NO: 42597 - protein, 9 aa, Homo sapiens
IENSELLDK

SEQ ID NO: 42598 - protein, 9 aa, Homo sapiens
LHICDHFTR

SEQ ID NO: 42599 - protein, 13 aa, Homo sapiens
LSEIHHLHPEYVR

SEQ ID NO: 42600 - protein, 18 aa, Homo sapiens
NSNVDSSYLESLYQSCPR

SEQ ID NO: 42601 - protein, 12 aa, Homo sapiens
QQICNQQPPCSR

SEQ ID NO: 42602 - protein, 12 aa, Homo sapiens
SCTPSPDQISHR

SEQ ID NO: 42603 - protein, 8 aa, Homo sapiens
VHFHLPYR

SEQ ID NO: 42604 - protein, 13 aa, Homo sapiens
YCQRPCDNLHLCK

SEQ ID NO: 42605 - protein, 11 aa, Homo sapiens
KKAITANISIG

SEQ ID NO: 42606 - protein, 29 aa, Homo sapiens
MMLVFGEMTDIFANAGNLEDLMSNITNRS

SEQ ID NO: 42607 - protein, 14 aa, Homo sapiens
AKPAMPQDSVPSPR

SEQ ID NO: 42608 - protein, 16 aa, Homo sapiens
DLVSSLTSGLLTIGDR

SEQ ID NO: 42609 - protein, 20 aa, Homo sapiens
EEADEYIDIGALNGIFVLGR

SEQ ID NO: 42610 - protein, 9 aa, Homo sapiens
EHEVTIFVR

SEQ ID NO: 42611 - protein, 11 aa, Homo sapiens
FICTTSAIQNR

SEQ ID NO: 42612 - protein, 17 aa, Homo sapiens
GKLGLVGVNLTLDGVKS

SEQ ID NO: 42613 - protein, 19 aa, Homo sapiens
GVTIIGPATVGGIKPGCFK

SEQ ID NO: 42614 - protein, 10 aa, Homo sapiens
HLLVHAPEDK

SEQ ID NO: 42615 - protein, 15 aa, Homo sapiens
IGNTGGMLDNILASK

SEQ ID NO: 42616 - protein, 15 aa, Homo sapiens
KHPEVDVLINFASLR

SEQ ID NO: 42617 - protein, 9 aa, Homo sapiens
LGQEATVGK

SEQ ID NO: 42618 - protein, 22 aa, Homo sapiens
LLQDHPWLLSQNLVVKPDQLIK

SEQ ID NO: 42619 - protein, 12 aa, Homo sapiens
LYRPGSVAYVSR

SEQ ID NO: 42620 - protein, 21 aa, Homo sapiens
NFLIEPFVPHSQAEEFYVCIY

SEQ ID NO: 42621 - protein, 24 aa, Homo sapiens
NFLIEPFVPHSQAEEFYVCIYATR

SEQ ID NO: 42622 - protein, 17 aa, Homo sapiens
QHFPATPLLDYALEVEK

SEQ ID NO: 42623 - protein, 14 aa, Homo sapiens
SGGMSNELNNIISR

SEQ ID NO: 42624 - protein, 12 aa, Homo sapiens
SMGFIGHYLDQK

SEQ ID NO: 42625 - protein, 23 aa, Homo sapiens
SSEVQFGHAGACANQASETAVAK

SEQ ID NO: 42626 - protein, 17 aa, Homo sapiens
TASFSESRADEVAPAKK

SEQ ID NO: 42627 - protein, 15 aa, Homo sapiens
TIAIIAEGIPEALTR

SEQ ID NO: 42628 - protein, 10 aa, Homo sapiens
VDATADYICK

SEQ ID NO: 42629 - protein, 17 aa, Homo sapiens
DWSFYLLYYTEFTPTEK

SEQ ID NO: 42630 - protein, 7 aa, Homo sapiens
HPAENGK

SEQ ID NO: 42631 - protein, 29 aa, Homo sapiens
HPAENGKSNFLNCYVSGFHPSDIEVDLLK

SEQ ID NO: 42632 - protein, 13 aa, Homo sapiens
IEKVEHSDLSFSK

SEQ ID NO: 42633 - protein, 19 aa, Homo sapiens
IQRTPKIQVYSRHPAENGK

SEQ ID NO: 42634 - protein, 11 aa, Homo sapiens
IQVYSRHPAEN

SEQ ID NO: 42635 - protein, 13 aa, Homo sapiens
IQVYSRHPAENGK

SEQ ID NO: 42636 - protein, 8 aa, Homo sapiens
IVKWDRDM

SEQ ID NO: 42637 - protein, 12 aa, Homo sapiens
LLYYTEFTPTEK

SEQ ID NO: 42638 - protein, 14 aa, Homo sapiens
SGFHPSDIEVDLLK

SEQ ID NO: 42639 - protein, 22 aa, Homo sapiens
SNFLNCYVSGFHPSDIEVDLLK

SEQ ID NO: 42640 - protein, 9 aa, Homo sapiens
TPKIQVYSR

SEQ ID NO: 42641 - protein, 16 aa, Homo sapiens
TPKIQVYSRHPAENGK

SEQ ID NO: 42642 - protein, 10 aa, Homo sapiens
VEHSDLSFSK

SEQ ID NO: 42643 - protein, 10 aa, Homo sapiens
VNHVTLSQPK

SEQ ID NO: 42644 - protein, 13 aa, Homo sapiens
VNHVTLSQPKIVK

SEQ ID NO: 42645 - protein, 16 aa, Homo sapiens
VNHVTLSQPKIVKWDR

SEQ ID NO: 42646 - protein, 18 aa, Homo sapiens
VNHVTLSQPKIVKWDRDM

SEQ ID NO: 42647 - protein, 15 aa, Homo sapiens
VSGFHPSDIEVDLLK

SEQ ID NO: 42648 - protein, 15 aa, Homo sapiens
YTEFTPTEKDEYACR

SEQ ID NO: 42649 - protein, 19 aa, Homo sapiens
RTESQLTPCIRNVTSPTRQ

SEQ ID NO: 42650 - protein, 21 aa, Homo sapiens
KEEQHANTSANYDVELLHHKD

SEQ ID NO: 42651 - protein, 15 aa, Homo sapiens
MNGTSSQPKKEEYGS

SEQ ID NO: 42652 - protein, 28 aa, Homo sapiens
PFKYIYELNNVTPLDNLLNLSNEILNAS

SEQ ID NO: 42653 - protein, 16 aa, Homo sapiens
GVGAFNLTLSMLPTRI

SEQ ID NO: 42654 - protein, 16 aa, Homo sapiens
GHDLNEDGLVSWEEYK

SEQ ID NO: 42655 - protein, 19 aa, Homo sapiens
IDGDKDGFVTVDELKDWIK

SEQ ID NO: 42656 - protein, 22 aa, Homo sapiens
KNATYGYVLDDPDPDDGFNYKQ

SEQ ID NO: 42657 - protein, 11 aa, Homo sapiens
TFDQLTPEESK

SEQ ID NO: 42658 - protein, 22 aa, Homo sapiens
VHNDAQSFDYDHDAFLGAEEAK

SEQ ID NO: 42659 - protein, 28 aa, Homo sapiens
MRKLHLGSSLDSSNASVSSSLSLASQKD

SEQ ID NO: 42660 - protein, 11 aa, Homo sapiens
AVAQALEVIPR

SEQ ID NO: 42661 - protein, 22 aa, Homo sapiens
HTQENCETWGVNGETGTLVDMK

SEQ ID NO: 42662 - protein, 9 aa, Homo sapiens
IDDIVSGHK

SEQ ID NO: 42663 - protein, 13 aa, Homo sapiens
IGDEYFTFITDCK

SEQ ID NO: 42664 - protein, 28 aa, Homo sapiens
ILQMEEEYIQQLCEDIIQLKPDVVITEK

SEQ ID NO: 42665 - protein, 13 aa, Homo sapiens
IPGGIIEDSCVLR

SEQ ID NO: 42666 - protein, 24 aa, Homo sapiens
ISIPVDISDSDMMLNIINSSITTK

SEQ ID NO: 42667 - protein, 23 aa, Homo sapiens
IVSRPEELREDDVGTGAGLLEIK

SEQ ID NO: 42668 - protein, 26 aa, Homo sapiens
NVLLDPQLVPGGGASEMAVAHALTEK

SEQ ID NO: 42669 - protein, 12 aa, Homo sapiens
TLIQNCGASTIR

SEQ ID NO: 42670 - protein, 14 aa, Homo sapiens
WSSLACNIALDAVK

SEQ ID NO: 42671 - protein, 20 aa, Homo sapiens
IQTYLQSTKPIIDLYEEMGK

SEQ ID NO: 42672 - protein, 12 aa, Homo sapiens
IVPVEITISLLK

SEQ ID NO: 42673 - protein, 16 aa, Homo sapiens
MKPLVVFVLGGPGAGK

SEQ ID NO: 42674 - protein, 15 aa, Homo sapiens
SVDEVFDEVVQIFDK

SEQ ID NO: 42675 - protein, 13 aa, Homo sapiens
YGYTHLSAGELLR

SEQ ID NO: 42676 - protein, 19 aa, Homo sapiens
PSATQPATAETQHIADQVR

SEQ ID NO: 42677 - protein, 12 aa, Homo sapiens
SQVVAGTNYFIK

SEQ ID NO: 42678 - protein, 21 aa, Homo sapiens
VFQSLPHENKPLTLSNYQTNK

SEQ ID NO: 42679 - protein, 12 aa, Homo sapiens
VHVGDEDFVHLR

SEQ ID NO: 42680 - protein, 24 aa, Homo sapiens
ELVVNCCTEFIHLISSEANEICNK

SEQ ID NO: 42681 - protein, 24 aa, Homo sapiens
TISPEHVIQALESLGFGSYISEVK

SEQ ID NO: 42682 - protein, 10 aa, Homo sapiens
GLLHSFDLLK

SEQ ID NO: 42683 - protein, 22 aa, Homo sapiens
LHEEEPPQNMKPQSGNDKPLSK

SEQ ID NO: 42684 - protein, 30 aa, Homo sapiens
LISKPVASDSTYFAWCPDGEHILTATCAPR

SEQ ID NO: 42685 - protein, 20 aa, Homo sapiens
NVNNEVHFFENNNFNTIANK

SEQ ID NO: 42686 - protein, 26 aa, Homo sapiens
PVASDSTYFAWCPDGEHILTATCAPR

SEQ ID NO: 42687 - protein, 15 aa, Homo sapiens
SPDLAPTPAPQSTPR

SEQ ID NO: 42688 - protein, 6 aa, Homo sapiens
VCIFSK

SEQ ID NO: 42689 - protein, 25 aa, Homo sapiens
YDVPSNAELWQVSWQPFLDGIFPAK

SEQ ID NO: 42690 - protein, 19 aa, Homo sapiens
GATLSHYNIVNNSNILGER

SEQ ID NO: 42691 - protein, 18 aa, Homo sapiens
GGENIYPAELEDFFHTHP

SEQ ID NO: 42692 - protein, 19 aa, Homo sapiens
GGENIYPAELEDFFHTHPK

SEQ ID NO: 42693 - protein, 30 aa, Homo sapiens
LPDLTTVISVDAPLPGTLLLDEVVAAGSTR

SEQ ID NO: 42694 - protein, 32 aa, Homo sapiens
QHLDQLQYNQQFLSCHDPINIQFTSGTTGSPK

SEQ ID NO: 42695 - protein, 19 aa, Homo sapiens
KQLSLLANGSELHISSVRY

SEQ ID NO: 42696 - protein, 19 aa, Homo sapiens
LNEQYEHASIHLWDLLEGK

SEQ ID NO: 42697 - protein, 22 aa, Homo sapiens
QGLNGVPILSEEELSLLDEFYK

SEQ ID NO: 42698 - protein, 17 aa, Homo sapiens
SQPLYQPSHATEQRPQK

SEQ ID NO: 42699 - protein, 20 aa, Homo sapiens
AELGIPLEEVPPEEINYLTR

SEQ ID NO: 42700 - protein, 12 aa, Homo sapiens
AFSVFLFNTENK

SEQ ID NO: 42701 - protein, 19 aa, Homo sapiens
AQSDGIWGEHEIDYILLVR

SEQ ID NO: 42702 - protein, 29 aa, Homo sapiens
FPGCFTNTCCSHPLSNPAELEESDALGVR

SEQ ID NO: 42703 - protein, 31 aa, Homo sapiens
ITFPGCFTNTCCSHPLSNPAELEESDALGVR

SEQ ID NO: 42704 - protein, 12 aa, Homo sapiens
NVTLNPDPNEIK

SEQ ID NO: 42705 - protein, 22 aa, Homo sapiens
TCCSHPLSNPAELEESDALGVR

SEQ ID NO: 42706 - protein, 16 aa, Homo sapiens
WWDNLNHLNQFVDHEK

SEQ ID NO: 42707 - protein, 35 aa, Homo sapiens
MSLGIMDLRNVTFKVTQATSSASADMLPVITGNRD

SEQ ID NO: 42708 - protein, 13 aa, Homo sapiens
AVIDQCNHDNILR

SEQ ID NO: 42709 - protein, 17 aa, Homo sapiens
DCGEDGLCISDLVLDVR

SEQ ID NO: 42710 - protein, 12 aa, Homo sapiens
KGEYFVNVTTRI

SEQ ID NO: 42711 - protein, 18 aa, Homo sapiens
KLNLQTSTSIPNVTEMKT

SEQ ID NO: 42712 - protein, 16 aa, Homo sapiens
RYFFNVSDEAALLEKA

SEQ ID NO: 42713 - protein, 10 aa, Homo sapiens
TSHGHLIFPK

SEQ ID NO: 42714 - protein, 18 aa, Homo sapiens
VAIVYNITLDADGFSSRV

SEQ ID NO: 42715 - protein, 22 aa, Homo sapiens
VDISLENPGTSPALEAYSETAK

SEQ ID NO: 42716 - protein, 20 aa, Homo sapiens
ITGNVVITLPTSTAELDGSK

SEQ ID NO: 42717 - protein, 25 aa, Homo sapiens
KVIVEGQNAHGEGYVNVTVKPEPRK

SEQ ID NO: 42718 - protein, 19 aa, Homo sapiens
KWLPNSTTTCSLSPDSAIL

SEQ ID NO: 42719 - protein, 21 aa, Homo sapiens
KDYNASASTISPPSSMEEDKF

SEQ ID NO: 42720 - protein, 26 aa, Homo sapiens
RDVMSDETNNEETESPSQEFVNITKY

SEQ ID NO: 42721 - protein, 26 aa, Homo sapiens
ENYLEFGLETGFTNFSDSAMQFLEKQ

SEQ ID NO: 42722 - protein, 33 aa, Homo sapiens
RSYFVVVNHSQSQDTVTTGEALNVIPGAQEKKA

SEQ ID NO: 42723 - protein, 25 aa, Homo sapiens
AAPYWITAPQNLVLSPGEDGTLICR

SEQ ID NO: 42724 - protein, 13 aa, Homo sapiens
HIEKKILTFQGSK

SEQ ID NO: 42725 - protein, 19 aa, Homo sapiens
ISWLTNGVPIEIAPDDPSR

SEQ ID NO: 42726 - protein, 26 aa, Homo sapiens
KGSALHEDIYVLHENGTLEIPVAQKD

SEQ ID NO: 42727 - protein, 15 aa, Homo sapiens
KIDGDTIIFSNVQER

SEQ ID NO: 42728 - protein, 9 aa, Homo sapiens
KILTFQGSK

SEQ ID NO: 42729 - protein, 26 aa, Homo sapiens
KKEKEPAEGNESSEAPSPVNAMNSFV

SEQ ID NO: 42730 - protein, 12 aa, Homo sapiens
KLSPYVNYSFRV

SEQ ID NO: 42731 - protein, 9 aa, Homo sapiens
KNLNFSTRY

SEQ ID NO: 42732 - protein, 26 aa, Homo sapiens
KVISVDELNDTIAANLSDTEFYGAKS

SEQ ID NO: 42733 - protein, 19 aa, Homo sapiens
KYQPINSTHELGPLVDLKI

SEQ ID NO: 42734 - protein, 13 aa, Homo sapiens
NALGAIHHTISVR

SEQ ID NO: 42735 - protein, 9 aa, Homo sapiens
QPEYAVVQR

SEQ ID NO: 42736 - protein, 18 aa, Homo sapiens
RERPPTFLTPEGNASNKE

SEQ ID NO: 42737 - protein, 22 aa, Homo sapiens
RERPPTFLTPEGNASNKEELRG

SEQ ID NO: 42738 - protein, 12 aa, Homo sapiens
RFNHTQTIQQKQ

SEQ ID NO: 42739 - protein, 34 aa, Homo sapiens
RFTVDKDHLVVADVSDDDSGTYTCVANTTLDSVS

SEQ ID NO: 42740 - protein, 33 aa, Homo sapiens
RNGTHFDIDKDPLVTMKPGTGTLIINIMSEGKA

SEQ ID NO: 42741 - protein, 20 aa, Homo sapiens
RQKDGDDEWTSVVVANVSKY

SEQ ID NO: 42742 - protein, 32 aa, Homo sapiens
RSSAVYQCNASNEYGYLLANAFVNVLAEPPRI

SEQ ID NO: 42743 - protein, 21 aa, Homo sapiens
RVNVVNSTLAEVHWDPVPLKS

SEQ ID NO: 42744 - protein, 13 aa, Homo sapiens
SLPSEASEQYLTK

SEQ ID NO: 42745 - protein, 19 aa, Homo sapiens
THGMLPGLEPFSHYTLNVR

SEQ ID NO: 42746 - protein, 33 aa, Homo sapiens
VQALNDMGFAPEPAVVMGHSGEDLPMVAPGNVR

SEQ ID NO: 42747 - protein, 14 aa, Homo sapiens
VVNGKGEGPASPDR

SEQ ID NO: 42748 - protein, 15 aa, Homo sapiens
YIVSGTPTFVPYLIK

SEQ ID NO: 42749 - protein, 18 aa, Homo sapiens
DPQSANHMNSSLLSLYRK

SEQ ID NO: 42750 - protein, 23 aa, Homo sapiens
KGILYGTMTLELGGTVNITCQKT

SEQ ID NO: 42751 - protein, 17 aa, Homo sapiens
HLNEIDLFHCIDPNDSK

SEQ ID NO: 42752 - protein, 12 aa, Homo sapiens
LNWLSVDFNNWK

SEQ ID NO: 42753 - protein, 13 aa, Homo sapiens
LTFSCLGGSDNFK

SEQ ID NO: 42754 - protein, 16 aa, Homo sapiens
AWALGQGLECFETSVK

SEQ ID NO: 42755 - protein, 25 aa, Homo sapiens
LWESPNVLCLVYDVTNEESFNNCSK

SEQ ID NO: 42756 - protein, 33 aa, Homo sapiens
DLDGNIPLLLAVQNGHSEICHFLLDHGADVNSR

SEQ ID NO: 42757 - protein, 19 aa, Homo sapiens
EREKGTVIKPPVEEYEEMK

SEQ ID NO: 42758 - protein, 9 aa, Homo sapiens
KSDTNEWNK

SEQ ID NO: 42759 - protein, 9 aa, Homo sapiens
LMQLTNVSR

SEQ ID NO: 42760 - protein, 22 aa, Homo sapiens
RAELVCLNNTEISENSSDLSQK

SEQ ID NO: 42761 - protein, 26 aa, Homo sapiens
RRAELVCLNNTEISENSSDLSQKLKE

SEQ ID NO: 42762 - protein, 13 aa, Homo sapiens
YEEAMKEVLSVQK

SEQ ID NO: 42763 - protein, 15 aa, Homo sapiens
KIEDNNTLVFIVDVK

SEQ ID NO: 42764 - protein, 13 aa, Homo sapiens
LAPDYDALDVANK

SEQ ID NO: 42765 - protein, 8 aa, Homo sapiens
LDHYAIIK

SEQ ID NO: 42766 - protein, 11 aa, Homo sapiens
VNTLIRPDGEK

SEQ ID NO: 42767 - protein, 12 aa, Homo sapiens
VNTLIRPDGEKK

SEQ ID NO: 42768 - protein, 12 aa, Homo sapiens
ALTSEIALLQSR

SEQ ID NO: 42769 - protein, 22 aa, Homo sapiens
APDELHYTYLDTFGRPVIVAYK

SEQ ID NO: 42770 - protein, 15 aa, Homo sapiens
ATSFLLALEPELEAR

SEQ ID NO: 42771 - protein, 11 aa, Homo sapiens
DVPAYSQDTFK

SEQ ID NO: 42772 - protein, 17 aa, Homo sapiens
FVDHVFDEQVIDSLTVK

SEQ ID NO: 42773 - protein, 25 aa, Homo sapiens
ISVIVETVYTHVLHPYPTQITQSEK

SEQ ID NO: 42774 - protein, 9 aa, Homo sapiens
LAHLGVQVK

SEQ ID NO: 42775 - protein, 18 aa, Homo sapiens
NLVEQHIQDIVVHYTFNK

SEQ ID NO: 42776 - protein, 18 aa, Homo sapiens
QFVVFEGNHYFYSPYPTK

SEQ ID NO: 42777 - protein, 25 aa, Homo sapiens
THYIVGYNLPSYEYLYNLGDQYALK

SEQ ID NO: 42778 - protein, 14 aa, Homo sapiens
VACITEQVLTLVNK

SEQ ID NO: 42779 - protein, 15 aa, Homo sapiens
VACITEQVLTLVNKR

SEQ ID NO: 42780 - protein, 17 aa, Homo sapiens
VHYENNSPFLTITSMTR

SEQ ID NO: 42781 - protein, 19 aa, Homo sapiens
VIEVSHWGNIAVEENVDLK

SEQ ID NO: 42782 - protein, 17 aa, Homo sapiens
VTAEVVLAHLGGGSTSR

SEQ ID NO: 42783 - protein, 21 aa, Homo sapiens
REALNISSSISESGGLNWKMT

SEQ ID NO: 42784 - protein, 9 aa, Homo sapiens
FLILPDMLK

SEQ ID NO: 42785 - protein, 13 aa, Homo sapiens
IVTCETNTGEVYR

SEQ ID NO: 42786 - protein, 20 aa, Homo sapiens
LIEAEDNMNCQMSNITVTYR

SEQ ID NO: 42787 - protein, 10 aa, Homo sapiens
MSNITVTYRD

SEQ ID NO: 42788 - protein, 10 aa, Homo sapiens
VAQLEQVYIR

SEQ ID NO: 42789 - protein, 21 aa, Homo sapiens
VLHEAEGHIVTCETNTGEVYR

SEQ ID NO: 42790 - protein, 31 aa, Homo sapiens
KNDATEILYSHVVKPVPAHPSSNSTLNQARN

SEQ ID NO: 42791 - protein, 13 aa, Homo sapiens
AIEINPDSAQPYK

SEQ ID NO: 42792 - protein, 17 aa, Homo sapiens
LLGHWEEAAHDLALACK

SEQ ID NO: 42793 - protein, 24 aa, Homo sapiens
KGSTPRNDPSVSVDYNTTEPAVRW

SEQ ID NO: 42794 - protein, 34 aa, Homo sapiens
KVGGTKPAGGDFGEVLNSAANASATTTEPLPEKT

SEQ ID NO: 42795 - protein, 14 aa, Homo sapiens
FLCFGSEGGTYYIK

SEQ ID NO: 42796 - protein, 14 aa, Homo sapiens
IHPFHILIALETYK

SEQ ID NO: 42797 - protein, 16 aa, Homo sapiens
LSHLKPSSEGLAIVTK

SEQ ID NO: 42798 - protein, 23 aa, Homo sapiens
RVLGSILNASTVAAAMCMVVTRT

SEQ ID NO: 42799 - protein, 16 aa, Homo sapiens
SVLEPGNSEVSLVCEK

SEQ ID NO: 42800 - protein, 28 aa, Homo sapiens
TNTPADVFIVFTDNETFAGGVHPAIALR

SEQ ID NO: 42801 - protein, 27 aa, Homo sapiens
TPADVFIVFTDNETFAGGVHPAIALRE

SEQ ID NO: 42802 - protein, 15 aa, Homo sapiens
TRDELEVIHLIEEHR

SEQ ID NO: 42803 - protein, 15 aa, Homo sapiens
DGSLASNPYSGDLTK

SEQ ID NO: 42804 - protein, 22 aa, Homo sapiens
KQHGVNVSVNASATPFQQPSGY

SEQ ID NO: 42805 - protein, 26 aa, Homo sapiens
NGFSSVQATQLQTTQSVEGATGSAVK

SEQ ID NO: 42806 - protein, 18 aa, Homo sapiens
NQDECVIALHDCNGDVNR

SEQ ID NO: 42807 - protein, 36 aa, Homo sapiens
RRGGRFSAQGMGTFNPADYAEPANTDDNYGNSSGNT

SEQ ID NO: 42808 - protein, 19 aa, Homo sapiens
DVLNLVYLCEALNLPEVAR

SEQ ID NO: 42809 - protein, 20 aa, Homo sapiens
EQIVVDLSHPGVSEDDQVSR

SEQ ID NO: 42810 - protein, 28 aa, Homo sapiens
IFDANTKPNLNLQVLSNPEFLAEGTAIK

SEQ ID NO: 42811 - protein, 13 aa, Homo sapiens
ILTTNTWSSELSK

SEQ ID NO: 42812 - protein, 17 aa, Homo sapiens
INAWNSPTLPIYEPGLK

SEQ ID NO: 42813 - protein, 13 aa, Homo sapiens
VLIGGDETPEGQR

SEQ ID NO: 42814 - protein, 10 aa, Homo sapiens
VTVVDVNESR

SEQ ID NO: 42815 - protein, 19 aa, Homo sapiens
EHLIDELDYILLPTEGWNK

SEQ ID NO: 42816 - protein, 30 aa, Homo sapiens
FAPQFSGYQQQDCQELLAFLLDGLHEDLNR

SEQ ID NO: 42817 - protein, 14 aa, Homo sapiens
TEDTEHVIIPVCLR

SEQ ID NO: 42818 - protein, 16 aa, Homo sapiens
DPGVITYDLPTPPGEK

SEQ ID NO: 42819 - protein, 13 aa, Homo sapiens
DVSGPMPDSYSPR

SEQ ID NO: 42820 - protein, 9 aa, Homo sapiens
EAFLQEVWK

SEQ ID NO: 42821 - protein, 23 aa, Homo sapiens
GETTLWNPGCDHAGIATQVVVEK

SEQ ID NO: 42822 - protein, 19 aa, Homo sapiens
GFVPSPTSQPGGHESLVDR

SEQ ID NO: 42823 - protein, 22 aa, Homo sapiens
IPAYFVTVSDPAVPPGEDPDGR

SEQ ID NO: 42824 - protein, 11 aa, Homo sapiens
IQQQQPPPGEK

SEQ ID NO: 42825 - protein, 15 aa, Homo sapiens
ITPAHDQNDYEVGQR

SEQ ID NO: 42826 - protein, 11 aa, Homo sapiens
KVDEAIALFQK

SEQ ID NO: 42827 - protein, 9 aa, Homo sapiens
LHEEGIIYR

SEQ ID NO: 42828 - protein, 26 aa, Homo sapiens
LHTYLAGEAPTLADLAAVTALLLPFR

SEQ ID NO: 42829 - protein, 16 aa, Homo sapiens
LLSPFMPFVTEELFQR

SEQ ID NO: 42830 - protein, 20 aa, Homo sapiens
LVNWSCTLNSAISDIEVDKK

SEQ ID NO: 42831 - protein, 36 aa, Homo sapiens
SLGNVIDPLDVIYGISLQGLHNQLLNSNLDPSEVEK

SEQ ID NO: 42832 - protein, 16 aa, Homo sapiens
STLYVSPHPDAFPSLR

SEQ ID NO: 42833 - protein, 12 aa, Homo sapiens
VPLEVQEADEAK

SEQ ID NO: 42834 - protein, 16 aa, Homo sapiens
VQGSDSDEEVVVATTR

SEQ ID NO: 42835 - protein, 16 aa, Homo sapiens
YGEAGEGPGWGGAHPR

SEQ ID NO: 42836 - protein, 16 aa, Homo sapiens
KPIDYTVLDDVGHGVK

SEQ ID NO: 42837 - protein, 15 aa, Homo sapiens
VADYCENNYIQATDK

SEQ ID NO: 42838 - protein, 8 aa, Homo sapiens
ATQIPSYK

SEQ ID NO: 42839 - protein, 8 aa, Homo sapiens
DFIATLGK

SEQ ID NO: 42840 - protein, 15 aa, Homo sapiens
ELSELSLLSLYGIHK

SEQ ID NO: 42841 - protein, 27 aa, Homo sapiens
ESSWPQGFGQLTQLGMEQHYELGEYIR

SEQ ID NO: 42842 - protein, 7 aa, Homo sapiens
FLNESYK

SEQ ID NO: 42843 - protein, 14 aa, Homo sapiens
FLNESYKHEQVYIR

SEQ ID NO: 42844 - protein, 10 aa, Homo sapiens
FQELESETLK

SEQ ID NO: 42845 - protein, 16 aa, Homo sapiens
FQELESETLKSEEFQK

SEQ ID NO: 42846 - protein, 17 aa, Homo sapiens
FQELESETLKSEEFQKR

SEQ ID NO: 42847 - protein, 7 aa, Homo sapiens
FVTLVFR

SEQ ID NO: 42848 - protein, 10 aa, Homo sapiens
GEYFVEMYYR

SEQ ID NO: 42849 - protein, 7 aa, Homo sapiens
HEQVYIR

SEQ ID NO: 42850 - protein, 16 aa, Homo sapiens
HGDRSPIDTFPTDPIK

SEQ ID NO: 42851 - protein, 43 aa, Homo sapiens
HGDRSPIDTFPTDPIKESSWPQGFGQLTQLGMEQHYELGEYIR

SEQ ID NO: 42852 - protein, 9 aa, Homo sapiens
KFLNESYKH

SEQ ID NO: 42853 - protein, 15 aa, Homo sapiens
KFLNESYKHEQVYIR

SEQ ID NO: 42854 - protein, 28 aa, Homo sapiens
KVYDPLYCESVHNFTLPSWATEDTMTKL

SEQ ID NO: 42855 - protein, 13 aa, Homo sapiens
LHPYKDFIATLGK

SEQ ID NO: 42856 - protein, 15 aa, Homo sapiens
LQGGVLVNEILNHMK

SEQ ID NO: 42857 - protein, 16 aa, Homo sapiens
LQGGVLVNEILNHMKR

SEQ ID NO: 42858 - protein, 17 aa, Homo sapiens
LRELSELSLLSLYGIHK

SEQ ID NO: 42859 - protein, 15 aa, Homo sapiens
LSGLHGQDLFGIWSK

SEQ ID NO: 42860 - protein, 9 aa, Homo sapiens
RATQIPSYK

SEQ ID NO: 42861 - protein, 10 aa, Homo sapiens
RATQIPSYKK

SEQ ID NO: 42862 - protein, 14 aa, Homo sapiens
RLHPYKDFIATLGK

SEQ ID NO: 42863 - protein, 25 aa, Homo sapiens
RNETQHEPYPLMLPGCSPSCPLERF

SEQ ID NO: 42864 - protein, 7 aa, Homo sapiens
SEEFQKR

SEQ ID NO: 42865 - protein, 12 aa, Homo sapiens
SPIDTFPTDPIK

SEQ ID NO: 42866 - protein, 39 aa, Homo sapiens
SPIDTFPTDPIKESSWPQGFGQLTQLGMEQHYELGEYIR

SEQ ID NO: 42867 - protein, 40 aa, Homo sapiens
SPIDTFPTDPIKESSWPQGFGQLTQLGMEQHYELGEYIRK

SEQ ID NO: 42868 - protein, 17 aa, Homo sapiens
SRLQGGVLVNEILNHMK

SEQ ID NO: 42869 - protein, 18 aa, Homo sapiens
SRLQGGVLVNEILNHMKR

SEQ ID NO: 42870 - protein, 15 aa, Homo sapiens
AYEDQTKPVLEYYQK

SEQ ID NO: 42871 - protein, 13 aa, Homo sapiens
GVLETFSGTETNK

SEQ ID NO: 42872 - protein, 14 aa, Homo sapiens
NLTQYSWLLDGFPR

SEQ ID NO: 42873 - protein, 15 aa, Homo sapiens
TVGIDDLTGEPLIQR

SEQ ID NO: 42874 - protein, 11 aa, Homo sapiens
KDFNETQLARI

SEQ ID NO: 42875 - protein, 12 aa, Homo sapiens
KINDSVTLNEKP

SEQ ID NO: 42876 - protein, 11 aa, Homo sapiens
IIGLKPEGVPR

SEQ ID NO: 42877 - protein, 27 aa, Homo sapiens
KFLKPYTLEEQKNLTVCPDGALFEQKG

SEQ ID NO: 42878 - protein, 25 aa, Homo sapiens
KLHVGYLQPLVAVQVSFAPNNTGKE

SEQ ID NO: 42879 - protein, 14 aa, Homo sapiens
LFIYNPTTGEFLGR

SEQ ID NO: 42880 - protein, 23 aa, Homo sapiens
LHVGYLQPLVAVQVSFAPNNTGK

SEQ ID NO: 42881 - protein, 19 aa, Homo sapiens
NEDIPNVAVYPHNGMIDLK

SEQ ID NO: 42882 - protein, 18 aa, Homo sapiens
KSANNTPENSPNFPNFRV

SEQ ID NO: 42883 - protein, 11 aa, Homo sapiens
AADIDQEVKER

SEQ ID NO: 42884 - protein, 30 aa, Homo sapiens
AISCMGQIICNLGDNLGSDLPNTLQIFLER

SEQ ID NO: 42885 - protein, 11 aa, Homo sapiens
ALTLIAGSPLK

SEQ ID NO: 42886 - protein, 13 aa, Homo sapiens
ASASYHISNLLEK

SEQ ID NO: 42887 - protein, 13 aa, Homo sapiens
AVAALLTIPEAEK

SEQ ID NO: 42888 - protein, 9 aa, Homo sapiens
CLDAVVSTR

SEQ ID NO: 42889 - protein, 8 aa, Homo sapiens
DISSIGLK

SEQ ID NO: 42890 - protein, 15 aa, Homo sapiens
DLLDTVLPHLYNETK

SEQ ID NO: 42891 - protein, 11 aa, Homo sapiens
DSIKLDDDSER

SEQ ID NO: 42892 - protein, 14 aa, Homo sapiens
EGPAVVGQFIQDVK

SEQ ID NO: 42893 - protein, 15 aa, Homo sapiens
EVYPHVSTIINICLK

SEQ ID NO: 42894 - protein, 12 aa, Homo sapiens
EYCIQAFESFVR

SEQ ID NO: 42895 - protein, 13 aa, Homo sapiens
FMATNDLMTELQK

SEQ ID NO: 42896 - protein, 15 aa, Homo sapiens
FTISDHPQPIDPLLK

SEQ ID NO: 42897 - protein, 9 aa, Homo sapiens
HEMLPEFYK

SEQ ID NO: 42898 - protein, 10 aa, Homo sapiens
HTVDDGLDIR

SEQ ID NO: 42899 - protein, 11 aa, Homo sapiens
HTVDDGLDIRK

SEQ ID NO: 42900 - protein, 19 aa, Homo sapiens
IDLRPVLGEGVPILASFLR

SEQ ID NO: 42901 - protein, 14 aa, Homo sapiens
ISGSILNELIGLVR

SEQ ID NO: 42902 - protein, 14 aa, Homo sapiens
ITSEALLVTQQLVK

SEQ ID NO: 42903 - protein, 21 aa, Homo sapiens
LDIFEFLNHVEDGLKDHYDIK

SEQ ID NO: 42904 - protein, 13 aa, Homo sapiens
LKGYLISGSSYAR

SEQ ID NO: 42905 - protein, 7 aa, Homo sapiens
LKNEITR

SEQ ID NO: 42906 - protein, 15 aa, Homo sapiens
LLEDKNGEVQNLAVK

SEQ ID NO: 42907 - protein, 12 aa, Homo sapiens
LSTLCPSAVLQR

SEQ ID NO: 42908 - protein, 16 aa, Homo sapiens
MLTGPVYSQSTALTHK

SEQ ID NO: 42909 - protein, 8 aa, Homo sapiens
NCIGDFLK

SEQ ID NO: 42910 - protein, 10 aa, Homo sapiens
NGEVQNLAVK

SEQ ID NO: 42911 - protein, 9 aa, Homo sapiens
NVVAECLGK

SEQ ID NO: 42912 - protein, 20 aa, Homo sapiens
QEDVSVQLEALDIMADMLSR

SEQ ID NO: 42913 - protein, 24 aa, Homo sapiens
QGGLLVNFHPSILTCLLPQLTSPR

SEQ ID NO: 42914 - protein, 10 aa, Homo sapiens
RQYLLLHSLK

SEQ ID NO: 42915 - protein, 15 aa, Homo sapiens
SVILEAFSSPSEEVK

SEQ ID NO: 42916 - protein, 10 aa, Homo sapiens
TLEDPDLNVR

SEQ ID NO: 42917 - protein, 21 aa, Homo sapiens
TVIGELPPASSGSALAANVCK

SEQ ID NO: 42918 - protein, 18 aa, Homo sapiens
VALVTFNSAAHNKPSLIR

SEQ ID NO: 42919 - protein, 18 aa, Homo sapiens
VIRPLDQPSSFDATPYIK

SEQ ID NO: 42920 - protein, 16 aa, Homo sapiens
DETVSDCSPHIANIGR

SEQ ID NO: 42921 - protein, 9 aa, Homo sapiens
DYLLCDYNR

SEQ ID NO: 42922 - protein, 14 aa, Homo sapiens
GCWDSIHVVEVQEK

SEQ ID NO: 42923 - protein, 14 aa, Homo sapiens
KLEVEANNAFDQYR

SEQ ID NO: 42924 - protein, 13 aa, Homo sapiens
LEVEANNAFDQYR

SEQ ID NO: 42925 - protein, 8 aa, Homo sapiens
LVEDMENK

SEQ ID NO: 42926 - protein, 25 aa, Homo sapiens
NLSDLIDLVPSLCEDLLSSVDQPLK

SEQ ID NO: 42927 - protein, 16 aa, Homo sapiens
PSLCEDLLSSVDQPLK

SEQ ID NO: 42928 - protein, 14 aa, Homo sapiens
SGSGTMNLGGSLTR

SEQ ID NO: 42929 - protein, 20 aa, Homo sapiens
SPWSNKYDPPLEDGAMPSAR

SEQ ID NO: 42930 - protein, 10 aa, Homo sapiens
STLNEIYFGK

SEQ ID NO: 42931 - protein, 24 aa, Homo sapiens
SVQTFADKSKQEALKNDLVEALKR

SEQ ID NO: 42932 - protein, 21 aa, Homo sapiens
IMDYYETNSQCSKPGIVFITK

SEQ ID NO: 42933 - protein, 22 aa, Homo sapiens
IMDYYETNSQCSKPGIVFITKR

SEQ ID NO: 42934 - protein, 8 aa, Homo sapiens
PGIVFITK

SEQ ID NO: 42935 - protein, 7 aa, Homo sapiens
WVQDYIK

SEQ ID NO: 42936 - protein, 29 aa, Homo sapiens
AFADALEVIPMALSENSGMNPIQTMTEVR

SEQ ID NO: 42937 - protein, 19 aa, Homo sapiens
ASMGTLAFDEYGRPFLIIK

SEQ ID NO: 42938 - protein, 30 aa, Homo sapiens
ETGANLAICQWGFDDEANHLLLQNNLPAVR

SEQ ID NO: 42939 - protein, 15 aa, Homo sapiens
GVIVDKDFSHPQMPK

SEQ ID NO: 42940 - protein, 12 aa, Homo sapiens
HKLDVTSVEDYK

SEQ ID NO: 42941 - protein, 14 aa, Homo sapiens
IAILTCPFEPPKPK

SEQ ID NO: 42942 - protein, 20 aa, Homo sapiens
ISDSVLVDIKDTEPLIQTAK

SEQ ID NO: 42943 - protein, 25 aa, Homo sapiens
LAICQWGFDDEANHLLLQNNLPAVR

SEQ ID NO: 42944 - protein, 16 aa, Homo sapiens
LGFAGLVQEISFGTTK

SEQ ID NO: 42945 - protein, 7 aa, Homo sapiens
SHIMAAK

SEQ ID NO: 42946 - protein, 10 aa, Homo sapiens
SLHDALCVIR

SEQ ID NO: 42947 - protein, 30 aa, Homo sapiens
SQDDEIGDGTTGVVVLAGALLEEAEQLLDR

SEQ ID NO: 42948 - protein, 8 aa, Homo sapiens
VAIEHLDK

SEQ ID NO: 42949 - protein, 22 aa, Homo sapiens
VVYGGGAAEISCALAVSQEADK

SEQ ID NO: 42950 - protein, 17 aa, Homo sapiens
WVGGPEIELIAIATGGR

SEQ ID NO: 42951 - protein, 19 aa, Homo sapiens
RLQLSNGNMTLTLLSVKRN

SEQ ID NO: 42952 - protein, 20 aa, Homo sapiens
KNISQENAPGPAHNGRETIY

SEQ ID NO: 42953 - protein, 9 aa, Homo sapiens
DCSQDLLKK

SEQ ID NO: 42954 - protein, 11 aa, Homo sapiens
ELSQLQAAQEK

SEQ ID NO: 42955 - protein, 18 aa, Homo sapiens
GEFALRLSSTQEEVHQLR

SEQ ID NO: 42956 - protein, 14 aa, Homo sapiens
INQQENSLTLEKLK

SEQ ID NO: 42957 - protein, 10 aa, Homo sapiens
LMEICESLEK

SEQ ID NO: 42958 - protein, 12 aa, Homo sapiens
LMEICESLEKTK

SEQ ID NO: 42959 - protein, 11 aa, Homo sapiens
LQLLSNEIMDK

SEQ ID NO: 42960 - protein, 22 aa, Homo sapiens
SLDCMHKDQVEKEGKVREEIAE

SEQ ID NO: 42961 - protein, 10 aa, Homo sapiens
TTALDQLSEK

SEQ ID NO: 42962 - protein, 29 aa, Homo sapiens
KHFLLQTVENGSWVGMVHFDSTATIVNKL

SEQ ID NO: 42963 - protein, 27 aa, Homo sapiens
LESKGLTLNSNAWMNDTVIIDSTVGKD

SEQ ID NO: 42964 - protein, 10 aa, Homo sapiens
ALHHGIDLEK

SEQ ID NO: 42965 - protein, 15 aa, Homo sapiens
IGSCTQQDVELHVQK

SEQ ID NO: 42966 - protein, 20 aa, Homo sapiens
LPLQLDDAVRPEAEGEEEGR

SEQ ID NO: 42967 - protein, 10 aa, Homo sapiens
LQSGICHLFR

SEQ ID NO: 42968 - protein, 12 aa, Homo sapiens
VTMLFLGLHNVR

SEQ ID NO: 42969 - protein, 15 aa, Homo sapiens
YGISSMIQSQEKPDR

SEQ ID NO: 42970 - protein, 13 aa, Homo sapiens
ATAEQISSQTGNK

SEQ ID NO: 42971 - protein, 28 aa, Homo sapiens
LGTVEELANLAAFLCSDYASWINGAVIK

SEQ ID NO: 42972 - protein, 22 aa, Homo sapiens
VAGHPNIVINNAAGNFISPTER

SEQ ID NO: 42973 - protein, 9 aa, Homo sapiens
VHAIQCDVR

SEQ ID NO: 42974 - protein, 23 aa, Homo sapiens
VHAIQCDVRDPDMVQNTVSELIK

SEQ ID NO: 42975 - protein, 30 aa, Homo sapiens
AALAGGTTMIIDHVVPEPGTSLLAAFDQWR

SEQ ID NO: 42976 - protein, 16 aa, Homo sapiens
AITIANQTNCPLYITK

SEQ ID NO: 42977 - protein, 14 aa, Homo sapiens
DHGVNSFLVYMAFK

SEQ ID NO: 42978 - protein, 16 aa, Homo sapiens
FQLTDCQIYEVLSVIR

SEQ ID NO: 42979 - protein, 15 aa, Homo sapiens
GLYDGPVCEVSVTPK

SEQ ID NO: 42980 - protein, 23 aa, Homo sapiens
GTVVYGEPITASLGTDGSHYWSK

SEQ ID NO: 42981 - protein, 18 aa, Homo sapiens
IAVGSDADLVIWDPDSVK

SEQ ID NO: 42982 - protein, 27 aa, Homo sapiens
ILDLGITGPEGHVLSRPEEVEAEAVNR

SEQ ID NO: 42983 - protein, 16 aa, Homo sapiens
IVLEDGTLHVTEGSGR

SEQ ID NO: 42984 - protein, 12 aa, Homo sapiens
MVIPGGIDVHTR

SEQ ID NO: 42985 - protein, 20 aa, Homo sapiens
RTTQRIVAPPGGRANITSLG

SEQ ID NO: 42986 - protein, 16 aa, Homo sapiens
SCCDYSLHVDISEWHK

SEQ ID NO: 42987 - protein, 17 aa, Homo sapiens
THNSSLEYNIFEGMECR

SEQ ID NO: 42988 - protein, 11 aa, Homo sapiens
ERLDGENIYIR

SEQ ID NO: 42989 - protein, 15 aa, Homo sapiens
QASALIDRPAPHFER

SEQ ID NO: 42990 - protein, 10 aa, Homo sapiens
TVKGGISETR

SEQ ID NO: 42991 - protein, 12 aa, Homo sapiens
ACIPTGPYPCGK

SEQ ID NO: 42992 - protein, 19 aa, Homo sapiens
CKDGLGEYTCTCLEGFEGK

SEQ ID NO: 42993 - protein, 15 aa, Homo sapiens
DGDQCETSPCQNQGK

SEQ ID NO: 42994 - protein, 17 aa, Homo sapiens
DGLGEYTCTCLEGFEGK

SEQ ID NO: 42995 - protein, 17 aa, Homo sapiens
DTYFVTGIVSWGEGCAR

SEQ ID NO: 42996 - protein, 11 aa, Homo sapiens
DWAESTLMTQK

SEQ ID NO: 42997 - protein, 14 aa, Homo sapiens
EGGEAVHEVEVVIK

SEQ ID NO: 42998 - protein, 11 aa, Homo sapiens
ETYDFDIAVLR

SEQ ID NO: 42999 - protein, 14 aa, Homo sapiens
FTKETYDFDIAVLR

SEQ ID NO: 43000 - protein, 9 aa, Homo sapiens
GYTLADNGK

SEQ ID NO: 43001 - protein, 9 aa, Homo sapiens
MLEVPYVDR

SEQ ID NO: 43002 - protein, 11 aa, Homo sapiens
MNVAPACLPER

SEQ ID NO: 43003 - protein, 22 aa, Homo sapiens
MNVAPACLPERDWAESTLMTQK

SEQ ID NO: 43004 - protein, 7 aa, Homo sapiens
NCELFTR

SEQ ID NO: 43005 - protein, 19 aa, Homo sapiens
NTEQEEGGEAVHEVEVVIK

SEQ ID NO: 43006 - protein, 16 aa, Homo sapiens
QEDACQGDSGGPHVTR

SEQ ID NO: 43007 - protein, 9 aa, Homo sapiens
TGIVSGFGR

SEQ ID NO: 43008 - protein, 6 aa, Homo sapiens
YGIYTK

SEQ ID NO: 43009 - protein, 22 aa, Homo sapiens
SVTELNGDIITNTMTLGDIVFK

SEQ ID NO: 43010 - protein, 23 aa, Homo sapiens
SVTELNGDIITNTMTLGDIVFKR

SEQ ID NO: 43011 - protein, 10 aa, Homo sapiens
TVVQLEGDNK

SEQ ID NO: 43012 - protein, 27 aa, Homo sapiens
MMQQTPCYSFAPPNTSLNSPSPNYQKY

SEQ ID NO: 43013 - protein, 20 aa, Homo sapiens
QSSMSPLPQMPIQTLQDNKS

SEQ ID NO: 43014 - protein, 12 aa, Homo sapiens
EHENLKPLLEQK

SEQ ID NO: 43015 - protein, 8 aa, Homo sapiens
EVLSAEVK

SEQ ID NO: 43016 - protein, 7 aa, Homo sapiens
LILELGK

SEQ ID NO: 43017 - protein, 13 aa, Homo sapiens
VNELTGGLEETLK

SEQ ID NO: 43018 - protein, 20 aa, Homo sapiens
ETDCGVHINAGPEIGVASTK

SEQ ID NO: 43019 - protein, 23 aa, Homo sapiens
GYDSAGVGFDGGNDKDWEANACK

SEQ ID NO: 43020 - protein, 22 aa, Homo sapiens
QVLEELTELPVMVELASDFLDR

SEQ ID NO: 43021 - protein, 13 aa, Homo sapiens
VDSTTCLFPVEEK

SEQ ID NO: 43022 - protein, 16 aa, Homo sapiens
WATHGEPSPVNSHPQR

SEQ ID NO: 43023 - protein, 14 aa, Homo sapiens
ALLVYPTLPEALQR

SEQ ID NO: 43024 - protein, 13 aa, Homo sapiens
DPSPVSGPVHLFR

SEQ ID NO: 43025 - protein, 19 aa, Homo sapiens
KYEFCPFHNVTQHEQTFRW

SEQ ID NO: 43026 - protein, 22 aa, Homo sapiens
MKVVEEPNAFGVNNPFLPQASR

SEQ ID NO: 43027 - protein, 21 aa, Homo sapiens
QWDQVEQDLADELITPQGHEK

SEQ ID NO: 43028 - protein, 10 aa, Homo sapiens
TLFEDAGYLK

SEQ ID NO: 43029 - protein, 17 aa, Homo sapiens
YEFCPFHNVTQHEQTFR

SEQ ID NO: 43030 - protein, 29 aa, Homo sapiens
DAGIMRNETETAEERVAELARDLVEMEQK

SEQ ID NO: 43031 - protein, 18 aa, Homo sapiens
ENQQHYGDLLNHCAVLEK

SEQ ID NO: 43032 - protein, 21 aa, Homo sapiens
KECMETLLSSNASMKEELERV

SEQ ID NO: 43033 - protein, 19 aa, Homo sapiens
KKNADNNSSAFTALSEERD

SEQ ID NO: 43034 - protein, 15 aa, Homo sapiens
QMSIHMEELKINISR

SEQ ID NO: 43035 - protein, 19 aa, Homo sapiens
APPSVFAEVPQAQPVLVFK

SEQ ID NO: 43036 - protein, 14 aa, Homo sapiens
EPESILQVLSQMEK

SEQ ID NO: 43037 - protein, 20 aa, Homo sapiens
FLFPFFDSAYQGFASGNLER

SEQ ID NO: 43038 - protein, 21 aa, Homo sapiens
IANDNSLNHEYLPILGLAEFR

SEQ ID NO: 43039 - protein, 8 aa, Homo sapiens
IGADFLAR

SEQ ID NO: 43040 - protein, 9 aa, Homo sapiens
INVSGLTTK

SEQ ID NO: 43041 - protein, 12 aa, Homo sapiens
ITWSNPPAQGAR

SEQ ID NO: 43042 - protein, 20 aa, Homo sapiens
IVASTLSNPELFEEWTGNVK

SEQ ID NO: 43043 - protein, 10 aa, Homo sapiens
KVNLGVGAYR

SEQ ID NO: 43044 - protein, 11 aa, Homo sapiens
LALGDDSPALK

SEQ ID NO: 43045 - protein, 13 aa, Homo sapiens
LALGDDSPALKEK

SEQ ID NO: 43046 - protein, 24 aa, Homo sapiens
NTPVYVSSPTWENHNAVFSAAGFK

SEQ ID NO: 43047 - protein, 9 aa, Homo sapiens
QVEYLVNEK

SEQ ID NO: 43048 - protein, 13 aa, Homo sapiens
TDDCHPWVLPVVK

SEQ ID NO: 43049 - protein, 23 aa, Homo sapiens
TPGTWNHITDQIGMFSFTGLNPK

SEQ ID NO: 43050 - protein, 14 aa, Homo sapiens
VGGVQSLGGTGALR

SEQ ID NO: 43051 - protein, 9 aa, Homo sapiens
VNLGVGAYR

SEQ ID NO: 43052 - protein, 24 aa, Homo sapiens
RLRNGLQNCATHTQPFWGSLTNRT

SEQ ID NO: 43053 - protein, 24 aa, Homo sapiens
KVLEANATPLDRGDGVLRTCALRP

SEQ ID NO: 43054 - protein, 19 aa, Homo sapiens
IVGYVGTSHTGEASGIYVK

SEQ ID NO: 43055 - protein, 22 aa, Homo sapiens
KTEFSGTIHDINSSLILEAPKG

SEQ ID NO: 43056 - protein, 22 aa, Homo sapiens
LVSVNEYCLDNTSLAEAVEILK

SEQ ID NO: 43057 - protein, 34 aa, Homo sapiens
ANLEAFTVDKDITLTNDKPATAIGVIGNFTDAER

SEQ ID NO: 43058 - protein, 15 aa, Homo sapiens
DLAEIGIAVGNNDVK

SEQ ID NO: 43059 - protein, 11 aa, Homo sapiens
FRPLNESEVNR

SEQ ID NO: 43060 - protein, 11 aa, Homo sapiens
LITDLQDQNQK

SEQ ID NO: 43061 - protein, 16 aa, Homo sapiens
PGQHPAASPTHPSAIR

SEQ ID NO: 43062 - protein, 19 aa, Homo sapiens
PIRPGQHPAASPTHPSAIR

SEQ ID NO: 43063 - protein, 10 aa, Homo sapiens
SHSIFLINVK

SEQ ID NO: 43064 - protein, 22 aa, Homo sapiens
SLSALGNVISALAEGSTYVPYR

SEQ ID NO: 43065 - protein, 18 aa, Homo sapiens
TTIVICCSPSSYNESETK

SEQ ID NO: 43066 - protein, 17 aa, Homo sapiens
VFQSSTSQEQVYNDCAK

SEQ ID NO: 43067 - protein, 13 aa, Homo sapiens
LPPNSELVQAVLR

SEQ ID NO: 43068 - protein, 15 aa, Homo sapiens
RNSLLNGSWGSEEKK

SEQ ID NO: 43069 - protein, 26 aa, Homo sapiens
EGSGKAMLEEALPVSLSQGQPSRQKR

SEQ ID NO: 43070 - protein, 16 aa, Homo sapiens
HLPEENVHDADFGEQK

SEQ ID NO: 43071 - protein, 10 aa, Homo sapiens
KQQCLQFFYK

SEQ ID NO: 43072 - protein, 21 aa, Homo sapiens
LAFHVCSGENDAILEWPVENR

SEQ ID NO: 43073 - protein, 10 aa, Homo sapiens
SAIDLERLNR

SEQ ID NO: 43074 - protein, 18 aa, Homo sapiens
SVENTGPLEDHNWPQYFR

SEQ ID NO: 43075 - protein, 33 aa, Homo sapiens
PGGGIKWRFIATSPASQLSPTELTEMRNDLFNK

SEQ ID NO: 43076 - protein, 19 aa, Homo sapiens
SILALVDGQPWDMYKPLTK

SEQ ID NO: 43077 - protein, 24 aa, Homo sapiens
TSICFQYEVSAVHNLQPTQPSLIR

SEQ ID NO: 43078 - protein, 12 aa, Homo sapiens
LTGAIMHFGNMK

SEQ ID NO: 43079 - protein, 14 aa, Homo sapiens
MDLSDLGEAAAFLR

SEQ ID NO: 43080 - protein, 29 aa, Homo sapiens
RMTQPMMNSSYHSNPAYMNQTAQYPMQMQ

SEQ ID NO: 43081 - protein, 13 aa, Homo sapiens
DIELVMSQANVSR

SEQ ID NO: 43082 - protein, 15 aa, Homo sapiens
IEDLSQQAQLAAAEK

SEQ ID NO: 43083 - protein, 13 aa, Homo sapiens
NILFVITKPDVYK

SEQ ID NO: 43084 - protein, 14 aa, Homo sapiens
SPASDTYIVFGEAK

SEQ ID NO: 43085 - protein, 22 aa, Homo sapiens
ADPFSFEGPEIVDCDGCTIDWK

SEQ ID NO: 43086 - protein, 15 aa, Homo sapiens
QVPNESFFNFFNPLK

SEQ ID NO: 43087 - protein, 27 aa, Homo sapiens
SEPDKADPFSFEGPEIVDCDGCTIDWK

SEQ ID NO: 43088 - protein, 19 aa, Homo sapiens
VLEFHFEPNDYFTNSVLTK

SEQ ID NO: 43089 - protein, 21 aa, Homo sapiens
AAQLVDKDSTFLSTLEHHLSR

SEQ ID NO: 43090 - protein, 14 aa, Homo sapiens
DSTFLSTLEHHLSR

SEQ ID NO: 43091 - protein, 29 aa, Homo sapiens
WLEDNLDHTDSSLLQDNVAFVLCLDTVGR

SEQ ID NO: 43092 - protein, 22 aa, Homo sapiens
FALNHPELVEGLVLINVDPCAK

SEQ ID NO: 43093 - protein, 17 aa, Homo sapiens
GNRPVILTYHDIGLNHK

SEQ ID NO: 43094 - protein, 19 aa, Homo sapiens
IDIDNSGYVSDYELQDLFK

SEQ ID NO: 43095 - protein, 13 aa, Homo sapiens
KIENCNYAVELGK

SEQ ID NO: 43096 - protein, 14 aa, Homo sapiens
ESNEEEQVWHFLGK

SEQ ID NO: 43097 - protein, 14 aa, Homo sapiens
FKPGYLEATLNWFR

SEQ ID NO: 43098 - protein, 16 aa, Homo sapiens
ILGILALIDEGETDWK

SEQ ID NO: 43099 - protein, 11 aa, Homo sapiens
ILSCGEVIHVK

SEQ ID NO: 43100 - protein, 16 aa, Homo sapiens
NDEYENLFNMIVEIPR

SEQ ID NO: 43101 - protein, 16 aa, Homo sapiens
NVTGHYISPFHDIPLK

SEQ ID NO: 43102 - protein, 12 aa, Homo sapiens
SLVESVSSSPNK

SEQ ID NO: 43103 - protein, 19 aa, Homo sapiens
STNCFGDNDPIDVCEIGSK

SEQ ID NO: 43104 - protein, 17 aa, Homo sapiens
VPDGKPENQFAFNGEFK

SEQ ID NO: 43105 - protein, 20 aa, Homo sapiens
GHEFIPTLYHFPANCDACAK

SEQ ID NO: 43106 - protein, 14 aa, Homo sapiens
LFHVRPVTQGDVYR

SEQ ID NO: 43107 - protein, 25 aa, Homo sapiens
SEVNSDCLLDGLDALVYDLDFPALR

SEQ ID NO: 43108 - protein, 11 aa, Homo sapiens
HGVVPLATYMR

SEQ ID NO: 43109 - protein, 8 aa, Homo sapiens
KGDIVDIK

SEQ ID NO: 43110 - protein, 17 aa, Homo sapiens
RVYNVTQHAVGIVVNKQ

SEQ ID NO: 43111 - protein, 18 aa, Homo sapiens
TNGKEPELLEPIPYEFMA

SEQ ID NO: 43112 - protein, 15 aa, Homo sapiens
VYNVTQHAVGIVVNK

SEQ ID NO: 43113 - protein, 12 aa, Homo sapiens
KSEIEYYAMLAK

SEQ ID NO: 43114 - protein, 12 aa, Homo sapiens
LVILANNCPALR

SEQ ID NO: 43115 - protein, 19 aa, Homo sapiens
TGVHHYSGNNIELGTACGK

SEQ ID NO: 43116 - protein, 16 aa, Homo sapiens
VCTLAIIDPGDSDIIR

SEQ ID NO: 43117 - protein, 28 aa, Homo sapiens
RVFYFMVGTAFANSTCQLIVCQMSSTRC

SEQ ID NO: 43118 - protein, 19 aa, Homo sapiens
AAQKTDTSHHDQDHPTFNK

SEQ ID NO: 43119 - protein, 13 aa, Homo sapiens
ADLSGVTEEAPLK

SEQ ID NO: 43120 - protein, 16 aa, Homo sapiens
ADLSGVTEEAPLKLSK

SEQ ID NO: 43121 - protein, 11 aa, Homo sapiens
ADTHDEILEGL

SEQ ID NO: 43122 - protein, 12 aa, Homo sapiens
ADTHDEILEGLN

SEQ ID NO: 43123 - protein, 13 aa, Homo sapiens
ADTHDEILEGLNF

SEQ ID NO: 43124 - protein, 14 aa, Homo sapiens
ADTHDEILEGLNFN

SEQ ID NO: 43125 - protein, 15 aa, Homo sapiens
ADTHDEILEGLNFNL

SEQ ID NO: 43126 - protein, 18 aa, Homo sapiens
ADTHDEILEGLNFNLTEI

SEQ ID NO: 43127 - protein, 22 aa, Homo sapiens
ADTHDEILEGLNFNLTEIPEAQ

SEQ ID NO: 43128 - protein, 24 aa, Homo sapiens
ADTHDEILEGLNFNLTEIPEAQIH

SEQ ID NO: 43129 - protein, 25 aa, Homo sapiens
ADTHDEILEGLNFNLTEIPEAQIHE

SEQ ID NO: 43130 - protein, 26 aa, Homo sapiens
ADTHDEILEGLNFNLTEIPEAQIHEG

SEQ ID NO: 43131 - protein, 27 aa, Homo sapiens
ADTHDEILEGLNFNLTEIPEAQIHEGF

SEQ ID NO: 43132 - protein, 28 aa, Homo sapiens
ADTHDEILEGLNFNLTEIPEAQIHEGFQ

SEQ ID NO: 43133 - protein, 29 aa, Homo sapiens
ADTHDEILEGLNFNLTEIPEAQIHEGFQE

SEQ ID NO: 43134 - protein, 30 aa, Homo sapiens
ADTHDEILEGLNFNLTEIPEAQIHEGFQEL

SEQ ID NO: 43135 - protein, 31 aa, Homo sapiens
ADTHDEILEGLNFNLTEIPEAQIHEGFQELL

SEQ ID NO: 43136 - protein, 32 aa, Homo sapiens
ADTHDEILEGLNFNLTEIPEAQIHEGFQELLR

SEQ ID NO: 43137 - protein, 9 aa, Homo sapiens
AEFAFSLYR

SEQ ID NO: 43138 - protein, 10 aa, Homo sapiens
AIFFLPDEGK

SEQ ID NO: 43139 - protein, 25 aa, Homo sapiens
AIFFLPDEGKLQHLENELTHDIITK

SEQ ID NO: 43140 - protein, 11 aa, Homo sapiens
AIPMSIPPEVK

SEQ ID NO: 43141 - protein, 9 aa, Homo sapiens
ALVNYIFFK

SEQ ID NO: 43142 - protein, 8 aa, Homo sapiens
AMLSLGTK

SEQ ID NO: 43143 - protein, 12 aa, Homo sapiens
AQIHEGFQELLR

SEQ ID NO: 43144 - protein, 12 aa, Homo sapiens
ATAIFFLPDEGK

SEQ ID NO: 43145 - protein, 27 aa, Homo sapiens
ATAIFFLPDEGKLQHLENELTHDIITK

SEQ ID NO: 43146 - protein, 12 aa, Homo sapiens
AVHKAVLTIDEK

SEQ ID NO: 43147 - protein, 18 aa, Homo sapiens
AVHKAVLTIDEKGTEAAG

SEQ ID NO: 43148 - protein, 19 aa, Homo sapiens
AVHKAVLTIDEKGTEAAGA

SEQ ID NO: 43149 - protein, 21 aa, Homo sapiens
AVHKAVLTIDEKGTEAAGAMF

SEQ ID NO: 43150 - protein, 8 aa, Homo sapiens
AVLTIDEK

SEQ ID NO: 43151 - protein, 9 aa, Homo sapiens
AVLTIDEKG

SEQ ID NO: 43152 - protein, 15 aa, Homo sapiens
AVLTIDEKGTEAAGA

SEQ ID NO: 43153 - protein, 17 aa, Homo sapiens
AVLTIDEKGTEAAGAMF

SEQ ID NO: 43154 - protein, 30 aa, Homo sapiens
AVLTIDEKGTEAAGAMFLEAIPMSIPPEVK

SEQ ID NO: 43155 - protein, 45 aa, Homo sapiens
AVLTIDEKGTEAAGAMFLEAIPMSIPPEVKFNKPFVFLMIEQNTK

SEQ ID NO: 43156 - protein, 20 aa, Homo sapiens
DAAQKTDTSHHDQDHPTFNK

SEQ ID NO: 43157 - protein, 19 aa, Homo sapiens
DEGKLQHLENELTHDIITK

SEQ ID NO: 43158 - protein, 28 aa, Homo sapiens
DEILEGLNFNLTEIPEAQIHEGFQELLR

SEQ ID NO: 43159 - protein, 11 aa, Homo sapiens
DFHVDQVTTVK

SEQ ID NO: 43160 - protein, 12 aa, Homo sapiens
DLSGVTEEAPLK

SEQ ID NO: 43161 - protein, 15 aa, Homo sapiens
DLSGVTEEAPLKLSK

SEQ ID NO: 43162 - protein, 9 aa, Homo sapiens
DPQGDAAQK

SEQ ID NO: 43163 - protein, 9 aa, Homo sapiens
DQDHPTFNK

SEQ ID NO: 43164 - protein, 11 aa, Homo sapiens
DRRSASLHLPK

SEQ ID NO: 43165 - protein, 14 aa, Homo sapiens
DTEEEDFHVDQVTT

SEQ ID NO: 43166 - protein, 16 aa, Homo sapiens
DTEEEDFHVDQVTTVK

SEQ ID NO: 43167 - protein, 21 aa, Homo sapiens
DTEEEDFHVDQVTTVKVPMMK

SEQ ID NO: 43168 - protein, 31 aa, Homo sapiens
DTHDEILEGLNFNLTEIPEAQIHEGFQELLR

SEQ ID NO: 43169 - protein, 14 aa, Homo sapiens
DTSHHDQDHPTFNK

SEQ ID NO: 43170 - protein, 13 aa, Homo sapiens
DTVFALVNYIFFK

SEQ ID NO: 43171 - protein, 23 aa, Homo sapiens
DVKKLYHSEAFTVNFGDTEEAKK

SEQ ID NO: 43172 - protein, 12 aa, Homo sapiens
EAIPMSIPPEVK

SEQ ID NO: 43173 - protein, 13 aa, Homo sapiens
EAQIHEGFQELLR

SEQ ID NO: 43174 - protein, 25 aa, Homo sapiens
EDPQGDAAQKTDTSHHDQDHPTFNK

SEQ ID NO: 43175 - protein, 39 aa, Homo sapiens
EDPQGDAAQKTDTSHHDQDHPTFNKITPNLAEFAFSLYR

SEQ ID NO: 43176 - protein, 13 aa, Homo sapiens
EEDFHVDQVTTVK

SEQ ID NO: 43177 - protein, 14 aa, Homo sapiens
EEEDFHVDQVTTVK

SEQ ID NO: 43178 - protein, 8 aa, Homo sapiens
EFAFSLYR

SEQ ID NO: 43179 - protein, 8 aa, Homo sapiens
EGFQELLR

SEQ ID NO: 43180 - protein, 18 aa, Homo sapiens
EGKLQHLENELTHDIITK

SEQ ID NO: 43181 - protein, 24 aa, Homo sapiens
EGLNFNLTEIPEAQIHEGFQELLR

SEQ ID NO: 43182 - protein, 27 aa, Homo sapiens
EILEGLNFNLTEIPEAQIHEGFQELLR

SEQ ID NO: 43183 - protein, 16 aa, Homo sapiens
EIPEAQIHEGFQELLR

SEQ ID NO: 43184 - protein, 13 aa, Homo sapiens
ELDRDTVFALVNY

SEQ ID NO: 43185 - protein, 17 aa, Homo sapiens
ELDRDTVFALVNYIFFK

SEQ ID NO: 43186 - protein, 19 aa, Homo sapiens
ELDRDTVFALVNYIFFKGK

SEQ ID NO: 43187 - protein, 9 aa, Homo sapiens
ELTHDIITK

SEQ ID NO: 43188 - protein, 11 aa, Homo sapiens
ENELTHDIITK

SEQ ID NO: 43189 - protein, 8 aa, Homo sapiens
FFLPDEGK

SEQ ID NO: 43190 - protein, 23 aa, Homo sapiens
FFLPDEGKLQHLENELTHDIITK

SEQ ID NO: 43191 - protein, 10 aa, Homo sapiens
FHVDQVTTVK

SEQ ID NO: 43192 - protein, 14 aa, Homo sapiens
FLEAIPMSIPPEVK

SEQ ID NO: 43193 - protein, 6 aa, Homo sapiens
FLEDVK

SEQ ID NO: 43194 - protein, 7 aa, Homo sapiens
FLEDVKK

SEQ ID NO: 43195 - protein, 7 aa, Homo sapiens
FLENEDR

SEQ ID NO: 43196 - protein, 8 aa, Homo sapiens
FLENEDRR

SEQ ID NO: 43197 - protein, 16 aa, Homo sapiens
FLMIEQNTKSPLFMGK

SEQ ID NO: 43198 - protein, 22 aa, Homo sapiens
FLPDEGKLQHLENELTHDIITK

SEQ ID NO: 43199 - protein, 7 aa, Homo sapiens
FNKPFVF

SEQ ID NO: 43200 - protein, 8 aa, Homo sapiens
FNKPFVFL

SEQ ID NO: 43201 - protein, 9 aa, Homo sapiens
FNKPFVFLM

SEQ ID NO: 43202 - protein, 12 aa, Homo sapiens
FNKPFVFLMIEQ

SEQ ID NO: 43203 - protein, 13 aa, Homo sapiens
FNKPFVFLMIEQN

SEQ ID NO: 43204 - protein, 15 aa, Homo sapiens
FNKPFVFLMIEQNTK

SEQ ID NO: 43205 - protein, 22 aa, Homo sapiens
FNKPFVFLMIEQNTKSPLFMGK

SEQ ID NO: 43206 - protein, 29 aa, Homo sapiens
FNKPFVFLMIEQNTKSPLFMGKVVNPTQK

SEQ ID NO: 43207 - protein, 20 aa, Homo sapiens
FNLTEIPEAQIHEGFQELLR

SEQ ID NO: 43208 - protein, 17 aa, Homo sapiens
FSNGADLSGVTEEAPLK

SEQ ID NO: 43209 - protein, 20 aa, Homo sapiens
FSNGADLSGVTEEAPLKLSK

SEQ ID NO: 43210 - protein, 18 aa, Homo sapiens
FSPVSIATAFAMLSLGTK

SEQ ID NO: 43211 - protein, 14 aa, Homo sapiens
GADLSGVTEEAPLK

SEQ ID NO: 43212 - protein, 17 aa, Homo sapiens
GADLSGVTEEAPLKLSK

SEQ ID NO: 43213 - protein, 21 aa, Homo sapiens
GADLSGVTEEAPLKLSKAVHK

SEQ ID NO: 43214 - protein, 25 aa, Homo sapiens
GITKVFSNGADLSGVTEEAPLKLSK

SEQ ID NO: 43215 - protein, 17 aa, Homo sapiens
GKLQHLENELTHDIITK

SEQ ID NO: 43216 - protein, 10 aa, Homo sapiens
GKWERPFEVK

SEQ ID NO: 43217 - protein, 26 aa, Homo sapiens
GKWERPFEVKDTEEEDFHVDQVTTVK

SEQ ID NO: 43218 - protein, 31 aa, Homo sapiens
GKWERPFEVKDTEEEDFHVDQVTTVKVPMMK

SEQ ID NO: 43219 - protein, 9 aa, Homo sapiens
GLFLSEGLK

SEQ ID NO: 43220 - protein, 23 aa, Homo sapiens
GLNFNLTEIPEAQIHEGFQELLR

SEQ ID NO: 43221 - protein, 9 aa, Homo sapiens
GMFNIQHCK

SEQ ID NO: 43222 - protein, 14 aa, Homo sapiens
GNATAIFFLPDEGK

SEQ ID NO: 43223 - protein, 29 aa, Homo sapiens
GNATAIFFLPDEGKLQHLENELTHDIITK

SEQ ID NO: 43224 - protein, 7 aa, Homo sapiens
GQLGITK

SEQ ID NO: 43225 - protein, 28 aa, Homo sapiens
GQLGITKVFSNGADLSGVTEEAPLKLSK

SEQ ID NO: 43226 - protein, 13 aa, Homo sapiens
GTEAAGAMFLEAI

SEQ ID NO: 43227 - protein, 15 aa, Homo sapiens
GTEAAGAMFLEAIPM

SEQ ID NO: 43228 - protein, 22 aa, Homo sapiens
GTEAAGAMFLEAIPMSIPPEVK

SEQ ID NO: 43229 - protein, 11 aa, Homo sapiens
GTQGKIVDLVK

SEQ ID NO: 43230 - protein, 28 aa, Homo sapiens
GTQGKIVDLVKELDRDTVFALVNYIFFK

SEQ ID NO: 43231 - protein, 9 aa, Homo sapiens
GVTEEAPLK

SEQ ID NO: 43232 - protein, 10 aa, Homo sapiens
HDQDHPTFNK

SEQ ID NO: 43233 - protein, 9 aa, Homo sapiens
HEGFQELLR

SEQ ID NO: 43234 - protein, 13 aa, Homo sapiens
HLENELTHDIITK

SEQ ID NO: 43235 - protein, 16 aa, Homo sapiens
HSEAFTVNFGDTEEAK

SEQ ID NO: 43236 - protein, 17 aa, Homo sapiens
HSEAFTVNFGDTEEAKK

SEQ ID NO: 43237 - protein, 9 aa, Homo sapiens
HVDQVTTVK

SEQ ID NO: 43238 - protein, 13 aa, Homo sapiens
IEQNTKSPLFMGK

SEQ ID NO: 43239 - protein, 9 aa, Homo sapiens
IFFLPDEGK

SEQ ID NO: 43240 - protein, 24 aa, Homo sapiens
IFFLPDEGKLQHLENELTHDIITK

SEQ ID NO: 43241 - protein, 10 aa, Homo sapiens
IHEGFQELLR

SEQ ID NO: 43242 - protein, 15 aa, Homo sapiens
IPEAQIHEGFQELLR

SEQ ID NO: 43243 - protein, 8 aa, Homo sapiens
ITGTYDLK

SEQ ID NO: 43244 - protein, 24 aa, Homo sapiens
ITKVFSNGADLSGVTEEAPLKLSK

SEQ ID NO: 43245 - protein, 9 aa, Homo sapiens
ITPNLAEFA

SEQ ID NO: 43246 - protein, 10 aa, Homo sapiens
ITPNLAEFAF

SEQ ID NO: 43247 - protein, 14 aa, Homo sapiens
ITPNLAEFAFSLYR

SEQ ID NO: 43248 - protein, 6 aa, Homo sapiens
IVDLVK

SEQ ID NO: 43249 - protein, 23 aa, Homo sapiens
IVDLVKELDRDTVFALVNYIFFK

SEQ ID NO: 43250 - protein, 33 aa, Homo sapiens
KADTHDEILEGLNFNLTEIPEAQIHEGFQELLR

SEQ ID NO: 43251 - protein, 34 aa, Homo sapiens
KADTHDEILEGLNFNLTEIPEAQIHEGFQELLRT

SEQ ID NO: 43252 - protein, 15 aa, Homo sapiens
KITPNLAEFAFSLYR

SEQ ID NO: 43253 - protein, 11 aa, Homo sapiens
KKLSSWVLLMK

SEQ ID NO: 43254 - protein, 16 aa, Homo sapiens
KLQHLENELTHDIITK

SEQ ID NO: 43255 - protein, 10 aa, Homo sapiens
KLSSWVLLMK

SEQ ID NO: 43256 - protein, 18 aa, Homo sapiens
KLSSWVLLMKYLGNATAI

SEQ ID NO: 43257 - protein, 26 aa, Homo sapiens
KLSSWVLLMKYLGNATAIFFLPDEGK

SEQ ID NO: 43258 - protein, 8 aa, Homo sapiens
KLYHSEAF

SEQ ID NO: 43259 - protein, 11 aa, Homo sapiens
KLYHSEAFTVN

SEQ ID NO: 43260 - protein, 19 aa, Homo sapiens
KLYHSEAFTVNFGDTEEAK

SEQ ID NO: 43261 - protein, 20 aa, Homo sapiens
KLYHSEAFTVNFGDTEEAKK

SEQ ID NO: 43262 - protein, 33 aa, Homo sapiens
KLYHSEAFTVNFGDTEEAKKQINDYVEKGTQGK

SEQ ID NO: 43263 - protein, 13 aa, Homo sapiens
KPFVFLMIEQNTK

SEQ ID NO: 43264 - protein, 9 aa, Homo sapiens
KQINDYVEK

SEQ ID NO: 43265 - protein, 14 aa, Homo sapiens
KQINDYVEKGTQGK

SEQ ID NO: 43266 - protein, 20 aa, Homo sapiens
KQINDYVEKGTQGKIVDLVK

SEQ ID NO: 43267 - protein, 11 aa, Homo sapiens
KSVLGQLGITK

SEQ ID NO: 43268 - protein, 19 aa, Homo sapiens
KVFSNGADLSGVTEEAPLK

SEQ ID NO: 43269 - protein, 17 aa, Homo sapiens
KYLGNATAIFFLPDEGK

SEQ ID NO: 43270 - protein, 18 aa, Homo sapiens
KYLGNATAIFFLPDEGKL

SEQ ID NO: 43271 - protein, 33 aa, Homo sapiens
KYLGNATAIFFLPDEGKLQHLENELTHDIITKF

SEQ ID NO: 43272 - protein, 10 aa, Homo sapiens
LAEFAFSLYR

SEQ ID NO: 43273 - protein, 13 aa, Homo sapiens
LEAIPMSIPPEVK

SEQ ID NO: 43274 - protein, 25 aa, Homo sapiens
LEGLNFNLTEIPEAQIHEGFQELLR

SEQ ID NO: 43275 - protein, 12 aa, Homo sapiens
LENELTHDIITK

SEQ ID NO: 43276 - protein, 12 aa, Homo sapiens
LFMGKVVNPTQK

SEQ ID NO: 43277 - protein, 26 aa, Homo sapiens
LGITKVFSNGADLSGVTEEAPLKLSK

SEQ ID NO: 43278 - protein, 8 aa, Homo sapiens
LGMFNIQH

SEQ ID NO: 43279 - protein, 10 aa, Homo sapiens
LGMFNIQHCK

SEQ ID NO: 43280 - protein, 11 aa, Homo sapiens
LGMFNIQHCKK

SEQ ID NO: 43281 - protein, 15 aa, Homo sapiens
LGNATAIFFLPDEGK

SEQ ID NO: 43282 - protein, 30 aa, Homo sapiens
LGNATAIFFLPDEGKLQHLENELTHDIITK

SEQ ID NO: 43283 - protein, 8 aa, Homo sapiens
LGQLGITK

SEQ ID NO: 43284 - protein, 29 aa, Homo sapiens
LGQLGITKVFSNGADLSGVTEEAPLKLSK

SEQ ID NO: 43285 - protein, 8 aa, Homo sapiens
LMIEQNTK

SEQ ID NO: 43286 - protein, 15 aa, Homo sapiens
LMIEQNTKSPLFMGK

SEQ ID NO: 43287 - protein, 22 aa, Homo sapiens
LNFNLTEIPEAQIHEGFQELLR

SEQ ID NO: 43288 - protein, 21 aa, Homo sapiens
LPDEGKLQHLENELTHDIITK

SEQ ID NO: 43289 - protein, 10 aa, Homo sapiens
LQHLENELTH

SEQ ID NO: 43290 - protein, 11 aa, Homo sapiens
LQHLENELTHD

SEQ ID NO: 43291 - protein, 15 aa, Homo sapiens
LQHLENELTHDIITK

SEQ ID NO: 43292 - protein, 22 aa, Homo sapiens
LQHLENELTHDIITKFLENEDR

SEQ ID NO: 43293 - protein, 23 aa, Homo sapiens
LQHLENELTHDIITKFLENEDRR

SEQ ID NO: 43294 - protein, 11 aa, Homo sapiens
LSGVTEEAPLK

SEQ ID NO: 43295 - protein, 14 aa, Homo sapiens
LSGVTEEAPLKLSK

SEQ ID NO: 43296 - protein, 10 aa, Homo sapiens
LSITGTYDLK

SEQ ID NO: 43297 - protein, 20 aa, Homo sapiens
LSITGTYDLKSVLGQLGITK

SEQ ID NO: 43298 - protein, 9 aa, Homo sapiens
LSSWVLLMK

SEQ ID NO: 43299 - protein, 25 aa, Homo sapiens
LSSWVLLMKYLGNATAIFFLPDEGK

SEQ ID NO: 43300 - protein, 18 aa, Homo sapiens
LTEIPEAQIHEGFQELLR

SEQ ID NO: 43301 - protein, 14 aa, Homo sapiens
LTTGNGLFLSEGLK

SEQ ID NO: 43302 - protein, 10 aa, Homo sapiens
LVDKFLEDVK

SEQ ID NO: 43303 - protein, 11 aa, Homo sapiens
LVDKFLEDVKK

SEQ ID NO: 43304 - protein, 29 aa, Homo sapiens
LVDKFLEDVKKLYHSEAFTVNFGDTEEAK

SEQ ID NO: 43305 - protein, 30 aa, Homo sapiens
LVDKFLEDVKKLYHSEAFTVNFGDTEEAKK

SEQ ID NO: 43306 - protein, 8 aa, Homo sapiens
LVNYIFFK

SEQ ID NO: 43307 - protein, 12 aa, Homo sapiens
LYHSEAFTVNFG

SEQ ID NO: 43308 - protein, 18 aa, Homo sapiens
LYHSEAFTVNFGDTEEAK

SEQ ID NO: 43309 - protein, 19 aa, Homo sapiens
LYHSEAFTVNFGDTEEAKK

SEQ ID NO: 43310 - protein, 27 aa, Homo sapiens
LYHSEAFTVNFGDTEEAKKQINDYVEK

SEQ ID NO: 43311 - protein, 32 aa, Homo sapiens
LYHSEAFTVNFGDTEEAKKQINDYVEKGTQGK

SEQ ID NO: 43312 - protein, 33 aa, Homo sapiens
LYRQLAHQSNSTNIFFSPVSIATAFAMLSLGTK

SEQ ID NO: 43313 - protein, 8 aa, Homo sapiens
MFNIQHCK

SEQ ID NO: 43314 - protein, 14 aa, Homo sapiens
MIEQNTKSPLFMGK

SEQ ID NO: 43315 - protein, 13 aa, Homo sapiens
NATAIFFLPDEGK

SEQ ID NO: 43316 - protein, 10 aa, Homo sapiens
NELTHDIITK

SEQ ID NO: 43317 - protein, 10 aa, Homo sapiens
NFGDTEEAKK

SEQ ID NO: 43318 - protein, 21 aa, Homo sapiens
NFNLTEIPEAQIHEGFQELLR

SEQ ID NO: 43319 - protein, 15 aa, Homo sapiens
NGADLSGVTEEAPLK

SEQ ID NO: 43320 - protein, 18 aa, Homo sapiens
NGADLSGVTEEAPLKLSK

SEQ ID NO: 43321 - protein, 11 aa, Homo sapiens
NLAEFAFSLYR

SEQ ID NO: 43322 - protein, 19 aa, Homo sapiens
NLTEIPEAQIHEGFQELLR

SEQ ID NO: 43323 - protein, 20 aa, Homo sapiens
PDEGKLQHLENELTHDIITK

SEQ ID NO: 43324 - protein, 20 aa, Homo sapiens
PDSQLQLTTGNGLFLSEGLK

SEQ ID NO: 43325 - protein, 14 aa, Homo sapiens
PEAQIHEGFQELLR

SEQ ID NO: 43326 - protein, 21 aa, Homo sapiens
PFEVKDTEEEDFHVDQVTTVK

SEQ ID NO: 43327 - protein, 12 aa, Homo sapiens
PFVFLMIEQNTK

SEQ ID NO: 43328 - protein, 19 aa, Homo sapiens
PFVFLMIEQNTKSPLFMGK

SEQ ID NO: 43329 - protein, 6 aa, Homo sapiens
PLFMGK

SEQ ID NO: 43330 - protein, 12 aa, Homo sapiens
PNLAEFAFSLYR

SEQ ID NO: 43331 - protein, 8 aa, Homo sapiens
PQGDAAQK

SEQ ID NO: 43332 - protein, 23 aa, Homo sapiens
PQGDAAQKTDTSHHDQDHPTFNK

SEQ ID NO: 43333 - protein, 16 aa, Homo sapiens
PVSIATAFAMLSLGTK

SEQ ID NO: 43334 - protein, 8 aa, Homo sapiens
QINDYVEK

SEQ ID NO: 43335 - protein, 13 aa, Homo sapiens
QINDYVEKGTQGK

SEQ ID NO: 43336 - protein, 22 aa, Homo sapiens
QLAHQSNSTNIFFSPVSIATAF

SEQ ID NO: 43337 - protein, 23 aa, Homo sapiens
QLAHQSNSTNIFFSPVSIATAFA

SEQ ID NO: 43338 - protein, 24 aa, Homo sapiens
QLAHQSNSTNIFFSPVSIATAFAM

SEQ ID NO: 43339 - protein, 25 aa, Homo sapiens
QLAHQSNSTNIFFSPVSIATAFAML

SEQ ID NO: 43340 - protein, 30 aa, Homo sapiens
QLAHQSNSTNIFFSPVSIATAFAMLSLGTK

SEQ ID NO: 43341 - protein, 27 aa, Homo sapiens
QLGITKVFSNGADLSGVTEEAPLKLSK

SEQ ID NO: 43342 - protein, 11 aa, Homo sapiens
RLGMFNIQHCK

SEQ ID NO: 43343 - protein, 12 aa, Homo sapiens
RLGMFNIQHCKK

SEQ ID NO: 43344 - protein, 32 aa, Homo sapiens
RQLAHQSNSTNIFFSPVSIATAFAMLSLGTKA

SEQ ID NO: 43345 - protein, 9 aa, Homo sapiens
RSASLHLPK

SEQ ID NO: 43346 - protein, 8 aa, Homo sapiens
SASLHLPK

SEQ ID NO: 43347 - protein, 18 aa, Homo sapiens
SASLHLPKLSITGTYDLK

SEQ ID NO: 43348 - protein, 28 aa, Homo sapiens
SASLHLPKLSITGTYDLKSVLGQLGITK

SEQ ID NO: 43349 - protein, 10 aa, Homo sapiens
SGVTEEAPLK

SEQ ID NO: 43350 - protein, 13 aa, Homo sapiens
SGVTEEAPLKLSK

SEQ ID NO: 43351 - protein, 12 aa, Homo sapiens
SHHDQDHPTFNK

SEQ ID NO: 43352 - protein, 14 aa, Homo sapiens
SIATAFAMLSLGTK

SEQ ID NO: 43353 - protein, 7 aa, Homo sapiens
SIPPEVK

SEQ ID NO: 43354 - protein, 9 aa, Homo sapiens
SITGTYDLK

SEQ ID NO: 43355 - protein, 16 aa, Homo sapiens
SNGADLSGVTEEAPLK

SEQ ID NO: 43356 - protein, 19 aa, Homo sapiens
SNGADLSGVTEEAPLKLSK

SEQ ID NO: 43357 - protein, 7 aa, Homo sapiens
SPLFMGK

SEQ ID NO: 43358 - protein, 14 aa, Homo sapiens
SPLFMGKVVNPTQK

SEQ ID NO: 43359 - protein, 17 aa, Homo sapiens
SPVSIATAFAMLSLGTK

SEQ ID NO: 43360 - protein, 18 aa, Homo sapiens
SQLQLTTGNGLFLSEGLK

SEQ ID NO: 43361 - protein, 8 aa, Homo sapiens
SSWVLLMK

SEQ ID NO: 43362 - protein, 23 aa, Homo sapiens
STNIFFSPVSIATAFAMLSLGTK

SEQ ID NO: 43363 - protein, 10 aa, Homo sapiens
SVLGQLGITK

SEQ ID NO: 43364 - protein, 12 aa, Homo sapiens
SVLGQLGITKVF

SEQ ID NO: 43365 - protein, 14 aa, Homo sapiens
SVLGQLGITKVFSN

SEQ ID NO: 43366 - protein, 27 aa, Homo sapiens
SVLGQLGITKVFSNGADLSGVTEEAPL

SEQ ID NO: 43367 - protein, 28 aa, Homo sapiens
SVLGQLGITKVFSNGADLSGVTEEAPLK

SEQ ID NO: 43368 - protein, 31 aa, Homo sapiens
SVLGQLGITKVFSNGADLSGVTEEAPLKLSK

SEQ ID NO: 43369 - protein, 23 aa, Homo sapiens
SWVLLMKYLGNATAIFFLPDEGK

SEQ ID NO: 43370 - protein, 11 aa, Homo sapiens
TAIFFLPDEGK

SEQ ID NO: 43371 - protein, 26 aa, Homo sapiens
TAIFFLPDEGKLQHLENELTHDIITK

SEQ ID NO: 43372 - protein, 15 aa, Homo sapiens
TDTSHHDQDHPTFNK

SEQ ID NO: 43373 - protein, 23 aa, Homo sapiens
TDTSHHDQDHPTFNKITPNLAEF

SEQ ID NO: 43374 - protein, 29 aa, Homo sapiens
TDTSHHDQDHPTFNKITPNLAEFAFSLYR

SEQ ID NO: 43375 - protein, 17 aa, Homo sapiens
TEIPEAQIHEGFQELLR

SEQ ID NO: 43376 - protein, 30 aa, Homo sapiens
THDEILEGLNFNLTEIPEAQIHEGFQELLR

SEQ ID NO: 43377 - protein, 16 aa, Homo sapiens
TKSPLFMGKVVNPTQK

SEQ ID NO: 43378 - protein, 11 aa, Homo sapiens
TLNQPDSQLQL

SEQ ID NO: 43379 - protein, 15 aa, Homo sapiens
TLNQPDSQLQLTTGN

SEQ ID NO: 43380 - protein, 24 aa, Homo sapiens
TLNQPDSQLQLTTGNGLFLSEGLK

SEQ ID NO: 43381 - protein, 28 aa, Homo sapiens
TLNQPDSQLQLTTGNGLFLSEGLKLVDK

SEQ ID NO: 43382 - protein, 35 aa, Homo sapiens
TLNQPDSQLQLTTGNGLFLSEGLKLVDKFLEDVKK

SEQ ID NO: 43383 - protein, 13 aa, Homo sapiens
TPNLAEFAFSLYR

SEQ ID NO: 43384 - protein, 13 aa, Homo sapiens
TSHHDQDHPTFNK

SEQ ID NO: 43385 - protein, 27 aa, Homo sapiens
TSHHDQDHPTFNKITPNLAEFAFSLYR

SEQ ID NO: 43386 - protein, 13 aa, Homo sapiens
TTGNGLFLSEGLK

SEQ ID NO: 43387 - protein, 11 aa, Homo sapiens
TVNFGDTEEAK

SEQ ID NO: 43388 - protein, 12 aa, Homo sapiens
TVNFGDTEEAKK

SEQ ID NO: 43389 - protein, 10 aa, Homo sapiens
VDKFLEDVKK

SEQ ID NO: 43390 - protein, 11 aa, Homo sapiens
VFALVNYIFFK

SEQ ID NO: 43391 - protein, 10 aa, Homo sapiens
VFLMIEQNTK

SEQ ID NO: 43392 - protein, 18 aa, Homo sapiens
VFSNGADLSGVTEEAPLK

SEQ ID NO: 43393 - protein, 19 aa, Homo sapiens
VFSNGADLSGVTEEAPLKL

SEQ ID NO: 43394 - protein, 20 aa, Homo sapiens
VFSNGADLSGVTEEAPLKLS

SEQ ID NO: 43395 - protein, 21 aa, Homo sapiens
VFSNGADLSGVTEEAPLKLSK

SEQ ID NO: 43396 - protein, 25 aa, Homo sapiens
VFSNGADLSGVTEEAPLKLSKAVHK

SEQ ID NO: 43397 - protein, 7 aa, Homo sapiens
VNYIFFK

SEQ ID NO: 43398 - protein, 6 aa, Homo sapiens
VVNPTQ

SEQ ID NO: 43399 - protein, 7 aa, Homo sapiens
VVNPTQK

SEQ ID NO: 43400 - protein, 8 aa, Homo sapiens
WERPFEVK

SEQ ID NO: 43401 - protein, 24 aa, Homo sapiens
WERPFEVKDTEEEDFHVDQVTTVK

SEQ ID NO: 43402 - protein, 13 aa, Homo sapiens
YLGNATAIFFLPD

SEQ ID NO: 43403 - protein, 16 aa, Homo sapiens
YLGNATAIFFLPDEGK

SEQ ID NO: 43404 - protein, 17 aa, Homo sapiens
YLGNATAIFFLPDEGKL

SEQ ID NO: 43405 - protein, 18 aa, Homo sapiens
YLGNATAIFFLPDEGKLQ

SEQ ID NO: 43406 - protein, 19 aa, Homo sapiens
YLGNATAIFFLPDEGKLQH

SEQ ID NO: 43407 - protein, 22 aa, Homo sapiens
YLGNATAIFFLPDEGKLQHLEN

SEQ ID NO: 43408 - protein, 24 aa, Homo sapiens
YLGNATAIFFLPDEGKLQHLENEL

SEQ ID NO: 43409 - protein, 25 aa, Homo sapiens
YLGNATAIFFLPDEGKLQHLENELT

SEQ ID NO: 43410 - protein, 27 aa, Homo sapiens
YLGNATAIFFLPDEGKLQHLENELTHD

SEQ ID NO: 43411 - protein, 31 aa, Homo sapiens
YLGNATAIFFLPDEGKLQHLENELTHDIITK

SEQ ID NO: 43412 - protein, 21 aa, Homo sapiens
ESSRSSQEIETSSCLDSLSSK

SEQ ID NO: 43413 - protein, 19 aa, Homo sapiens
RENSTFSINDAASHTSTMS

SEQ ID NO: 43414 - protein, 24 aa, Homo sapiens
RNTTTGASAAAVASLVSGPLSHSA

SEQ ID NO: 43415 - protein, 21 aa, Homo sapiens
SNELVMSCPYFRNEIGGEGER

SEQ ID NO: 43416 - protein, 9 aa, Homo sapiens
SSTYPSLPK

SEQ ID NO: 43417 - protein, 14 aa, Homo sapiens
LIDAVGFSPLRILR

SEQ ID NO: 43418 - protein, 22 aa, Homo sapiens
PEGVKIFRCPSPIYFANIGFFR

SEQ ID NO: 43419 - protein, 9 aa, Homo sapiens
VCCSCSPQK

SEQ ID NO: 43420 - protein, 10 aa, Homo sapiens
VYEVPVETKF

SEQ ID NO: 43421 - protein, 26 aa, Homo sapiens
RDLHLSITDDYDNHTGIDLVGTIIAT

SEQ ID NO: 43422 - protein, 20 aa, Homo sapiens
CLTQSGIAGGYKPFNLETCR

SEQ ID NO: 43423 - protein, 12 aa, Homo sapiens
ITFDDYIACCVK

SEQ ID NO: 43424 - protein, 35 aa, Homo sapiens
PGGPAFPGQTQDPLYGYFAAVAGQDGQIDADELQR

SEQ ID NO: 43425 - protein, 29 aa, Homo sapiens
PGQTQDPLYGYFAAVAGQDGQIDADELQR

SEQ ID NO: 43426 - protein, 22 aa, Homo sapiens
NEFVSLINCSSQPPLISHGIGK

SEQ ID NO: 43427 - protein, 22 aa, Homo sapiens
REFVMQVKVGNHTAEGTGTNKK

SEQ ID NO: 43428 - protein, 22 aa, Homo sapiens
TKPIVKPQTSPEYGQGINPISR

SEQ ID NO: 43429 - protein, 35 aa, Homo sapiens
AEQSHDDSSSEDSDAETDGQASGGSDSGDWIFTIR

SEQ ID NO: 43430 - protein, 9 aa, Homo sapiens
EFVEACLNK

SEQ ID NO: 43431 - protein, 31 aa, Homo sapiens
IIDLEEAEDEIEDIQQEITVLSQCDSPYVTK

SEQ ID NO: 43432 - protein, 19 aa, Homo sapiens
RPFSQCLSTIISPLFAELK

SEQ ID NO: 43433 - protein, 22 aa, Homo sapiens
LGQRWYLANFSHATSFNFTTRE

SEQ ID NO: 43434 - protein, 24 aa, Homo sapiens
LEQLILSDTGISSLHFPDAGIGCK

SEQ ID NO: 43435 - protein, 17 aa, Homo sapiens
NLLSSWDEVIHIADQLR

SEQ ID NO: 43436 - protein, 13 aa, Homo sapiens
TLNKCEILPEERR

SEQ ID NO: 43437 - protein, 22 aa, Homo sapiens
RGHKISDYFEYQGGNGSSPVRG

SEQ ID NO: 43438 - protein, 28 aa, Homo sapiens
KINSSSVCVSSISENDNGISFTCRLGRD

SEQ ID NO: 43439 - protein, 32 aa, Homo sapiens
FDKSKLKKTETQEKNPLPSKETIEQEKQAGES

SEQ ID NO: 43440 - protein, 13 aa, Homo sapiens
KTETQEKNPLPSK

SEQ ID NO: 43441 - protein, 21 aa, Homo sapiens
KTETQEKNPLPSKETIEQEKQ

SEQ ID NO: 43442 - protein, 25 aa, Homo sapiens
KTETQEKNPLPSKETIEQEKQAGES

SEQ ID NO: 43443 - protein, 15 aa, Homo sapiens
LKKTETQEKNPLPSK

SEQ ID NO: 43444 - protein, 27 aa, Homo sapiens
LKKTETQEKNPLPSKETIEQEKQAGES

SEQ ID NO: 43445 - protein, 11 aa, Homo sapiens
MAEIEKFDKSK

SEQ ID NO: 43446 - protein, 13 aa, Homo sapiens
NPLPSKETIEQEK

SEQ ID NO: 43447 - protein, 18 aa, Homo sapiens
NPLPSKETIEQEKQAGES

SEQ ID NO: 43448 - protein, 17 aa, Homo sapiens
PLPSKETIEQEKQAGES

SEQ ID NO: 43449 - protein, 15 aa, Homo sapiens
PSKETIEQEKQAGES

SEQ ID NO: 43450 - protein, 29 aa, Homo sapiens
SKLKKTETQEKNPLPSKETIEQEKQAGES

SEQ ID NO: 43451 - protein, 12 aa, Homo sapiens
TETQEKNPLPSK

SEQ ID NO: 43452 - protein, 24 aa, Homo sapiens
TETQEKNPLPSKETIEQEKQAGES

SEQ ID NO: 43453 - protein, 8 aa, Homo sapiens
ATTVSTQR

SEQ ID NO: 43454 - protein, 14 aa, Homo sapiens
GPVYIGELPQDFLR

SEQ ID NO: 43455 - protein, 13 aa, Homo sapiens
IAWTHITIPESLR

SEQ ID NO: 43456 - protein, 9 aa, Homo sapiens
LNITVVQAK

SEQ ID NO: 43457 - protein, 24 aa, Homo sapiens
ENGSDNLPSSAGSGDKPLSDPAPF

SEQ ID NO: 43458 - protein, 21 aa, Homo sapiens
TPAVEGLTEAEEEELRAELTK

SEQ ID NO: 43459 - protein, 30 aa, Homo sapiens
TPAVEGLTEAEEEELRAELTKVEEEIVTLR

SEQ ID NO: 43460 - protein, 20 aa, Homo sapiens
FQLLVQQVALGTMMHCQTLK

SEQ ID NO: 43461 - protein, 27 aa, Homo sapiens
LGQHVVGMAPLSVGSLDDEPGGEAETK

SEQ ID NO: 43462 - protein, 24 aa, Homo sapiens
LLDPSITLGQYVQPQGVSVVDFVR

SEQ ID NO: 43463 - protein, 22 aa, Homo sapiens
VPSGFYVGSYVHGAMQSPSLHK

SEQ ID NO: 43464 - protein, 11 aa, Homo sapiens
IVNETLYENTK

SEQ ID NO: 43465 - protein, 10 aa, Homo sapiens
LLSATGESEK

SEQ ID NO: 43466 - protein, 28 aa, Homo sapiens
MISNMSEESANMIASALAQIPQKVLWRF

SEQ ID NO: 43467 - protein, 5 aa, Homo sapiens
DLIFK

SEQ ID NO: 43468 - protein, 16 aa, Homo sapiens
HVPCVEDEDFIQALDK

SEQ ID NO: 43469 - protein, 17 aa, Homo sapiens
ISDVNCAVHLCSLFHQR

SEQ ID NO: 43470 - protein, 27 aa, Homo sapiens
ICISGDSAGGNLAAALGQQFTQDASLK

SEQ ID NO: 43471 - protein, 15 aa, Homo sapiens
RLNWTSLLPASFTKN

SEQ ID NO: 43472 - protein, 12 aa, Homo sapiens
TYILTCEHDVLR

SEQ ID NO: 43473 - protein, 18 aa, Homo sapiens
EAYMGNVLQGGEGQAPTR

SEQ ID NO: 43474 - protein, 13 aa, Homo sapiens
FGNEVIPVTVTVK

SEQ ID NO: 43475 - protein, 12 aa, Homo sapiens
IHMGSCAENTAK

SEQ ID NO: 43476 - protein, 27 aa, Homo sapiens
IVAFADAAVEPIDFPIAPVYAASMVLK

SEQ ID NO: 43477 - protein, 10 aa, Homo sapiens
IVGHLTHALK

SEQ ID NO: 43478 - protein, 13 aa, Homo sapiens
NEQDAYAINSYTR

SEQ ID NO: 43479 - protein, 19 aa, Homo sapiens
QAVLGAGLPISTPCTTINK

SEQ ID NO: 43480 - protein, 9 aa, Homo sapiens
RLNVTPLAR

SEQ ID NO: 43481 - protein, 17 aa, Homo sapiens
TPIGSFLGSLSLLPATK

SEQ ID NO: 43482 - protein, 20 aa, Homo sapiens
VNINGGAVSLGHPIGMSGAR

SEQ ID NO: 43483 - protein, 21 aa, Homo sapiens
DLYANNVLSGGTTMYPGIADR

SEQ ID NO: 43484 - protein, 15 aa, Homo sapiens
AIDTIYQTTDFSGIR

SEQ ID NO: 43485 - protein, 25 aa, Homo sapiens
DFDDGVLGLAWVGAPSGSSGGICEK

SEQ ID NO: 43486 - protein, 12 aa, Homo sapiens
EAVIAQISSHVK

SEQ ID NO: 43487 - protein, 8 aa, Homo sapiens
FEGFIQTR

SEQ ID NO: 43488 - protein, 22 aa, Homo sapiens
FLELNSEQNHDDYCLAYVFTDR

SEQ ID NO: 43489 - protein, 8 aa, Homo sapiens
FPNIGVEK

SEQ ID NO: 43490 - protein, 10 aa, Homo sapiens
LVDADGPLAR

SEQ ID NO: 43491 - protein, 15 aa, Homo sapiens
NTCQLYIQTDHLFFK

SEQ ID NO: 43492 - protein, 27 aa, Homo sapiens
REGICNGFTALCPASDPKPNFTDCNRH

SEQ ID NO: 43493 - protein, 10 aa, Homo sapiens
RINTTADEKD

SEQ ID NO: 43494 - protein, 10 aa, Homo sapiens
RNISQVLEKK

SEQ ID NO: 43495 - protein, 19 aa, Homo sapiens
SLNTGIITVQNYGSHVPPK

SEQ ID NO: 43496 - protein, 30 aa, Homo sapiens
VSHITFAHEVGHNFGSPHDSGTECTPGESK

SEQ ID NO: 43497 - protein, 14 aa, Homo sapiens
AGHTEVAKYLLQNK

SEQ ID NO: 43498 - protein, 16 aa, Homo sapiens
AGHTEVAKYLLQNKAK

SEQ ID NO: 43499 - protein, 13 aa, Homo sapiens
AKDDQTPLHCAAR

SEQ ID NO: 43500 - protein, 13 aa, Homo sapiens
ITHSPTVSQVTER

SEQ ID NO: 43501 - protein, 19 aa, Homo sapiens
KLVYANECANFTTNVSARF

SEQ ID NO: 43502 - protein, 22 aa, Homo sapiens
LVKPQKLSTPPPLAEEEGLASR

SEQ ID NO: 43503 - protein, 22 aa, Homo sapiens
NDDTRTAAVLLQNDPNPDVLSK

SEQ ID NO: 43504 - protein, 28 aa, Homo sapiens
RQDDATGAGQDSENEVSLVSGHQRGQAR

SEQ ID NO: 43505 - protein, 15 aa, Homo sapiens
SVGFREADAATSFLR

SEQ ID NO: 43506 - protein, 12 aa, Homo sapiens
VLLDKGAKPNSR

SEQ ID NO: 43507 - protein, 16 aa, Homo sapiens
YSVGFREADAATSFLR

SEQ ID NO: 43508 - protein, 18 aa, Homo sapiens
HTDRDYSLSPSQMNGHQR

SEQ ID NO: 43509 - protein, 11 aa, Homo sapiens
DGLTPLHCGAR

SEQ ID NO: 43510 - protein, 23 aa, Homo sapiens
DIEVLEGKPIYVDCYGNLAPLTK

SEQ ID NO: 43511 - protein, 22 aa, Homo sapiens
EGHEDVAAFLLDHGASLSITTK

SEQ ID NO: 43512 - protein, 18 aa, Homo sapiens
GLPQTAVCNLNITLPAHK

SEQ ID NO: 43513 - protein, 21 aa, Homo sapiens
IDIVTLLEGPIFDYGNISGTR

SEQ ID NO: 43514 - protein, 19 aa, Homo sapiens
IHGSGHVEEPASPLAAYQK

SEQ ID NO: 43515 - protein, 22 aa, Homo sapiens
KDEHAQSNEIVVNDSGSDNVKK

SEQ ID NO: 43516 - protein, 23 aa, Homo sapiens
NEDLTELLNGMDEELDSPEELGK

SEQ ID NO: 43517 - protein, 18 aa, Homo sapiens
RDGKNATTDALTSVLTKI

SEQ ID NO: 43518 - protein, 25 aa, Homo sapiens
SKDIEVLEGKPIYVDCYGNLAPLTK

SEQ ID NO: 43519 - protein, 19 aa, Homo sapiens
TVVSQSPYNIQVSSGTLAR

SEQ ID NO: 43520 - protein, 17 aa, Homo sapiens
AEDGSVIDYELIDQDAR

SEQ ID NO: 43521 - protein, 19 aa, Homo sapiens
AFLNLVQCIQNKPLYFADR

SEQ ID NO: 43522 - protein, 10 aa, Homo sapiens
ALLYLCGGDD

SEQ ID NO: 43523 - protein, 9 aa, Homo sapiens
AYTNFDAER

SEQ ID NO: 43524 - protein, 19 aa, Homo sapiens
AYTNFDAERDALNIETAIK

SEQ ID NO: 43525 - protein, 12 aa, Homo sapiens
CIQNKPLYFADR

SEQ ID NO: 43526 - protein, 10 aa, Homo sapiens
DALNIETAIK

SEQ ID NO: 43527 - protein, 15 aa, Homo sapiens
DGSVIDYELIDQDAR

SEQ ID NO: 43528 - protein, 11 aa, Homo sapiens
DIISDTSGDFR

SEQ ID NO: 43529 - protein, 12 aa, Homo sapiens
DIISDTSGDFRK

SEQ ID NO: 43530 - protein, 8 aa, Homo sapiens
DLYDAGVK

SEQ ID NO: 43531 - protein, 9 aa, Homo sapiens
DLYDAGVKR

SEQ ID NO: 43532 - protein, 7 aa, Homo sapiens
ELASALK

SEQ ID NO: 43533 - protein, 21 aa, Homo sapiens
ENAFLNLVQCIQNKPLYFADR

SEQ ID NO: 43534 - protein, 18 aa, Homo sapiens
FLNLVQCIQNKPLYFADR

SEQ ID NO: 43535 - protein, 17 aa, Homo sapiens
GDLENAFLNLVQCIQNK

SEQ ID NO: 43536 - protein, 19 aa, Homo sapiens
GDLENAFLNLVQCIQNKPL

SEQ ID NO: 43537 - protein, 20 aa, Homo sapiens
GDLENAFLNLVQCIQNKPLY

SEQ ID NO: 43538 - protein, 21 aa, Homo sapiens
GDLENAFLNLVQCIQNKPLYF

SEQ ID NO: 43539 - protein, 24 aa, Homo sapiens
GDLENAFLNLVQCIQNKPLYFADR

SEQ ID NO: 43540 - protein, 16 aa, Homo sapiens
GLGTDEDSLIEIICSR

SEQ ID NO: 43541 - protein, 14 aa, Homo sapiens
GVDEVTIVNILTNR

SEQ ID NO: 43542 - protein, 9 aa, Homo sapiens
ISDTSGDFR

SEQ ID NO: 43543 - protein, 7 aa, Homo sapiens
LMVALAK

SEQ ID NO: 43544 - protein, 17 aa, Homo sapiens
LNLVQCIQNKPLYFADR

SEQ ID NO: 43545 - protein, 14 aa, Homo sapiens
LSGHLETVILGLLK

SEQ ID NO: 43546 - protein, 18 aa, Homo sapiens
LSLEGDHSTPPSAYGSVK

SEQ ID NO: 43547 - protein, 15 aa, Homo sapiens
LVQCIQNKPLYFADR

SEQ ID NO: 43548 - protein, 20 aa, Homo sapiens
NAFLNLVQCIQNKPLYFADR

SEQ ID NO: 43549 - protein, 16 aa, Homo sapiens
NLVQCIQNKPLYFADR

SEQ ID NO: 43550 - protein, 10 aa, Homo sapiens
PAQYDASELK

SEQ ID NO: 43551 - protein, 9 aa, Homo sapiens
QDIAFAYQR

SEQ ID NO: 43552 - protein, 18 aa, Homo sapiens
RAEDGSVIDYELIDQDAR

SEQ ID NO: 43553 - protein, 16 aa, Homo sapiens
SALSGHLETVILGLLK

SEQ ID NO: 43554 - protein, 7 aa, Homo sapiens
SEVDMLK

SEQ ID NO: 43555 - protein, 13 aa, Homo sapiens
SGHLETVILGLLK

SEQ ID NO: 43556 - protein, 11 aa, Homo sapiens
SLYYYIQQDTK

SEQ ID NO: 43557 - protein, 12 aa, Homo sapiens
SYSPYDMLESIR

SEQ ID NO: 43558 - protein, 13 aa, Homo sapiens
SYSPYDMLESIRK

SEQ ID NO: 43559 - protein, 16 aa, Homo sapiens
TDLEKDIISDTSGDFR

SEQ ID NO: 43560 - protein, 17 aa, Homo sapiens
TDLEKDIISDTSGDFRK

SEQ ID NO: 43561 - protein, 16 aa, Homo sapiens
TKGVDEVTIVNILTNR

SEQ ID NO: 43562 - protein, 10 aa, Homo sapiens
TNQELQEINR

SEQ ID NO: 43563 - protein, 11 aa, Homo sapiens
TPAQYDASELK

SEQ ID NO: 43564 - protein, 8 aa, Homo sapiens
WISIMTER

SEQ ID NO: 43565 - protein, 32 aa, Homo sapiens
AIVDCGFEHPSEVQHECIPQAILGMDVLCQAK

SEQ ID NO: 43566 - protein, 20 aa, Homo sapiens
CIALAQLLVEQNFPAIAIHR

SEQ ID NO: 43567 - protein, 10 aa, Homo sapiens
DFLLKPELLR

SEQ ID NO: 43568 - protein, 22 aa, Homo sapiens
FEVNISELPDEIDISSYIEQTR

SEQ ID NO: 43569 - protein, 14 aa, Homo sapiens
GLAITFVSDENDAK

SEQ ID NO: 43570 - protein, 12 aa, Homo sapiens
GSYVSIHSSGFR

SEQ ID NO: 43571 - protein, 9 aa, Homo sapiens
HFILDECDK

SEQ ID NO: 43572 - protein, 10 aa, Homo sapiens
ILVATNLFGR

SEQ ID NO: 43573 - protein, 12 aa, Homo sapiens
LTLHGLQQYYVK

SEQ ID NO: 43574 - protein, 12 aa, Homo sapiens
NCPHIVVGTPGR

SEQ ID NO: 43575 - protein, 19 aa, Homo sapiens
GLLLSCIEDKNPCIFFEPK

SEQ ID NO: 43576 - protein, 35 aa, Homo sapiens
LLISHEAPLTGGFASEISSTVQEECFLNLEAPISR

SEQ ID NO: 43577 - protein, 17 aa, Homo sapiens
MNLFQSVTSALDNSLAK

SEQ ID NO: 43578 - protein, 28 aa, Homo sapiens
SPWGCVGHGALYHSQSPEAFFAHCPGIK

SEQ ID NO: 43579 - protein, 20 aa, Homo sapiens
VCGYDTPFPHIFEPFYIPDK

SEQ ID NO: 43580 - protein, 38 aa, Homo sapiens
KCGSEVTTPENSSSPGMMDMHDDNSNQSSIADASPIKQ

SEQ ID NO: 43581 - protein, 27 aa, Homo sapiens
KQENSSNSSPAPEPNSAVPSDGTEAKV

SEQ ID NO: 43582 - protein, 15 aa, Homo sapiens
EFESVLVDAFSHVAR

SEQ ID NO: 43583 - protein, 32 aa, Homo sapiens
SHIQSLPDLSLLPNVTGGLAPLPSAGDLFSTD

SEQ ID NO: 43584 - protein, 15 aa, Homo sapiens
TVDEACLLLAEYNGR

SEQ ID NO: 43585 - protein, 23 aa, Homo sapiens
RFQLPGNIGFDCHLNGTASQKKS

SEQ ID NO: 43586 - protein, 22 aa, Homo sapiens
RFYKFNTSLAGDLTNLVHGSHC

SEQ ID NO: 43587 - protein, 23 aa, Homo sapiens
AGAAPYVQAFDSLLAGPVAEYLK

SEQ ID NO: 43588 - protein, 16 aa, Homo sapiens
ALLVTASQCQQPAENK

SEQ ID NO: 43589 - protein, 32 aa, Homo sapiens
ATKKEPAVLELEGKKWRVENQENVSNLVIEDT

SEQ ID NO: 43590 - protein, 16 aa, Homo sapiens
AVGRLEAVSHTSDMHR

SEQ ID NO: 43591 - protein, 11 aa, Homo sapiens
EFHTTGLAWSK

SEQ ID NO: 43592 - protein, 12 aa, Homo sapiens
EMNDAAMFYTNR

SEQ ID NO: 43593 - protein, 8 aa, Homo sapiens
EYKDVDKK

SEQ ID NO: 43594 - protein, 10 aa, Homo sapiens
HAEMVHTGLK

SEQ ID NO: 43595 - protein, 10 aa, Homo sapiens
INSITVDNCK

SEQ ID NO: 43596 - protein, 12 aa, Homo sapiens
LEAVSHTSDMHR

SEQ ID NO: 43597 - protein, 23 aa, Homo sapiens
LFNHLSAVSESIQALGWVAMAPK

SEQ ID NO: 43598 - protein, 18 aa, Homo sapiens
LGLVFDDVVGIVEIINSK

SEQ ID NO: 43599 - protein, 13 aa, Homo sapiens
LSDLLAPISEQIK

SEQ ID NO: 43600 - protein, 11 aa, Homo sapiens
NSLDCEIVSAK

SEQ ID NO: 43601 - protein, 20 aa, Homo sapiens
RVENQENVSNLVIEDTELKQ

SEQ ID NO: 43602 - protein, 25 aa, Homo sapiens
SSEMNVLIPTEGGDFNEFPVPEQFK

SEQ ID NO: 43603 - protein, 10 aa, Homo sapiens
TDGCHAYLSK

SEQ ID NO: 43604 - protein, 18 aa, Homo sapiens
VENQENVSNLVIEDTELK

SEQ ID NO: 43605 - protein, 51 aa, Homo sapiens
GGGGGGGGGGGLGGGLGNVLGGLISGAGGGGGGGGGGGGGGGGGGGGTAMR

SEQ ID NO: 43606 - protein, 24 aa, Homo sapiens
ILGGVISAISEAAAQYNPEPPPPR

SEQ ID NO: 43607 - protein, 23 aa, Homo sapiens
LFAQLAGDDMEVSATELMNILNK

SEQ ID NO: 43608 - protein, 25 aa, Homo sapiens
SGTICSSELPGAFEAAGFHLNEHLY

SEQ ID NO: 43609 - protein, 30 aa, Homo sapiens
SGTICSSELPGAFEAAGFHLNEHLYNMIIR

SEQ ID NO: 43610 - protein, 13 aa, Homo sapiens
SMVAVMDSDTTGK

SEQ ID NO: 43611 - protein, 10 aa, Homo sapiens
TDGFGIDTCR

SEQ ID NO: 43612 - protein, 15 aa, Homo sapiens
THYSNIEANESEEVR

SEQ ID NO: 43613 - protein, 19 aa, Homo sapiens
YSDESGNMDFDNFISCLVR

SEQ ID NO: 43614 - protein, 14 aa, Homo sapiens
AFNSTLPTMAQMEK

SEQ ID NO: 43615 - protein, 12 aa, Homo sapiens
DGTRYVQKGEYR

SEQ ID NO: 43616 - protein, 9 aa, Homo sapiens
FAGVFHVEK

SEQ ID NO: 43617 - protein, 12 aa, Homo sapiens
FAGVFHVEKNGR

SEQ ID NO: 43618 - protein, 16 aa, Homo sapiens
KAFNSTLPTMAQMEKA

SEQ ID NO: 43619 - protein, 10 aa, Homo sapiens
SQEMVHLVNK

SEQ ID NO: 43620 - protein, 24 aa, Homo sapiens
TNPEDIYPSNPTDDDVSSGSSSER

SEQ ID NO: 43621 - protein, 12 aa, Homo sapiens
YGFIEGHVVIPR

SEQ ID NO: 43622 - protein, 13 aa, Homo sapiens
YSISRTEAADLCK

SEQ ID NO: 43623 - protein, 8 aa, Homo sapiens
YVQKGEYR

SEQ ID NO: 43624 - protein, 21 aa, Homo sapiens
DQVTTLEVSVCDCEGAAGVCR

SEQ ID NO: 43625 - protein, 18 aa, Homo sapiens
DTANWLEINPDTGAISTR

SEQ ID NO: 43626 - protein, 19 aa, Homo sapiens
DWVIPPISCPENEKGPFPK

SEQ ID NO: 43627 - protein, 12 aa, Homo sapiens
FKVGTDGVITVK

SEQ ID NO: 43628 - protein, 10 aa, Homo sapiens
GLDARPEVTR

SEQ ID NO: 43629 - protein, 16 aa, Homo sapiens
GQVPENEANVVITTLK

SEQ ID NO: 43630 - protein, 13 aa, Homo sapiens
LTFPNSSPGLRRQ

SEQ ID NO: 43631 - protein, 9 aa, Homo sapiens
MALEVGDYK

SEQ ID NO: 43632 - protein, 14 aa, Homo sapiens
NTGVISVVTTGLDR

SEQ ID NO: 43633 - protein, 16 aa, Homo sapiens
PANPDEIGNFIDENLK

SEQ ID NO: 43634 - protein, 19 aa, Homo sapiens
RAELDREDFEHVKNSTYTA

SEQ ID NO: 43635 - protein, 19 aa, Homo sapiens
SITGQGADTPPVGVFIIER

SEQ ID NO: 43636 - protein, 9 aa, Homo sapiens
TAYFSLDTR

SEQ ID NO: 43637 - protein, 22 aa, Homo sapiens
VFYSITGQGADTPPVGVFIIER

SEQ ID NO: 43638 - protein, 10 aa, Homo sapiens
VGTDGVITVK

SEQ ID NO: 43639 - protein, 9 aa, Homo sapiens
VNFEDCTGR

SEQ ID NO: 43640 - protein, 14 aa, Homo sapiens
RYESHPVCADLQAK

SEQ ID NO: 43641 - protein, 13 aa, Homo sapiens
YESHPVCADLQAK

SEQ ID NO: 43642 - protein, 7 aa, Homo sapiens
FEEILTR

SEQ ID NO: 43643 - protein, 14 aa, Homo sapiens
GGDDLDPNYVLSSR

SEQ ID NO: 43644 - protein, 17 aa, Homo sapiens
LGSSEVEQVQLVVDGVK

SEQ ID NO: 43645 - protein, 14 aa, Homo sapiens
LSVEALNSLTGEFK

SEQ ID NO: 43646 - protein, 12 aa, Homo sapiens
AGVHVRIPKLSK

SEQ ID NO: 43647 - protein, 13 aa, Homo sapiens
ILTCPSNLGTGLR

SEQ ID NO: 43648 - protein, 16 aa, Homo sapiens
LGYILTCPSNLGTGLR

SEQ ID NO: 43649 - protein, 19 aa, Homo sapiens
TLDQCIQTGVDNPGHPFIK

SEQ ID NO: 43650 - protein, 31 aa, Homo sapiens
KDIKKKNINLQPMWQLLPVEQDTSNVTEMKV

SEQ ID NO: 43651 - protein, 24 aa, Homo sapiens
KRDCTEREILISEEEKGNVNLTKT

SEQ ID NO: 43652 - protein, 18 aa, Homo sapiens
ESELSKGGSVDITKETVK

SEQ ID NO: 43653 - protein, 10 aa, Homo sapiens
LDESFYGPEK

SEQ ID NO: 43654 - protein, 22 aa, Homo sapiens
ELYVMEISDNPGVHEPGEPEFK

SEQ ID NO: 43655 - protein, 19 aa, Homo sapiens
GFVKDSITGSGLENATISV

SEQ ID NO: 43656 - protein, 10 aa, Homo sapiens
GFVLDATDGR

SEQ ID NO: 43657 - protein, 14 aa, Homo sapiens
IHLMPSMNPDGYEK

SEQ ID NO: 43658 - protein, 18 aa, Homo sapiens
KDLDTDFTNNASQPETKA

SEQ ID NO: 43659 - protein, 28 aa, Homo sapiens
KDSITGSGLENATISVAGINHNITTGRF

SEQ ID NO: 43660 - protein, 8 aa, Homo sapiens
LLVPGTYK

SEQ ID NO: 43661 - protein, 27 aa, Homo sapiens
LTAGLGSLIPEGDAGPDAAGPDAAGPL

SEQ ID NO: 43662 - protein, 16 aa, Homo sapiens
NFGTDPEVTDLVHNTR

SEQ ID NO: 43663 - protein, 11 aa, Homo sapiens
RFANEYPNITR

SEQ ID NO: 43664 - protein, 12 aa, Homo sapiens
RFANEYPNITRL

SEQ ID NO: 43665 - protein, 22 aa, Homo sapiens
RGILNATISVAEINHPVTTYKT

SEQ ID NO: 43666 - protein, 24 aa, Homo sapiens
RGLVMNYPHITNLTNLGQSTEYRH

SEQ ID NO: 43667 - protein, 22 aa, Homo sapiens
RLLNTTDVYLLPSLNPDGFERA

SEQ ID NO: 43668 - protein, 7 aa, Homo sapiens
SLIQFMK

SEQ ID NO: 43669 - protein, 16 aa, Homo sapiens
SPDDAVFQQIALSYSK

SEQ ID NO: 43670 - protein, 12 aa, Homo sapiens
SQEGDSISVIGR

SEQ ID NO: 43671 - protein, 33 aa, Homo sapiens
SYPFVLSANLHGGSLVVNYPFDDDEQGLATYSK

SEQ ID NO: 43672 - protein, 13 aa, Homo sapiens
YIGNMHGNEVVGR

SEQ ID NO: 43673 - protein, 20 aa, Homo sapiens
RTPQVIGVMQSQNSSAGNRG

SEQ ID NO: 43674 - protein, 28 aa, Homo sapiens
KQQNVDQAVATLQGEGLSVTGTVCHVGK

SEQ ID NO: 43675 - protein, 13 aa, Homo sapiens
LAQDGAHVVVSSR

SEQ ID NO: 43676 - protein, 34 aa, Homo sapiens
EDSGSGMKAELPPGPGAVGREMTKEEKLQLRKEK

SEQ ID NO: 43677 - protein, 24 aa, Homo sapiens
EEKGAEPETGSAVSAAQCQVGPTR

SEQ ID NO: 43678 - protein, 14 aa, Homo sapiens
FLNKEITSVGSSKR

SEQ ID NO: 43679 - protein, 21 aa, Homo sapiens
GAEPETGSAVSAAQCQVGPTR

SEQ ID NO: 43680 - protein, 16 aa, Homo sapiens
GEHVALANWQNHASLR

SEQ ID NO: 43681 - protein, 18 aa, Homo sapiens
ISNGDVILVYGCSSLVSR

SEQ ID NO: 43682 - protein, 17 aa, Homo sapiens
VLLGAHALLANGSVMSR

SEQ ID NO: 43683 - protein, 20 aa, Homo sapiens
VQTDAFVSNELDDPDDLQCK

SEQ ID NO: 43684 - protein, 18 aa, Homo sapiens
FLSPVVPNYDNVHPNYHK

SEQ ID NO: 43685 - protein, 16 aa, Homo sapiens
GDPQVYEELFSYSCPK

SEQ ID NO: 43686 - protein, 17 aa, Homo sapiens
IWNVHSVLNVLHSLVDK

SEQ ID NO: 43687 - protein, 13 aa, Homo sapiens
LHSLLGDYYQAIK

SEQ ID NO: 43688 - protein, 20 aa, Homo sapiens
QLEVYTSGGDPESVAGEYGR

SEQ ID NO: 43689 - protein, 13 aa, Homo sapiens
GNPTVEVDLHTAK

SEQ ID NO: 43690 - protein, 20 aa, Homo sapiens
HIADLAGNPDLILPVPAFNV

SEQ ID NO: 43691 - protein, 15 aa, Homo sapiens
VNQIGSVTESIQACK

SEQ ID NO: 43692 - protein, 9 aa, Homo sapiens
FLSHKLDIK

SEQ ID NO: 43693 - protein, 16 aa, Homo sapiens
KASEYTVSIQSNVSKD

SEQ ID NO: 43694 - protein, 26 aa, Homo sapiens
KLASGVPQLEYHCLGGFYGNLSSQRH

SEQ ID NO: 43695 - protein, 13 aa, Homo sapiens
LAATDPDAGFNGK

SEQ ID NO: 43696 - protein, 16 aa, Homo sapiens
RATVPVYINTTNANKY

SEQ ID NO: 43697 - protein, 16 aa, Homo sapiens
RSNYNLTVEVTDGSRT

SEQ ID NO: 43698 - protein, 19 aa, Homo sapiens
RVPENITLYTPILHTQARS

SEQ ID NO: 43699 - protein, 31 aa, Homo sapiens
SSSNVSQGFEGCLDAVVVNEEALDLLAPGKT

SEQ ID NO: 43700 - protein, 16 aa, Homo sapiens
DDFAYCLNCFCDLYAK

SEQ ID NO: 43701 - protein, 12 aa, Homo sapiens
DNQNFCVPCYEK

SEQ ID NO: 43702 - protein, 17 aa, Homo sapiens
EDQLLCTDCYSNEYSSK

SEQ ID NO: 43703 - protein, 30 aa, Homo sapiens
EESPYCVVCFETLFANTCEECGKPIGCDCK

SEQ ID NO: 43704 - protein, 13 aa, Homo sapiens
FDCHHCNESLFGK

SEQ ID NO: 43705 - protein, 13 aa, Homo sapiens
GSSWHETCFICHR

SEQ ID NO: 43706 - protein, 13 aa, Homo sapiens
HWHEACFHCSQCR

SEQ ID NO: 43707 - protein, 11 aa, Homo sapiens
KPITTGGVTYR

SEQ ID NO: 43708 - protein, 10 aa, Homo sapiens
QWHNDCFNCK

SEQ ID NO: 43709 - protein, 6 aa, Homo sapiens
EALLIK

SEQ ID NO: 43710 - protein, 12 aa, Homo sapiens
ELENTALELSQK

SEQ ID NO: 43711 - protein, 19 aa, Homo sapiens
ELSENINAVTLMKEELKEK

SEQ ID NO: 43712 - protein, 12 aa, Homo sapiens
ELTCQILEQKIK

SEQ ID NO: 43713 - protein, 9 aa, Homo sapiens
EMQETLKKK

SEQ ID NO: 43714 - protein, 11 aa, Homo sapiens
HNKEITVMVEK

SEQ ID NO: 43715 - protein, 21 aa, Homo sapiens
KTEALLEAKTNELINISSSKT

SEQ ID NO: 43716 - protein, 14 aa, Homo sapiens
LKAEMDEQIKTIEK

SEQ ID NO: 43717 - protein, 14 aa, Homo sapiens
NQSKDLAVHLEAEK

SEQ ID NO: 43718 - protein, 13 aa, Homo sapiens
EDPTVSALLTSEK

SEQ ID NO: 43719 - protein, 34 aa, Homo sapiens
EDPTVSALLTSEKDWQGFLELYLQNSPEACDYGL

SEQ ID NO: 43720 - protein, 31 aa, Homo sapiens
GLVPVLENSQGQLIYESAITCEYLDEAYPGK

SEQ ID NO: 43721 - protein, 32 aa, Homo sapiens
GLVPVLENSQGQLIYESAITCEYLDEAYPGKK

SEQ ID NO: 43722 - protein, 14 aa, Homo sapiens
GSAPPGPVPEGSIR

SEQ ID NO: 43723 - protein, 9 aa, Homo sapiens
HEVININLK

SEQ ID NO: 43724 - protein, 35 aa, Homo sapiens
KNPFGLVPVLENSQGQLIYESAITCEYLDEAYPGK

SEQ ID NO: 43725 - protein, 10 aa, Homo sapiens
LNECVDHTPK

SEQ ID NO: 43726 - protein, 18 aa, Homo sapiens
MILELFSKVPSLVGSFIR

SEQ ID NO: 43727 - protein, 34 aa, Homo sapiens
NPFGLVPVLENSQGQLIYESAITCEYLDEAYPGK

SEQ ID NO: 43728 - protein, 35 aa, Homo sapiens
NPFGLVPVLENSQGQLIYESAITCEYLDEAYPGKK

SEQ ID NO: 43729 - protein, 18 aa, Homo sapiens
SLGKGSAPPGPVPEGSIR

SEQ ID NO: 43730 - protein, 22 aa, Homo sapiens
TTFFGGNSISMIDYLIWPWFER

SEQ ID NO: 43731 - protein, 10 aa, Homo sapiens
VPSLVGSFIR

SEQ ID NO: 43732 - protein, 15 aa, Homo sapiens
AMGIMNSFVNDIFER

SEQ ID NO: 43733 - protein, 8 aa, Homo sapiens
HAVSEGTK

SEQ ID NO: 43734 - protein, 7 aa, Homo sapiens
IAGEASR

SEQ ID NO: 43735 - protein, 9 aa, Homo sapiens
LLLPGELAK

SEQ ID NO: 43736 - protein, 19 aa, Homo sapiens
AILQQLGLNSTCDDSILVK

SEQ ID NO: 43737 - protein, 14 aa, Homo sapiens
ATDCVGHDVVTLLR

SEQ ID NO: 43738 - protein, 11 aa, Homo sapiens
IDEAILITWTK

SEQ ID NO: 43739 - protein, 16 aa, Homo sapiens
KLPVGFTFSFPCQQSK

SEQ ID NO: 43740 - protein, 20 aa, Homo sapiens
MCINTEWGAFGDDGSLEDIR

SEQ ID NO: 43741 - protein, 6 aa, Homo sapiens
MELGLR

SEQ ID NO: 43742 - protein, 13 aa, Homo sapiens
QIEETLAHFHLTK

SEQ ID NO: 43743 - protein, 21 aa, Homo sapiens
TPDGTENGDFLALDLGGTNFR

SEQ ID NO: 43744 - protein, 15 aa, Homo sapiens
DGEDQTQDTELVETR

SEQ ID NO: 43745 - protein, 14 aa, Homo sapiens
FISVGYVDDTQFVR

SEQ ID NO: 43746 - protein, 13 aa, Homo sapiens
RGYYNQSEAGSHT

SEQ ID NO: 43747 - protein, 12 aa, Homo sapiens
YTCHVQHEGLPK

SEQ ID NO: 43748 - protein, 14 aa, Homo sapiens
APWVEQEGPEYWDR

SEQ ID NO: 43749 - protein, 12 aa, Homo sapiens
AYLEGTCVEWLR

SEQ ID NO: 43750 - protein, 24 aa, Homo sapiens
DGEDQTQDTELVETRPAGDGTFQK

SEQ ID NO: 43751 - protein, 24 aa, Homo sapiens
GGSCSQAACSNSAQGSDESLITCK

SEQ ID NO: 43752 - protein, 17 aa, Homo sapiens
RGYYNQSEDGSHTLQRM

SEQ ID NO: 43753 - protein, 8 aa, Homo sapiens
AEYGVYVK

SEQ ID NO: 43754 - protein, 14 aa, Homo sapiens
AKDIAPTLTLYVGK

SEQ ID NO: 43755 - protein, 15 aa, Homo sapiens
AKDIAPTLTLYVGKK

SEQ ID NO: 43756 - protein, 15 aa, Homo sapiens
AKNLFLNHSENATAK

SEQ ID NO: 43757 - protein, 32 aa, Homo sapiens
ALYSGNDVTDISDDRFPKPPEIANGYVEHLFR

SEQ ID NO: 43758 - protein, 10 aa, Homo sapiens
APTLTLYVGK

SEQ ID NO: 43759 - protein, 11 aa, Homo sapiens
APTLTLYVGKK

SEQ ID NO: 43760 - protein, 16 aa, Homo sapiens
ATAKDIAPTLTLYVGK

SEQ ID NO: 43761 - protein, 17 aa, Homo sapiens
ATAKDIAPTLTLYVGKK

SEQ ID NO: 43762 - protein, 10 aa, Homo sapiens
AVAEYGVYVK

SEQ ID NO: 43763 - protein, 15 aa, Homo sapiens
AVGDKLPECEAVCGK

SEQ ID NO: 43764 - protein, 17 aa, Homo sapiens
AVGDKLPECEAVCGKPK

SEQ ID NO: 43765 - protein, 24 aa, Homo sapiens
AVGDKLPECEAVCGKPKNPANPVQ

SEQ ID NO: 43766 - protein, 25 aa, Homo sapiens
AVGDKLPECEAVCGKPKNPANPVQR

SEQ ID NO: 43767 - protein, 20 aa, Homo sapiens
AVHDLEEDTWYAAGILSFDK

SEQ ID NO: 43768 - protein, 9 aa, Homo sapiens
DGVYTLNDK

SEQ ID NO: 43769 - protein, 9 aa, Homo sapiens
DIAPTLTLY

SEQ ID NO: 43770 - protein, 12 aa, Homo sapiens
DIAPTLTLYVGK

SEQ ID NO: 43771 - protein, 13 aa, Homo sapiens
DIAPTLTLYVGKK

SEQ ID NO: 43772 - protein, 20 aa, Homo sapiens
DIAPTLTLYVGKKQLVEIEK

SEQ ID NO: 43773 - protein, 9 aa, Homo sapiens
EQWLLTTAK

SEQ ID NO: 43774 - protein, 11 aa, Homo sapiens
FLNHSENATAK

SEQ ID NO: 43775 - protein, 17 aa, Homo sapiens
FPKPPEIANGYVEHLFR

SEQ ID NO: 43776 - protein, 15 aa, Homo sapiens
GATLINEQWLLTTAK

SEQ ID NO: 43777 - protein, 11 aa, Homo sapiens
GDAGSAFAVHD

SEQ ID NO: 43778 - protein, 15 aa, Homo sapiens
GGHLDAKGSFPWQAK

SEQ ID NO: 43779 - protein, 8 aa, Homo sapiens
GSFPWQAK

SEQ ID NO: 43780 - protein, 21 aa, Homo sapiens
HHNLTTGATLINEQWLLTTAK

SEQ ID NO: 43781 - protein, 20 aa, Homo sapiens
HNLTTGATLINEQWLLTTAK

SEQ ID NO: 43782 - protein, 13 aa, Homo sapiens
HPNYHQVDIGLIK

SEQ ID NO: 43783 - protein, 8 aa, Homo sapiens
HSENATAK

SEQ ID NO: 43784 - protein, 9 aa, Homo sapiens
ILGGHLDAK

SEQ ID NO: 43785 - protein, 17 aa, Homo sapiens
ILGGHLDAKGSFPWQAK

SEQ ID NO: 43786 - protein, 11 aa, Homo sapiens
INEQWLLTTAK

SEQ ID NO: 43787 - protein, 25 aa, Homo sapiens
KMVSHHNLTTGATLINEQWLLTTAK

SEQ ID NO: 43788 - protein, 8 aa, Homo sapiens
KQLVEIEK

SEQ ID NO: 43789 - protein, 6 aa, Homo sapiens
KQWINK

SEQ ID NO: 43790 - protein, 36 aa, Homo sapiens
LDAKGSFPWQAKMVSHHNLTTGATLINEQWLLTTAK

SEQ ID NO: 43791 - protein, 12 aa, Homo sapiens
LFLNHSENATAK

SEQ ID NO: 43792 - protein, 24 aa, Homo sapiens
LFLNHSENATAKDIAPTLTLYVGK

SEQ ID NO: 43793 - protein, 25 aa, Homo sapiens
LFLNHSENATAKDIAPTLTLYVGKK

SEQ ID NO: 43794 - protein, 8 aa, Homo sapiens
LGGHLDAK

SEQ ID NO: 43795 - protein, 16 aa, Homo sapiens
LGGHLDAKGSFPWQAK

SEQ ID NO: 43796 - protein, 14 aa, Homo sapiens
LHPNYHQVDIGLIK

SEQ ID NO: 43797 - protein, 12 aa, Homo sapiens
LINEQWLLTTAK

SEQ ID NO: 43798 - protein, 10 aa, Homo sapiens
LNHSENATAK

SEQ ID NO: 43799 - protein, 10 aa, Homo sapiens
LPECEAVCGK

SEQ ID NO: 43800 - protein, 12 aa, Homo sapiens
LPECEAVCGKPK

SEQ ID NO: 43801 - protein, 14 aa, Homo sapiens
LRTEGDGVYTLNDK

SEQ ID NO: 43802 - protein, 15 aa, Homo sapiens
LRTEGDGVYTLNDKK

SEQ ID NO: 43803 - protein, 20 aa, Homo sapiens
LRTEGDGVYTLNDKKQWINK

SEQ ID NO: 43804 - protein, 6 aa, Homo sapiens
LTDHLK

SEQ ID NO: 43805 - protein, 18 aa, Homo sapiens
LTTGATLINEQWLLTTAK

SEQ ID NO: 43806 - protein, 8 aa, Homo sapiens
MPICLPSK

SEQ ID NO: 43807 - protein, 15 aa, Homo sapiens
MVSHHNLTTGATLIN

SEQ ID NO: 43808 - protein, 17 aa, Homo sapiens
MVSHHNLTTGATLINEQ

SEQ ID NO: 43809 - protein, 24 aa, Homo sapiens
MVSHHNLTTGATLINEQWLLTTAK

SEQ ID NO: 43810 - protein, 25 aa, Homo sapiens
MVSHHNLTTGATLINEQWLLTTAKN

SEQ ID NO: 43811 - protein, 10 aa, Homo sapiens
NEQWLLTTAK

SEQ ID NO: 43812 - protein, 9 aa, Homo sapiens
NHSENATAK

SEQ ID NO: 43813 - protein, 10 aa, Homo sapiens
NLFLNHSENA

SEQ ID NO: 43814 - protein, 12 aa, Homo sapiens
NLFLNHSENATA

SEQ ID NO: 43815 - protein, 13 aa, Homo sapiens
NLFLNHSENATAK

SEQ ID NO: 43816 - protein, 22 aa, Homo sapiens
NLFLNHSENATAKDIAPTLTLY

SEQ ID NO: 43817 - protein, 25 aa, Homo sapiens
NLFLNHSENATAKDIAPTLTLYVGK

SEQ ID NO: 43818 - protein, 26 aa, Homo sapiens
NLFLNHSENATAKDIAPTLTLYVGKK

SEQ ID NO: 43819 - protein, 19 aa, Homo sapiens
NLTTGATLINEQWLLTTAK

SEQ ID NO: 43820 - protein, 7 aa, Homo sapiens
NPANPVQ

SEQ ID NO: 43821 - protein, 8 aa, Homo sapiens
NPANPVQR

SEQ ID NO: 43822 - protein, 7 aa, Homo sapiens
NYAEVGR

SEQ ID NO: 43823 - protein, 19 aa, Homo sapiens
NYYRLRTEGDGVYTLNDKK

SEQ ID NO: 43824 - protein, 24 aa, Homo sapiens
NYYRLRTEGDGVYTLNDKKQWINK

SEQ ID NO: 43825 - protein, 11 aa, Homo sapiens
PECEAVCGKPK

SEQ ID NO: 43826 - protein, 7 aa, Homo sapiens
PICLPSK

SEQ ID NO: 43827 - protein, 14 aa, Homo sapiens
PILNEHTFCVGMSK

SEQ ID NO: 43828 - protein, 10 aa, Homo sapiens
PKNPANPVQR

SEQ ID NO: 43829 - protein, 12 aa, Homo sapiens
PNYHQVDIGLIK

SEQ ID NO: 43830 - protein, 9 aa, Homo sapiens
PTLTLYVGK

SEQ ID NO: 43831 - protein, 10 aa, Homo sapiens
PTLTLYVGKK

SEQ ID NO: 43832 - protein, 19 aa, Homo sapiens
PVADQYDCITHYEGSTCPK

SEQ ID NO: 43833 - protein, 18 aa, Homo sapiens
QLFALYSGNDVTDISDDR

SEQ ID NO: 43834 - protein, 35 aa, Homo sapiens
QLFALYSGNDVTDISDDRFPKPPEIANGYVEHLFR

SEQ ID NO: 43835 - protein, 7 aa, Homo sapiens
QLVEIEK

SEQ ID NO: 43836 - protein, 12 aa, Homo sapiens
SCAVAEYGVYVK

SEQ ID NO: 43837 - protein, 14 aa, Homo sapiens
SDLGAVISLLLWGR

SEQ ID NO: 43838 - protein, 22 aa, Homo sapiens
SHHNLTTGATLINEQWLLTTAK

SEQ ID NO: 43839 - protein, 18 aa, Homo sapiens
SKYQEDTCYGDAGSAFAV

SEQ ID NO: 43840 - protein, 10 aa, Homo sapiens
SPVGVQPILN

SEQ ID NO: 43841 - protein, 12 aa, Homo sapiens
SPVGVQPILNEH

SEQ ID NO: 43842 - protein, 13 aa, Homo sapiens
SPVGVQPILNEHT

SEQ ID NO: 43843 - protein, 14 aa, Homo sapiens
SPVGVQPILNEHTF

SEQ ID NO: 43844 - protein, 15 aa, Homo sapiens
SPVGVQPILNEHTFC

SEQ ID NO: 43845 - protein, 20 aa, Homo sapiens
SPVGVQPILNEHTFCVGMSK

SEQ ID NO: 43846 - protein, 12 aa, Homo sapiens
TEGDGVYTLNDK

SEQ ID NO: 43847 - protein, 13 aa, Homo sapiens
TEGDGVYTLNDKK

SEQ ID NO: 43848 - protein, 18 aa, Homo sapiens
TEGDGVYTLNDKKQWINK

SEQ ID NO: 43849 - protein, 16 aa, Homo sapiens
TGATLINEQWLLTTAK

SEQ ID NO: 43850 - protein, 13 aa, Homo sapiens
TLINEQWLLTTAK

SEQ ID NO: 43851 - protein, 17 aa, Homo sapiens
TTGATLINEQWLLTTAK

SEQ ID NO: 43852 - protein, 7 aa, Homo sapiens
VDIGLIK

SEQ ID NO: 43853 - protein, 14 aa, Homo sapiens
VGYVSGWGQSDNFK

SEQ ID NO: 43854 - protein, 9 aa, Homo sapiens
VMPICLPSK

SEQ ID NO: 43855 - protein, 16 aa, Homo sapiens
VMPICLPSKNYAEVGR

SEQ ID NO: 43856 - protein, 23 aa, Homo sapiens
VSHHNLTTGATLINEQWLLTTAK

SEQ ID NO: 43857 - protein, 10 aa, Homo sapiens
VTSIQHWVQK

SEQ ID NO: 43858 - protein, 16 aa, Homo sapiens
VVLHPNYHQVDIGLIK

SEQ ID NO: 43859 - protein, 11 aa, Homo sapiens
YQEDTCYGDAG

SEQ ID NO: 43860 - protein, 17 aa, Homo sapiens
YQEDTCYGDAGSAFAVH

SEQ ID NO: 43861 - protein, 22 aa, Homo sapiens
YQEDTCYGDAGSAFAVHDLEED

SEQ ID NO: 43862 - protein, 34 aa, Homo sapiens
YQEDTCYGDAGSAFAVHDLEEDTWYAAGILSFDK

SEQ ID NO: 43863 - protein, 23 aa, Homo sapiens
YVMLPVADQYDCITHYEGSTCPK

SEQ ID NO: 43864 - protein, 22 aa, Homo sapiens
FIYEGSSDFSCLPTFGVIIGQK

SEQ ID NO: 43865 - protein, 26 aa, Homo sapiens
ICDFENASKPQSIQESTGSIIEVLSK

SEQ ID NO: 43866 - protein, 6 aa, Homo sapiens
IHFQTK

SEQ ID NO: 43867 - protein, 28 aa, Homo sapiens
LPPFSYAYTELEAIMYALGVGASIKDPK

SEQ ID NO: 43868 - protein, 36 aa, Homo sapiens
LSGDWNPLHIDPNFASLAGFDKPILHGLCTFGFSAR

SEQ ID NO: 43869 - protein, 15 aa, Homo sapiens
SNIHCNTIAPNAGSR

SEQ ID NO: 43870 - protein, 16 aa, Homo sapiens
VLHGEQYLELYKPLPR

SEQ ID NO: 43871 - protein, 25 aa, Homo sapiens
VQETGDIVISNAYVDLAPTSGTSAK

SEQ ID NO: 43872 - protein, 17 aa, Homo sapiens
EGYAWAEDKEHCEEYGR

SEQ ID NO: 43873 - protein, 18 aa, Homo sapiens
EQLAQAMFDHIPVGVGSK

SEQ ID NO: 43874 - protein, 16 aa, Homo sapiens
GLGHQVATDALVAMEK

SEQ ID NO: 43875 - protein, 16 aa, Homo sapiens
NVTDVVNTCHDAGISK

SEQ ID NO: 43876 - protein, 23 aa, Homo sapiens
VFNTTPDDLDLHVIYDVSHNIAK

SEQ ID NO: 43877 - protein, 24 aa, Homo sapiens
AAAVPVEFQEHHLSEVQNMASEEK

SEQ ID NO: 43878 - protein, 16 aa, Homo sapiens
HLNLEYHSSMIADAVK

SEQ ID NO: 43879 - protein, 10 aa, Homo sapiens
HNNLDLVIIR

SEQ ID NO: 43880 - protein, 9 aa, Homo sapiens
HPFAQAVGR

SEQ ID NO: 43881 - protein, 12 aa, Homo sapiens
KLDLFANVVHVK

SEQ ID NO: 43882 - protein, 19 aa, Homo sapiens
LGDGLFLQCCEEVAELYPK

SEQ ID NO: 43883 - protein, 30 aa, Homo sapiens
RSRNTTAADTYNITDPEELETEYPFFESRV

SEQ ID NO: 43884 - protein, 27 aa, Homo sapiens
RTNASVPSIPLDVLSASNSSSQLIVKW

SEQ ID NO: 43885 - protein, 11 aa, Homo sapiens
DEITFVSGAPR

SEQ ID NO: 43886 - protein, 16 aa, Homo sapiens
DFHYIVFGAPGTYNWK

SEQ ID NO: 43887 - protein, 16 aa, Homo sapiens
DGWQDIVIGAPQYFDR

SEQ ID NO: 43888 - protein, 14 aa, Homo sapiens
FGSCQQGVAATFTK

SEQ ID NO: 43889 - protein, 16 aa, Homo sapiens
KEINSLNLTESHNSRK

SEQ ID NO: 43890 - protein, 16 aa, Homo sapiens
LETTSNQDNLAPITAK

SEQ ID NO: 43891 - protein, 18 aa, Homo sapiens
LRPIPITASVEIQEPSSR

SEQ ID NO: 43892 - protein, 24 aa, Homo sapiens
NIGDINQDGYPDIAVGAPYDDLGK

SEQ ID NO: 43893 - protein, 19 aa, Homo sapiens
NSYPDVAVGSLSDSVTIFR

SEQ ID NO: 43894 - protein, 13 aa, Homo sapiens
RANHSGAVVLLKR

SEQ ID NO: 43895 - protein, 14 aa, Homo sapiens
RLWNSTFLEEYSKL

SEQ ID NO: 43896 - protein, 30 aa, Homo sapiens
SAHLLPEHIFDGEGLASSFGYDVAVVDLNK

SEQ ID NO: 43897 - protein, 26 aa, Homo sapiens
SCFEYTANPAGYNPSISIVGTLEAEK

SEQ ID NO: 43898 - protein, 28 aa, Homo sapiens
SCFEYTANPAGYNPSISIVGTLEAEKER

SEQ ID NO: 43899 - protein, 10 aa, Homo sapiens
TAHIDVHFLK

SEQ ID NO: 43900 - protein, 20 aa, Homo sapiens
VFIYHGSANGINTKPTQVLK

SEQ ID NO: 43901 - protein, 15 aa, Homo sapiens
KLNFTGPGDPDSIRC

SEQ ID NO: 43902 - protein, 16 aa, Homo sapiens
KLTNNSNQFQTEVGKQ

SEQ ID NO: 43903 - protein, 19 aa, Homo sapiens
KNCSAACPGLQLSNNPVKG

SEQ ID NO: 43904 - protein, 9 aa, Homo sapiens
AQALAVSYR

SEQ ID NO: 43905 - protein, 12 aa, Homo sapiens
DHLISVTPDSIR

SEQ ID NO: 43906 - protein, 11 aa, Homo sapiens
GAGTQPGPLLK

SEQ ID NO: 43907 - protein, 13 aa, Homo sapiens
IDYPPSSVVQATK

SEQ ID NO: 43908 - protein, 10 aa, Homo sapiens
LSLENCGLTR

SEQ ID NO: 43909 - protein, 31 aa, Homo sapiens
RASEDQDIEFQMQIPAAAFITNFTMLIGDKV

SEQ ID NO: 43910 - protein, 35 aa, Homo sapiens
RGEDDSGPPPSTVINQNETFANIIFKPTVVQQARI

SEQ ID NO: 43911 - protein, 33 aa, Homo sapiens
RLTEDPAGPSQNLTHPLLLQVGEGPEAVLTVKG

SEQ ID NO: 43912 - protein, 8 aa, Homo sapiens
TPLLSDIR

SEQ ID NO: 43913 - protein, 9 aa, Homo sapiens
VYQGEITER

SEQ ID NO: 43914 - protein, 9 aa, Homo sapiens
YAFTTVSCR

SEQ ID NO: 43915 - protein, 10 aa, Homo sapiens
YVAHSGIGDR

SEQ ID NO: 43916 - protein, 11 aa, Homo sapiens
CCHASAVADGR

SEQ ID NO: 43917 - protein, 12 aa, Homo sapiens
FNTWIHLASMNQ

SEQ ID NO: 43918 - protein, 18 aa, Homo sapiens
KRNETLVFSHNAVIAMRD

SEQ ID NO: 43919 - protein, 9 aa, Homo sapiens
YEPVLFEEK

SEQ ID NO: 43920 - protein, 26 aa, Homo sapiens
KSINDLKNTSGLLYPPEAPELQIRKM

SEQ ID NO: 43921 - protein, 36 aa, Homo sapiens
REGELCSLLKENVSELRILSSGNDHGNWCIIAEKKG

SEQ ID NO: 43922 - protein, 29 aa, Homo sapiens
DLLRTLNDTLGKLSAIPNDTAAKLQAVKD

SEQ ID NO: 43923 - protein, 28 aa, Homo sapiens
KACNCSTVGSLDFQCNVNTGQCNCHPKF

SEQ ID NO: 43924 - protein, 25 aa, Homo sapiens
KKADILDVVGMLYVGGLPINYTTRR

SEQ ID NO: 43925 - protein, 20 aa, Homo sapiens
KNESGIILLGSGGTPAPPRR

SEQ ID NO: 43926 - protein, 39 aa, Homo sapiens
KVSQAESHAAQLNDSSAVLDGILDEAKNISFNATAAFKA

SEQ ID NO: 43927 - protein, 26 aa, Homo sapiens
RGLFPAVLNLASNALITTNATCGEKG

SEQ ID NO: 43928 - protein, 21 aa, Homo sapiens
RLEQMVMSINLTGPLPAPYKM

SEQ ID NO: 43929 - protein, 10 aa, Homo sapiens
RRNLSLNIRG

SEQ ID NO: 43930 - protein, 16 aa, Homo sapiens
RYMQNLTVEQPIEVKK

SEQ ID NO: 43931 - protein, 12 aa, Homo sapiens
LSSSAEFTGMTR

SEQ ID NO: 43932 - protein, 7 aa, Homo sapiens
TDALPGV

SEQ ID NO: 43933 - protein, 31 aa, Homo sapiens
LLKANNTLLKMGYHFELPGPRMVVTNLLTRN

SEQ ID NO: 43934 - protein, 20 aa, Homo sapiens
KASMNTSSNPGTPLPLPLRI

SEQ ID NO: 43935 - protein, 16 aa, Homo sapiens
ATPMPSRPSTTPFIDK

SEQ ID NO: 43936 - protein, 16 aa, Homo sapiens
DVPPLSETEATPVPIK

SEQ ID NO: 43937 - protein, 22 aa, Homo sapiens
EIEMASEERPPAQALEIMMGLK

SEQ ID NO: 43938 - protein, 14 aa, Homo sapiens
GVLTLANNVTPAKD

SEQ ID NO: 43939 - protein, 19 aa, Homo sapiens
KPCNSQPSELSSETSGIAR

SEQ ID NO: 43940 - protein, 21 aa, Homo sapiens
NVCLPPEMEVALTEDQVPALK

SEQ ID NO: 43941 - protein, 13 aa, Homo sapiens
RLATNTSAPDLKN

SEQ ID NO: 43942 - protein, 36 aa, Homo sapiens
SQPSELSSETSGIARPEEGRPVVSGTGNDITTPPNK

SEQ ID NO: 43943 - protein, 15 aa, Homo sapiens
TTTAAAVASTGPSSR

SEQ ID NO: 43944 - protein, 17 aa, Homo sapiens
TTTLSGTAPAAGVVPSR

SEQ ID NO: 43945 - protein, 17 aa, Homo sapiens
VGSLDNVGHLPAGGAVK

SEQ ID NO: 43946 - protein, 16 aa, Homo sapiens
AAGNECPELQPPVHGK

SEQ ID NO: 43947 - protein, 10 aa, Homo sapiens
APEPISTQSH

SEQ ID NO: 43948 - protein, 25 aa, Homo sapiens
APEPISTQSHSVLILFHSDNSGENR

SEQ ID NO: 43949 - protein, 14 aa, Homo sapiens
DNVEMDTFQIECLK

SEQ ID NO: 43950 - protein, 12 aa, Homo sapiens
DQVLVSCDTGYK

SEQ ID NO: 43951 - protein, 10 aa, Homo sapiens
FGYILHTDNR

SEQ ID NO: 43952 - protein, 13 aa, Homo sapiens
FGYILHTDNRTCR

SEQ ID NO: 43953 - protein, 17 aa, Homo sapiens
FTGFDAHYMAVDVDECK

SEQ ID NO: 43954 - protein, 11 aa, Homo sapiens
KNEIDLESELK

SEQ ID NO: 43955 - protein, 10 aa, Homo sapiens
NEIDLESELK

SEQ ID NO: 43956 - protein, 8 aa, Homo sapiens
SDFSNEER

SEQ ID NO: 43957 - protein, 15 aa, Homo sapiens
TGVITSPDFPNPYPK

SEQ ID NO: 43958 - protein, 11 aa, Homo sapiens
VECSDNLFTQR

SEQ ID NO: 43959 - protein, 14 aa, Homo sapiens
VETEDQVLATFCGR

SEQ ID NO: 43960 - protein, 17 aa, Homo sapiens
VLKDNVEMDTFQIECLK

SEQ ID NO: 43961 - protein, 12 aa, Homo sapiens
APGELEHGLITF

SEQ ID NO: 43962 - protein, 15 aa, Homo sapiens
APGELEHGLITFSTR

SEQ ID NO: 43963 - protein, 16 aa, Homo sapiens
DACAGDSGGPMVTLNR

SEQ ID NO: 43964 - protein, 11 aa, Homo sapiens
DSDLLSPSDFK

SEQ ID NO: 43965 - protein, 20 aa, Homo sapiens
FPETLMEIEIPIVDHSTCQK

SEQ ID NO: 43966 - protein, 31 aa, Homo sapiens
HTTLHPQYDPNTFENDVALVELLESPVLNAF

SEQ ID NO: 43967 - protein, 20 aa, Homo sapiens
MLNNNTGIYTCSAQGVWMNK

SEQ ID NO: 43968 - protein, 11 aa, Homo sapiens
SDENEQHLGVK

SEQ ID NO: 43969 - protein, 13 aa, Homo sapiens
SLPTCLPVCGLPK

SEQ ID NO: 43970 - protein, 11 aa, Homo sapiens
YGVYSYIHHNK

SEQ ID NO: 43971 - protein, 9 aa, Homo sapiens
YSCQEPYYK

SEQ ID NO: 43972 - protein, 40 aa, Homo sapiens
AHTVELNNMFGQIQSPGYPDSYPSDSEVTWNITVPDGFRI

SEQ ID NO: 43973 - protein, 13 aa, Homo sapiens
EHVTVYLGLHDVR

SEQ ID NO: 43974 - protein, 22 aa, Homo sapiens
KMLNNNTGIYTCSAQGVWMNKV

SEQ ID NO: 43975 - protein, 12 aa, Homo sapiens
KSGAVNSSAARV

SEQ ID NO: 43976 - protein, 35 aa, Homo sapiens
LEPEGPAPHMLGLVAGWGISNPNVTVDEIISSGTR

SEQ ID NO: 43977 - protein, 12 aa, Homo sapiens
NAEPGLFPWQAL

SEQ ID NO: 43978 - protein, 20 aa, Homo sapiens
NAEPGLFPWQALIVVEDTSR

SEQ ID NO: 43979 - protein, 12 aa, Homo sapiens
RFGYILHTDNRT

SEQ ID NO: 43980 - protein, 37 aa, Homo sapiens
RLEPEGPAPHMLGLVAGWGISNPNVTVDEIISSGTRT

SEQ ID NO: 43981 - protein, 9 aa, Homo sapiens
RNNLTTYKS

SEQ ID NO: 43982 - protein, 13 aa, Homo sapiens
SLPSLVKRIIGGR

SEQ ID NO: 43983 - protein, 14 aa, Homo sapiens
SLPTCLPECGQPSR

SEQ ID NO: 43984 - protein, 30 aa, Homo sapiens
VVLHPDFNIQNYNHDIALVQLQEPVPLGPH

SEQ ID NO: 43985 - protein, 18 aa, Homo sapiens
WVVQGLVSWGGPEECGSK

SEQ ID NO: 43986 - protein, 14 aa, Homo sapiens
HGATVLTALGGILK

SEQ ID NO: 43987 - protein, 15 aa, Homo sapiens
HGATVLTALGGILKK

SEQ ID NO: 43988 - protein, 15 aa, Homo sapiens
VEADIPGHGQEVLIR

SEQ ID NO: 43989 - protein, 7 aa, Homo sapiens
AICDHVR

SEQ ID NO: 43990 - protein, 13 aa, Homo sapiens
DLDVAILVGSMPR

SEQ ID NO: 43991 - protein, 13 aa, Homo sapiens
DVIATDKEDVAFK

SEQ ID NO: 43992 - protein, 8 aa, Homo sapiens
EKMDLTAK

SEQ ID NO: 43993 - protein, 24 aa, Homo sapiens
EKMDLTAKELTEEKESAFEFLSSA

SEQ ID NO: 43994 - protein, 16 aa, Homo sapiens
ELTEEKESAFEFLSSA

SEQ ID NO: 43995 - protein, 8 aa, Homo sapiens
ENFSCLTR

SEQ ID NO: 43996 - protein, 9 aa, Homo sapiens
EVGVYEALK

SEQ ID NO: 43997 - protein, 15 aa, Homo sapiens
EVGVYEALKDDSWLK

SEQ ID NO: 43998 - protein, 12 aa, Homo sapiens
FVEGLPINDFSR

SEQ ID NO: 43999 - protein, 10 aa, Homo sapiens
GEFVTTVQQR

SEQ ID NO: 44000 - protein, 24 aa, Homo sapiens
GVISDGNSYGVPDDLLYSFPVVIK

SEQ ID NO: 44001 - protein, 10 aa, Homo sapiens
KLSSAMSAAK

SEQ ID NO: 44002 - protein, 9 aa, Homo sapiens
LGVTANDVK

SEQ ID NO: 44003 - protein, 9 aa, Homo sapiens
LSSAMSAAK

SEQ ID NO: 44004 - protein, 20 aa, Homo sapiens
MGVLDGVLMELQDCALPLLK

SEQ ID NO: 44005 - protein, 20 aa, Homo sapiens
NVIIWGNHSSTQYPDVNHAK

SEQ ID NO: 44006 - protein, 32 aa, Homo sapiens
PEGEFVSMGVISDGNSYGVPDDLLYSFPVVIK

SEQ ID NO: 44007 - protein, 28 aa, Homo sapiens
RVLVTGAAGQIAYSLLYSIGNGSVFGKD

SEQ ID NO: 44008 - protein, 7 aa, Homo sapiens
SAPSIPK

SEQ ID NO: 44009 - protein, 8 aa, Homo sapiens
SQGAALDK

SEQ ID NO: 44010 - protein, 11 aa, Homo sapiens
SQGAALDKYAK

SEQ ID NO: 44011 - protein, 17 aa, Homo sapiens
VIVVGNPANTNCLTASK

SEQ ID NO: 44012 - protein, 23 aa, Homo sapiens
KNPTDEYLDAMMNEAPGPINFTM

SEQ ID NO: 44013 - protein, 22 aa, Homo sapiens
MMNEAPGPINFTMFLTMFGEKL

SEQ ID NO: 44014 - protein, 16 aa, Homo sapiens
EKPLWFDVYDAFPPLR

SEQ ID NO: 44015 - protein, 20 aa, Homo sapiens
KSEHLSVRPQTALEENETQK

SEQ ID NO: 44016 - protein, 23 aa, Homo sapiens
IEPLSPELVAAASAVADSLPFDK

SEQ ID NO: 44017 - protein, 24 aa, Homo sapiens
RIEPLSPELVAAASAVADSLPFDK

SEQ ID NO: 44018 - protein, 15 aa, Homo sapiens
SELLSQLQQHEEESR

SEQ ID NO: 44019 - protein, 31 aa, Homo sapiens
KNEEIDEMIKEAPGPINFTVFLSMFGEKLKG

SEQ ID NO: 44020 - protein, 26 aa, Homo sapiens
MSLDFNATGRITAAQLQTMLLEKSRV

SEQ ID NO: 44021 - protein, 35 aa, Homo sapiens
RKEMDNVSILSSQPEGSLQSWLSCTLSLATDTMRT

SEQ ID NO: 44022 - protein, 29 aa, Homo sapiens
RYDLTGWLHRAKPNLSALDAPQVLHQSKR

SEQ ID NO: 44023 - protein, 16 aa, Homo sapiens
KAKAVALDSDNISLKS

SEQ ID NO: 44024 - protein, 18 aa, Homo sapiens
KQKSLTNLSFLTDSEKKL

SEQ ID NO: 44025 - protein, 30 aa, Homo sapiens
RQNSSDSISSLNSITSHSSIGSSKDADAKK

SEQ ID NO: 44026 - protein, 28 aa, Homo sapiens
MMRGQGLNMTPSMVAPSGMPATMSNPRI

SEQ ID NO: 44027 - protein, 26 aa, Homo sapiens
KLEDQLQGGQLEEVILQAEHELNLAR

SEQ ID NO: 44028 - protein, 16 aa, Homo sapiens
TTGLVGLAVCNTPHER

SEQ ID NO: 44029 - protein, 22 aa, Homo sapiens
DGDYIVNVQPIDDGWMYGTVQR

SEQ ID NO: 44030 - protein, 9 aa, Homo sapiens
GCFHCEVCK

SEQ ID NO: 44031 - protein, 10 aa, Homo sapiens
KPYCNAHYPK

SEQ ID NO: 44032 - protein, 17 aa, Homo sapiens
HEVSPLPCHAVGPYSCK

SEQ ID NO: 44033 - protein, 15 aa, Homo sapiens
SCASPLWHCDQVCGK

SEQ ID NO: 44034 - protein, 9 aa, Homo sapiens
NLLDHLEEK

SEQ ID NO: 44035 - protein, 13 aa, Homo sapiens
YNAVSNADLMDFK

SEQ ID NO: 44036 - protein, 34 aa, Homo sapiens
KAGNEQSVHQYTISKDEPLFLQARANAANLSEKL

SEQ ID NO: 44037 - protein, 10 aa, Homo sapiens
DVVVDLVCYR

SEQ ID NO: 44038 - protein, 30 aa, Homo sapiens
EANFDINQLYDCNWVVVNCSTPGNFFHVLR

SEQ ID NO: 44039 - protein, 12 aa, Homo sapiens
ELEQIFCQFDSK

SEQ ID NO: 44040 - protein, 14 aa, Homo sapiens
FGLEGCEVLIPALK

SEQ ID NO: 44041 - protein, 31 aa, Homo sapiens
GHHVAQLDPLGILDADLDSSVPADIISSTDK

SEQ ID NO: 44042 - protein, 21 aa, Homo sapiens
GSLAAVAHAQSLVEAQPNVDK

SEQ ID NO: 44043 - protein, 18 aa, Homo sapiens
HWLDSPWPGFFTLDGQPR

SEQ ID NO: 44044 - protein, 13 aa, Homo sapiens
KELEQIFCQFDSK

SEQ ID NO: 44045 - protein, 13 aa, Homo sapiens
LVEDHLAVQSLIR

SEQ ID NO: 44046 - protein, 23 aa, Homo sapiens
NITLSLVANPSHLEAADPVVMGK

SEQ ID NO: 44047 - protein, 37 aa, Homo sapiens
SMSCPSTGLTEDILTHIGNVASSVPVENFTIHGGLSR

SEQ ID NO: 44048 - protein, 20 aa, Homo sapiens
VFHLPTTTFIGGQESALPLR

SEQ ID NO: 44049 - protein, 22 aa, Homo sapiens
VVNAPIFHVNSDDPEAVMYVCK

SEQ ID NO: 44050 - protein, 22 aa, Homo sapiens
YAELLVSQGVVNQPEYEEEISK

SEQ ID NO: 44051 - protein, 14 aa, Homo sapiens
YPNAELAWCQEEHK

SEQ ID NO: 44052 - protein, 28 aa, Homo sapiens
NAENMYYFSELALTLNAWESGTAPTDSR

SEQ ID NO: 44053 - protein, 20 aa, Homo sapiens
SLCEQVSHHPPAAAHHAESK

SEQ ID NO: 44054 - protein, 19 aa, Homo sapiens
TGSNISGASSDISLDEQYK

SEQ ID NO: 44055 - protein, 12 aa, Homo sapiens
VHFALLGTWDEK

SEQ ID NO: 44056 - protein, 27 aa, Homo sapiens
RKELVMLLLEYNADTTIVNGSGQTAKE

SEQ ID NO: 44057 - protein, 9 aa, Homo sapiens
ANILYAWAR

SEQ ID NO: 44058 - protein, 16 aa, Homo sapiens
GKGSGGLNLGNFFASR

SEQ ID NO: 44059 - protein, 14 aa, Homo sapiens
GSGGLNLGNFFASR

SEQ ID NO: 44060 - protein, 15 aa, Homo sapiens
IPVDEEAFVIDFKPR

SEQ ID NO: 44061 - protein, 9 aa, Homo sapiens
IVQFSPSGK

SEQ ID NO: 44062 - protein, 15 aa, Homo sapiens
LDPNNKEGPVLILGR

SEQ ID NO: 44063 - protein, 12 aa, Homo sapiens
MENKPTSSELQK

SEQ ID NO: 44064 - protein, 9 aa, Homo sapiens
NGQWTLIGR

SEQ ID NO: 44065 - protein, 8 aa, Homo sapiens
NNLVIFHR

SEQ ID NO: 44066 - protein, 22 aa, Homo sapiens
PQAFYPVGHPVDVSFGDLLAAR

SEQ ID NO: 44067 - protein, 15 aa, Homo sapiens
PVVPIDSSDFALDIR

SEQ ID NO: 44068 - protein, 36 aa, Homo sapiens
SMQPGSDQNHFCQPTDVAVDPGTGAIYVSDGYCNSR

SEQ ID NO: 44069 - protein, 21 aa, Homo sapiens
AGIEVQEIKDSEHKLETSSGR

SEQ ID NO: 44070 - protein, 16 aa, Homo sapiens
KNESNLGDLLLGFLKY

SEQ ID NO: 44071 - protein, 21 aa, Homo sapiens
KEIDILPTQLVNTSSVQLVKS

SEQ ID NO: 44072 - protein, 14 aa, Homo sapiens
ASAAPKPEPVPVQK

SEQ ID NO: 44073 - protein, 24 aa, Homo sapiens
IGDVVLSIDGINAQGMTHLEAQNK

SEQ ID NO: 44074 - protein, 20 aa, Homo sapiens
QPTVTSVCSETSQELAEGQR

SEQ ID NO: 44075 - protein, 13 aa, Homo sapiens
SWHPEEFNCAHCK

SEQ ID NO: 44076 - protein, 14 aa, Homo sapiens
ALPFWNEEIVPQIK

SEQ ID NO: 44077 - protein, 18 aa, Homo sapiens
ALPFWNEEIVPQIKEGKR

SEQ ID NO: 44078 - protein, 10 aa, Homo sapiens
AMEAVAAQGK

SEQ ID NO: 44079 - protein, 13 aa, Homo sapiens
AMEAVAAQGKAKK

SEQ ID NO: 44080 - protein, 15 aa, Homo sapiens
DAGYEFDICFTSVQK

SEQ ID NO: 44081 - protein, 18 aa, Homo sapiens
FSGWYDADLSPAGHEEAK

SEQ ID NO: 44082 - protein, 19 aa, Homo sapiens
FSGWYDADLSPAGHEEAKR

SEQ ID NO: 44083 - protein, 11 aa, Homo sapiens
HGESAWNLENR

SEQ ID NO: 44084 - protein, 27 aa, Homo sapiens
HLEGLSEEAIMELNLPTGIPIVYELDK

SEQ ID NO: 44085 - protein, 10 aa, Homo sapiens
HYGGLTGLNK

SEQ ID NO: 44086 - protein, 16 aa, Homo sapiens
HYGGLTGLNKAETAAK

SEQ ID NO: 44087 - protein, 11 aa, Homo sapiens
KAMEAVAAQGK

SEQ ID NO: 44088 - protein, 12 aa, Homo sapiens
KAMEAVAAQGKA

SEQ ID NO: 44089 - protein, 27 aa, Homo sapiens
LNERHYGGLTGLNKAETAAKHGEAQVK

SEQ ID NO: 44090 - protein, 18 aa, Homo sapiens
NLKPIKPMQFLGDEETVR

SEQ ID NO: 44091 - protein, 19 aa, Homo sapiens
NLKPIKPMQFLGDEETVRK

SEQ ID NO: 44092 - protein, 12 aa, Homo sapiens
PFWNEEIVPQIK

SEQ ID NO: 44093 - protein, 19 aa, Homo sapiens
RFSGWYDADLSPAGHEEAK

SEQ ID NO: 44094 - protein, 22 aa, Homo sapiens
RSYDVPPPPMEPDHPFYSNISK

SEQ ID NO: 44095 - protein, 12 aa, Homo sapiens
RVLIAAHGNSLR

SEQ ID NO: 44096 - protein, 21 aa, Homo sapiens
SYDVPPPPMEPDHPFYSNISK

SEQ ID NO: 44097 - protein, 18 aa, Homo sapiens
TLWTVLDAIDQMWLPVVR

SEQ ID NO: 44098 - protein, 11 aa, Homo sapiens
VLIAAHGNSLR

SEQ ID NO: 44099 - protein, 15 aa, Homo sapiens
VLIAAHGNSLRGIVK

SEQ ID NO: 44100 - protein, 16 aa, Homo sapiens
YADLTEDQLPSCESLK

SEQ ID NO: 44101 - protein, 21 aa, Homo sapiens
YADLTEDQLPSCESLKDTIAR

SEQ ID NO: 44102 - protein, 21 aa, Homo sapiens
RCSAEEATEGLMNLSPSAMKN

SEQ ID NO: 44103 - protein, 20 aa, Homo sapiens
SGEEDFESLASQFSDCSSAK

SEQ ID NO: 44104 - protein, 15 aa, Homo sapiens
VYYFNHITNASQWER

SEQ ID NO: 44105 - protein, 31 aa, Homo sapiens
KANGLLDFDIFYNVTGCLRNMSSAGADGRKA

SEQ ID NO: 44106 - protein, 21 aa, Homo sapiens
RDQPDQHGLLWNLSSNDKLKN

SEQ ID NO: 44107 - protein, 16 aa, Homo sapiens
AALRDNHTHSDIQVKL

SEQ ID NO: 44108 - protein, 16 aa, Homo sapiens
KELGVVMYNCSCLARD

SEQ ID NO: 44109 - protein, 27 aa, Homo sapiens
MAEAGAGLSETVTETTVTVTTEPENRS

SEQ ID NO: 44110 - protein, 9 aa, Homo sapiens
DGGFCEVCK

SEQ ID NO: 44111 - protein, 12 aa, Homo sapiens
DVYCEVCEFLVK

SEQ ID NO: 44112 - protein, 15 aa, Homo sapiens
EIVDSYLPVILDIIK

SEQ ID NO: 44113 - protein, 11 aa, Homo sapiens
EMPMQTLVPAK

SEQ ID NO: 44114 - protein, 11 aa, Homo sapiens
GCSFLPDPYQK

SEQ ID NO: 44115 - protein, 10 aa, Homo sapiens
GSAVWCQNVK

SEQ ID NO: 44116 - protein, 13 aa, Homo sapiens
HCLQTVWNKPTVK

SEQ ID NO: 44117 - protein, 9 aa, Homo sapiens
HLAELNHQK

SEQ ID NO: 44118 - protein, 16 aa, Homo sapiens
IGACPSAHKPLLGTEK

SEQ ID NO: 44119 - protein, 16 aa, Homo sapiens
KDNATEEEILVYLEKT

SEQ ID NO: 44120 - protein, 19 aa, Homo sapiens
KLIDNNKTEKEILDAFDKM

SEQ ID NO: 44121 - protein, 8 aa, Homo sapiens
KLVGYLDR

SEQ ID NO: 44122 - protein, 15 aa, Homo sapiens
KNSTKQEILAALEKG

SEQ ID NO: 44123 - protein, 12 aa, Homo sapiens
LPALTVHVTQPK

SEQ ID NO: 44124 - protein, 7 aa, Homo sapiens
LVGYLDR

SEQ ID NO: 44125 - protein, 13 aa, Homo sapiens
NVIPALELVEPIK

SEQ ID NO: 44126 - protein, 14 aa, Homo sapiens
NVIPALELVEPIKK

SEQ ID NO: 44127 - protein, 29 aa, Homo sapiens
QCDQFVAEYEPVLIEILVEVMDPSFVCLK

SEQ ID NO: 44128 - protein, 9 aa, Homo sapiens
QEILAALEK

SEQ ID NO: 44129 - protein, 34 aa, Homo sapiens
QLESNKIPELDMTEVVAPFMANIPLLLYPQDGPR

SEQ ID NO: 44130 - protein, 16 aa, Homo sapiens
RTNSTFVQALVEHVKE

SEQ ID NO: 44131 - protein, 13 aa, Homo sapiens
SDVYCEVCEFLVK

SEQ ID NO: 44132 - protein, 19 aa, Homo sapiens
TNSTFVQALVEHVKEECDR

SEQ ID NO: 44133 - protein, 10 aa, Homo sapiens
RGGMIVDPLR

SEQ ID NO: 44134 - protein, 15 aa, Homo sapiens
IIQTPGLWESENQNK

SEQ ID NO: 44135 - protein, 14 aa, Homo sapiens
LDNWLNELETYCTR

SEQ ID NO: 44136 - protein, 15 aa, Homo sapiens
TCDGVQCAFEELVEK

SEQ ID NO: 44137 - protein, 8 aa, Homo sapiens
TISVDGNK

SEQ ID NO: 44138 - protein, 16 aa, Homo sapiens
DTSFLGSDDIGNIDVR

SEQ ID NO: 44139 - protein, 19 aa, Homo sapiens
EGQWDCSACLVQNEGSSTK

SEQ ID NO: 44140 - protein, 14 aa, Homo sapiens
ELLQSFDSALQSVK

SEQ ID NO: 44141 - protein, 16 aa, Homo sapiens
EPELEDLTRYDVGAIR

SEQ ID NO: 44142 - protein, 19 aa, Homo sapiens
ETNPVVFFDVCADGEPLGR

SEQ ID NO: 44143 - protein, 9 aa, Homo sapiens
FVFGSESVK

SEQ ID NO: 44144 - protein, 17 aa, Homo sapiens
LCANHRITPDMTLQNMK

SEQ ID NO: 44145 - protein, 7 aa, Homo sapiens
LCTERQK

SEQ ID NO: 44146 - protein, 9 aa, Homo sapiens
LFRFDVESK

SEQ ID NO: 44147 - protein, 16 aa, Homo sapiens
LKEQLLDCEGEDGWNK

SEQ ID NO: 44148 - protein, 23 aa, Homo sapiens
NEANATRCVACQNPDKPSPSTSV

SEQ ID NO: 44149 - protein, 28 aa, Homo sapiens
NHETDGGSAHGDDDDDGPHFEPVVPLPD

SEQ ID NO: 44150 - protein, 18 aa, Homo sapiens
VCANHVITKTMELKPLNV

SEQ ID NO: 44151 - protein, 10 aa, Homo sapiens
VLPLLKIIKK

SEQ ID NO: 44152 - protein, 14 aa, Homo sapiens
YICTYINVQERDPK

SEQ ID NO: 44153 - protein, 14 aa, Homo sapiens
YSLSPSKSYKYSPK

SEQ ID NO: 44154 - protein, 12 aa, Homo sapiens
KWNVTTTNYGKA

SEQ ID NO: 44155 - protein, 12 aa, Homo sapiens
RKFLQENASGRG

SEQ ID NO: 44156 - protein, 16 aa, Homo sapiens
DDPSQPVHLTAFLGYK

SEQ ID NO: 44157 - protein, 11 aa, Homo sapiens
VACIGAWHPAR

SEQ ID NO: 44158 - protein, 19 aa, Homo sapiens
AFKDFDVGDGFIPVCSLGV

SEQ ID NO: 44159 - protein, 36 aa, Homo sapiens
AKASTVDLPIESVSLSLQDLIGYFHPPDEHLEHEDK

SEQ ID NO: 44160 - protein, 23 aa, Homo sapiens
DMKCDDMLTCYMFHMYVGVRAGG

SEQ ID NO: 44161 - protein, 21 aa, Homo sapiens
DMVVMLLSMLEGNVVNGTIGK

SEQ ID NO: 44162 - protein, 18 aa, Homo sapiens
ECLAAFAGAFPVAFLETH

SEQ ID NO: 44163 - protein, 17 aa, Homo sapiens
FLPPPGYAPCYEAVLPK

SEQ ID NO: 44164 - protein, 19 aa, Homo sapiens
GECLAAFAGAFPVAFLETH

SEQ ID NO: 44165 - protein, 31 aa, Homo sapiens
HRISLFGNDATSIVNCLHILGQTLDARTVMK

SEQ ID NO: 44166 - protein, 23 aa, Homo sapiens
KDMVVMLLSMLEGNVVNGTIGKQ

SEQ ID NO: 44167 - protein, 18 aa, Homo sapiens
KLALPCLSAVAGALPPDY

SEQ ID NO: 44168 - protein, 19 aa, Homo sapiens
KLEFDGLYITEQPSEDDIK

SEQ ID NO: 44169 - protein, 24 aa, Homo sapiens
LMRMLSLKSLKKQMKKVKKMTVKD

SEQ ID NO: 44170 - protein, 16 aa, Homo sapiens
LQMCLLLQYLCDCQVR

SEQ ID NO: 44171 - protein, 9 aa, Homo sapiens
MAPLYNLPR

SEQ ID NO: 44172 - protein, 26 aa, Homo sapiens
QKAMFDHLSYLLENSSVGLASPAMRG

SEQ ID NO: 44173 - protein, 25 aa, Homo sapiens
QMVDMLVESSNNVEMILKFFDMFLK

SEQ ID NO: 44174 - protein, 13 aa, Homo sapiens
RAFLDNAAEDLEK

SEQ ID NO: 44175 - protein, 10 aa, Homo sapiens
RPKEGLLQMK

SEQ ID NO: 44176 - protein, 9 aa, Homo sapiens
SVRMGSIQR

SEQ ID NO: 44177 - protein, 32 aa, Homo sapiens
VFYQHPNLMRALGMHETVMEVMVNVLGGGESK

SEQ ID NO: 44178 - protein, 14 aa, Homo sapiens
WLKEPNPEAEELFR

SEQ ID NO: 44179 - protein, 13 aa, Homo sapiens
YGEPEVPESAFWK

SEQ ID NO: 44180 - protein, 12 aa, Homo sapiens
YLCTAVLPLLTR

SEQ ID NO: 44181 - protein, 13 aa, Homo sapiens
YNILTLMRMLSLK

SEQ ID NO: 44182 - protein, 24 aa, Homo sapiens
EIGNLLHPSVPISNDEDVDNKVER

SEQ ID NO: 44183 - protein, 14 aa, Homo sapiens
ELVSCSNCTDYQAR

SEQ ID NO: 44184 - protein, 29 aa, Homo sapiens
KEPVGDDESVPENVLSFDDLTADALANLK

SEQ ID NO: 44185 - protein, 30 aa, Homo sapiens
KKEPVGDDESVPENVLSFDDLTADALANLK

SEQ ID NO: 44186 - protein, 15 aa, Homo sapiens
KLDLEAWFPGSGAFR

SEQ ID NO: 44187 - protein, 13 aa, Homo sapiens
TICAILENYQTEK

SEQ ID NO: 44188 - protein, 9 aa, Homo sapiens
YAGLSTCFR

SEQ ID NO: 44189 - protein, 15 aa, Homo sapiens
YLIATSEQPIAALHR

SEQ ID NO: 44190 - protein, 19 aa, Homo sapiens
KDLTDTLMDNMSSLTSLSV

SEQ ID NO: 44191 - protein, 20 aa, Homo sapiens
KLLLNVTPTVRPDADQMTKI

SEQ ID NO: 44192 - protein, 10 aa, Homo sapiens
FTAVAQTDLK

SEQ ID NO: 44193 - protein, 12 aa, Homo sapiens
SRPHDNIVISPH

SEQ ID NO: 44194 - protein, 16 aa, Homo sapiens
LKVMNFTIDGMGNLRI

SEQ ID NO: 44195 - protein, 11 aa, Homo sapiens
EFHGLGDCIIK

SEQ ID NO: 44196 - protein, 21 aa, Homo sapiens
KMQMVSNISFFAMFVMYFLTA

SEQ ID NO: 44197 - protein, 18 aa, Homo sapiens
FSSGDLFTAHNFSEQSRI

SEQ ID NO: 44198 - protein, 13 aa, Homo sapiens
RGNVTQHVQGHRN

SEQ ID NO: 44199 - protein, 13 aa, Homo sapiens
RNLSTCFSSGDLF

SEQ ID NO: 44200 - protein, 25 aa, Homo sapiens
KDRCNVEKVPSNSQLEIEGNSSGRQ

SEQ ID NO: 44201 - protein, 30 aa, Homo sapiens
KAGGVGLNLSAASRVFLMDPAWNPAAEDQC

SEQ ID NO: 44202 - protein, 22 aa, Homo sapiens
KKEYNVNDDSMKLGGNNTSEKA

SEQ ID NO: 44203 - protein, 12 aa, Homo sapiens
KDAAHMLQANKT

SEQ ID NO: 44204 - protein, 11 aa, Homo sapiens
CAVVSSAGSLK

SEQ ID NO: 44205 - protein, 10 aa, Homo sapiens
EIDDHDAVLR

SEQ ID NO: 44206 - protein, 18 aa, Homo sapiens
FFDSACTMGAYHPLLYEK

SEQ ID NO: 44207 - protein, 16 aa, Homo sapiens
FNGAPTANFQQDVGTK

SEQ ID NO: 44208 - protein, 7 aa, Homo sapiens
FSAEALR

SEQ ID NO: 44209 - protein, 15 aa, Homo sapiens
HLNQGTDEDIYLLGK

SEQ ID NO: 44210 - protein, 10 aa, Homo sapiens
KTDVCYYYQK

SEQ ID NO: 44211 - protein, 11 aa, Homo sapiens
LMNSQLVTTEK

SEQ ID NO: 44212 - protein, 12 aa, Homo sapiens
LMNSQLVTTEKR

SEQ ID NO: 44213 - protein, 28 aa, Homo sapiens
RDHVNVSMVEVTDFPFNTSEWEGYLPKE

SEQ ID NO: 44214 - protein, 14 aa, Homo sapiens
WYQNPDYNFFNNYK

SEQ ID NO: 44215 - protein, 19 aa, Homo sapiens
KCIRCAVVGNGGILNGSRQ

SEQ ID NO: 44216 - protein, 22 aa, Homo sapiens
RNLNHSLPSDFTFQNMNSKRKA

SEQ ID NO: 44217 - protein, 8 aa, Homo sapiens
GAEDSGVK

SEQ ID NO: 44218 - protein, 21 aa, Homo sapiens
LPQQSYNFDPDTCDESVDPFK

SEQ ID NO: 44219 - protein, 35 aa, Homo sapiens
VTAGILEMRNALGNQSTPAPPTGEVADTPLEPGKV

SEQ ID NO: 44220 - protein, 34 aa, Homo sapiens
MNQFGPSALINLSNFSSIKPEPASTPPQGSMANS

SEQ ID NO: 44221 - protein, 24 aa, Homo sapiens
KSSLVNESETNQNSSSDSEAERRP

SEQ ID NO: 44222 - protein, 14 aa, Homo sapiens
FEMFRELNEALELK

SEQ ID NO: 44223 - protein, 13 aa, Homo sapiens
GEPHHELPPGSTK

SEQ ID NO: 44224 - protein, 13 aa, Homo sapiens
VEGNLRVEYLDDR

SEQ ID NO: 44225 - protein, 11 aa, Homo sapiens
KNFSASSIAKI

SEQ ID NO: 44226 - protein, 8 aa, Homo sapiens
EGSPLAEK

SEQ ID NO: 44227 - protein, 9 aa, Homo sapiens
KDLMVKNIK

SEQ ID NO: 44228 - protein, 14 aa, Homo sapiens
WTVSNLRLYLESTR

SEQ ID NO: 44229 - protein, 13 aa, Homo sapiens
ALQLLHCFPLDIR

SEQ ID NO: 44230 - protein, 22 aa, Homo sapiens
CIPFAEEDLSADALLNILSEVK

SEQ ID NO: 44231 - protein, 28 aa, Homo sapiens
CLIVDFSNPEAPLEIHTAMLALDQFQEK

SEQ ID NO: 44232 - protein, 16 aa, Homo sapiens
DKFESSFSHKPSLFNK

SEQ ID NO: 44233 - protein, 17 aa, Homo sapiens
FDLNEPLHLSFLQNAAK

SEQ ID NO: 44234 - protein, 30 aa, Homo sapiens
FSPLCQWLYLEAADIVESLGKPECEEFLPR

SEQ ID NO: 44235 - protein, 18 aa, Homo sapiens
GHTEVIVPHLTESYNSHR

SEQ ID NO: 44236 - protein, 31 aa, Homo sapiens
GHTEVIVPHLTESYNSHRDPPEEEIPFCTLK

SEQ ID NO: 44237 - protein, 22 aa, Homo sapiens
IIPAIATTTATVSGLVALEMIK

SEQ ID NO: 44238 - protein, 15 aa, Homo sapiens
IQSGHSLEGCFQVIK

SEQ ID NO: 44239 - protein, 15 aa, Homo sapiens
KPNVGCQQDSEELLK

SEQ ID NO: 44240 - protein, 20 aa, Homo sapiens
LFCDFGDEFEVLDTTGEEPK

SEQ ID NO: 44241 - protein, 20 aa, Homo sapiens
NCFLNLAIPIVVFTETTEVR

SEQ ID NO: 44242 - protein, 24 aa, Homo sapiens
YVDLTVSFAPDIDGDEDLPGPPVR

SEQ ID NO: 44243 - protein, 25 aa, Homo sapiens
AHDGGIYAISWSPDSTHLLSASGDK

SEQ ID NO: 44244 - protein, 21 aa, Homo sapiens
FGAVFLWDSGSSVGEITGHNK

SEQ ID NO: 44245 - protein, 22 aa, Homo sapiens
GPVTDVAYSHDGAFLAVCDASK

SEQ ID NO: 44246 - protein, 19 aa, Homo sapiens
LATGSDDNCAAFFEGPPFK

SEQ ID NO: 44247 - protein, 25 aa, Homo sapiens
LHHVSSLAWLDEHTLVTTSHDASVK

SEQ ID NO: 44248 - protein, 14 aa, Homo sapiens
LYSILGTTLKDEGK

SEQ ID NO: 44249 - protein, 22 aa, Homo sapiens
NIDNPALADIYTEHAHQVVVAK

SEQ ID NO: 44250 - protein, 11 aa, Homo sapiens
NNPSKPLHVIK

SEQ ID NO: 44251 - protein, 9 aa, Homo sapiens
SIQCLTVHK

SEQ ID NO: 44252 - protein, 28 aa, Homo sapiens
SYIYSGSHDGHINYWDSETGENDSFAGK

SEQ ID NO: 44253 - protein, 8 aa, Homo sapiens
VCALGGSK

SEQ ID NO: 44254 - protein, 23 aa, Homo sapiens
VVTVFSVADGYSENNVFYGHHAK

SEQ ID NO: 44255 - protein, 16 aa, Homo sapiens
FFPSGLVVLSGGMDAQ

SEQ ID NO: 44256 - protein, 13 aa, Homo sapiens
VLEGHVFDVNCCR

SEQ ID NO: 44257 - protein, 15 aa, Homo sapiens
AHAAQVTCVAASPHK

SEQ ID NO: 44258 - protein, 35 aa, Homo sapiens
KETPPPLVPPAAREWNLPPNAPACMERQLEAARYR

SEQ ID NO: 44259 - protein, 22 aa, Homo sapiens
LASLSEDCSLAVLDSSLSELFR

SEQ ID NO: 44260 - protein, 23 aa, Homo sapiens
STSCVLSSAVHSQCVTGLVFSPH

SEQ ID NO: 44261 - protein, 26 aa, Homo sapiens
SVPFLASLSEDCSLAVLDSSLSELFR

SEQ ID NO: 44262 - protein, 16 aa, Homo sapiens
IVLFDTLLEEYSVLNK

SEQ ID NO: 44263 - protein, 16 aa, Homo sapiens
NEEVLAVLGHELGHWK

SEQ ID NO: 44264 - protein, 13 aa, Homo sapiens
SSHSNAYFYGFFK

SEQ ID NO: 44265 - protein, 29 aa, Homo sapiens
MASFLKNVSATVSINGSGISGNTAINYKH

SEQ ID NO: 44266 - protein, 13 aa, Homo sapiens
GVLHQFSGTETNK

SEQ ID NO: 44267 - protein, 17 aa, Homo sapiens
IAQNFGLQHLSSGHFLR

SEQ ID NO: 44268 - protein, 11 aa, Homo sapiens
SLLVPDHVITR

SEQ ID NO: 44269 - protein, 36 aa, Homo sapiens
VYNLDFNPPHVHGIDDVTGEPLVQQEDDKPEAVAAR

SEQ ID NO: 44270 - protein, 14 aa, Homo sapiens
ELSEIAQSIVANGK

SEQ ID NO: 44271 - protein, 13 aa, Homo sapiens
ETTIQGLDGLSER

SEQ ID NO: 44272 - protein, 9 aa, Homo sapiens
FPALTQEQK

SEQ ID NO: 44273 - protein, 18 aa, Homo sapiens
GQYVHTGSSGAASTQSLF

SEQ ID NO: 44274 - protein, 14 aa, Homo sapiens
IGGVILFHETLYQK

SEQ ID NO: 44275 - protein, 13 aa, Homo sapiens
LDQGGAPLAGTNK

SEQ ID NO: 44276 - protein, 7 aa, Homo sapiens
VLAAVYK

SEQ ID NO: 44277 - protein, 11 aa, Homo sapiens
DLLQTVEDQYK

SEQ ID NO: 44278 - protein, 15 aa, Homo sapiens
IDGSQNFNETWENYK

SEQ ID NO: 44279 - protein, 18 aa, Homo sapiens
IDQDNSSFDSLSPEPKSR

SEQ ID NO: 44280 - protein, 16 aa, Homo sapiens
KNEEVKNMSLELNSKL

SEQ ID NO: 44281 - protein, 12 aa, Homo sapiens
MLIHPTDSESFE

SEQ ID NO: 44282 - protein, 14 aa, Homo sapiens
NEEVKNMSLELNSK

SEQ ID NO: 44283 - protein, 17 aa, Homo sapiens
RIDGSQNFNETWENYKY

SEQ ID NO: 44284 - protein, 18 aa, Homo sapiens
RIDQDNSSFDSLSPEPKS

SEQ ID NO: 44285 - protein, 16 aa, Homo sapiens
TSIQEPTEISLSSKPR

SEQ ID NO: 44286 - protein, 26 aa, Homo sapiens
ASSFAGYVGMLTGFKPGLFSLTLNER

SEQ ID NO: 44287 - protein, 10 aa, Homo sapiens
DAMWIGFLTR

SEQ ID NO: 44288 - protein, 11 aa, Homo sapiens
ESLDVYELDAK

SEQ ID NO: 44289 - protein, 16 aa, Homo sapiens
GAVPWYTINLDLPPYK

SEQ ID NO: 44290 - protein, 7 aa, Homo sapiens
GHLIHGR

SEQ ID NO: 44291 - protein, 8 aa, Homo sapiens
GQFETYLR

SEQ ID NO: 44292 - protein, 8 aa, Homo sapiens
HPFFLDDR

SEQ ID NO: 44293 - protein, 22 aa, Homo sapiens
ILAPAYFILGGNQSGEGCVITR

SEQ ID NO: 44294 - protein, 12 aa, Homo sapiens
KESLDVYELDAK

SEQ ID NO: 44295 - protein, 8 aa, Homo sapiens
KGHLIHGR

SEQ ID NO: 44296 - protein, 24 aa, Homo sapiens
KILAPAYFILGGNQSGEGCVITRD

SEQ ID NO: 44297 - protein, 12 aa, Homo sapiens
KSTYPPSGPTYR

SEQ ID NO: 44298 - protein, 17 aa, Homo sapiens
LPGLLGNFPGPFEEEMK

SEQ ID NO: 44299 - protein, 12 aa, Homo sapiens
LTVYTTLIDVTK

SEQ ID NO: 44300 - protein, 11 aa, Homo sapiens
NMINTFVPSGK

SEQ ID NO: 44301 - protein, 15 aa, Homo sapiens
RTVLENSTSYEEAKN

SEQ ID NO: 44302 - protein, 11 aa, Homo sapiens
STYPPSGPTYR

SEQ ID NO: 44303 - protein, 23 aa, Homo sapiens
TSQENISFETMYDVLSTKPVLNK

SEQ ID NO: 44304 - protein, 7 aa, Homo sapiens
VIVNSLK

SEQ ID NO: 44305 - protein, 8 aa, Homo sapiens
VMQVVDEK

SEQ ID NO: 44306 - protein, 8 aa, Homo sapiens
WHELMLDK

SEQ ID NO: 44307 - protein, 13 aa, Homo sapiens
WHELMLDKAPMLK

SEQ ID NO: 44308 - protein, 10 aa, Homo sapiens
WKHPFFLDDR

SEQ ID NO: 44309 - protein, 10 aa, Homo sapiens
WYVVQTNYDR

SEQ ID NO: 44310 - protein, 20 aa, Homo sapiens
KLEWLGNCSGLNDETYGYKE

SEQ ID NO: 44311 - protein, 22 aa, Homo sapiens
KYLQPLLAVQFTNLTMDTEIRI

SEQ ID NO: 44312 - protein, 23 aa, Homo sapiens
RVLGFKPKPPKNESLETYPVMKY

SEQ ID NO: 44313 - protein, 11 aa, Homo sapiens
TEISFRPNDPK

SEQ ID NO: 44314 - protein, 25 aa, Homo sapiens
VGNVEYFGLGNSPGFPLQYYPYYGK

SEQ ID NO: 44315 - protein, 13 aa, Homo sapiens
YNPNVLPVQCTGK

SEQ ID NO: 44316 - protein, 10 aa, Homo sapiens
AGEVQEPELR

SEQ ID NO: 44317 - protein, 14 aa, Homo sapiens
AKAYLEEECPATLR

SEQ ID NO: 44318 - protein, 15 aa, Homo sapiens
AKAYLEEECPATLRK

SEQ ID NO: 44319 - protein, 18 aa, Homo sapiens
AKAYLEEECPATLRKYLK

SEQ ID NO: 44320 - protein, 21 aa, Homo sapiens
AKAYLEEECPATLRKYLKYSK

SEQ ID NO: 44321 - protein, 12 aa, Homo sapiens
ALGSLNDLQFFR

SEQ ID NO: 44322 - protein, 11 aa, Homo sapiens
AREDIFMETLK

SEQ ID NO: 44323 - protein, 29 aa, Homo sapiens
AREDIFMETLKDIVEYYNDSNGSHVLQGR

SEQ ID NO: 44324 - protein, 12 aa, Homo sapiens
AYLEEECPATLR

SEQ ID NO: 44325 - protein, 13 aa, Homo sapiens
AYLEEECPATLRK

SEQ ID NO: 44326 - protein, 16 aa, Homo sapiens
AYLEEECPATLRKYLK

SEQ ID NO: 44327 - protein, 10 aa, Homo sapiens
CLAYDFYPGK

SEQ ID NO: 44328 - protein, 17 aa, Homo sapiens
CLAYDFYPGKIDVHWTR

SEQ ID NO: 44329 - protein, 18 aa, Homo sapiens
DIVEYYNDSNGSHVLQGR

SEQ ID NO: 44330 - protein, 7 aa, Homo sapiens
DYIEFNK

SEQ ID NO: 44331 - protein, 9 aa, Homo sapiens
EDIFMETLK

SEQ ID NO: 44332 - protein, 27 aa, Homo sapiens
EDIFMETLKDIVEYYNDSNGSHVLQGR

SEQ ID NO: 44333 - protein, 16 aa, Homo sapiens
EIPAWVPFDPAAQITK

SEQ ID NO: 44334 - protein, 15 aa, Homo sapiens
EYYNDSNGSHVLQGR

SEQ ID NO: 44335 - protein, 9 aa, Homo sapiens
FGCEIENNR

SEQ ID NO: 44336 - protein, 16 aa, Homo sapiens
FGCEIENNRSSGAFWK

SEQ ID NO: 44337 - protein, 47 aa, Homo sapiens
GDVLHNGNGTYQSWVVVAVPPQDTAPYSCHVQHSSLAQPLVVPWEAS

SEQ ID NO: 44338 - protein, 21 aa, Homo sapiens
HVEDVPAFQALGSLNDLQFFR

SEQ ID NO: 44339 - protein, 25 aa, Homo sapiens
HVEDVPAFQALGSLNDLQFFRYNSK

SEQ ID NO: 44340 - protein, 28 aa, Homo sapiens
HVEDVPAFQALGSLNDLQFFRYNSKDRK

SEQ ID NO: 44341 - protein, 7 aa, Homo sapiens
IDVHWTR

SEQ ID NO: 44342 - protein, 17 aa, Homo sapiens
IDVHWTRAGEVQEPELR

SEQ ID NO: 44343 - protein, 13 aa, Homo sapiens
KAYLEEECPATLR

SEQ ID NO: 44344 - protein, 20 aa, Homo sapiens
KDIVEYYNDSNGSHVLQGRF

SEQ ID NO: 44345 - protein, 14 aa, Homo sapiens
KKLKCLAYDFYPGK

SEQ ID NO: 44346 - protein, 9 aa, Homo sapiens
KSQPMGLWR

SEQ ID NO: 44347 - protein, 20 aa, Homo sapiens
LDRQDPPSVVVTSHQAPGEK

SEQ ID NO: 44348 - protein, 21 aa, Homo sapiens
LDRQDPPSVVVTSHQAPGEKK

SEQ ID NO: 44349 - protein, 12 aa, Homo sapiens
LKCLAYDFYPGK

SEQ ID NO: 44350 - protein, 19 aa, Homo sapiens
LKCLAYDFYPGKIDVHWTR

SEQ ID NO: 44351 - protein, 20 aa, Homo sapiens
LKDIVEYYNDSNGSHVLQGR

SEQ ID NO: 44352 - protein, 12 aa, Homo sapiens
NDSNGSHVLQGR

SEQ ID NO: 44353 - protein, 22 aa, Homo sapiens
NILDRQDPPSVVVTSHQAPGEK

SEQ ID NO: 44354 - protein, 23 aa, Homo sapiens
NILDRQDPPSVVVTSHQAPGEKK

SEQ ID NO: 44355 - protein, 24 aa, Homo sapiens
NILDRQDPPSVVVTSHQAPGEKKK

SEQ ID NO: 44356 - protein, 26 aa, Homo sapiens
NILDRQDPPSVVVTSHQAPGEKKKLK

SEQ ID NO: 44357 - protein, 14 aa, Homo sapiens
PAWVPFDPAAQITK

SEQ ID NO: 44358 - protein, 10 aa, Homo sapiens
PFDPAAQITK

SEQ ID NO: 44359 - protein, 22 aa, Homo sapiens
PMGLWRQVEGMEDWKQDSQLQK

SEQ ID NO: 44360 - protein, 28 aa, Homo sapiens
PPQDTAPYSCHVQHSSLAQPLVVPWEAS

SEQ ID NO: 44361 - protein, 15 aa, Homo sapiens
PPSVVVTSHQAPGEK

SEQ ID NO: 44362 - protein, 16 aa, Homo sapiens
PPSVVVTSHQAPGEKK

SEQ ID NO: 44363 - protein, 17 aa, Homo sapiens
PPSVVVTSHQAPGEKKK

SEQ ID NO: 44364 - protein, 19 aa, Homo sapiens
PPSVVVTSHQAPGEKKKLK

SEQ ID NO: 44365 - protein, 14 aa, Homo sapiens
PSVVVTSHQAPGEK

SEQ ID NO: 44366 - protein, 17 aa, Homo sapiens
QDPPSVVVTSHQAPGEK

SEQ ID NO: 44367 - protein, 18 aa, Homo sapiens
QDPPSVVVTSHQAPGEKK

SEQ ID NO: 44368 - protein, 7 aa, Homo sapiens
QDSQLQK

SEQ ID NO: 44369 - protein, 12 aa, Homo sapiens
QKWEAEPVYVQR

SEQ ID NO: 44370 - protein, 9 aa, Homo sapiens
QVEGMEDWK

SEQ ID NO: 44371 - protein, 16 aa, Homo sapiens
QVEGMEDWKQDSQLQK

SEQ ID NO: 44372 - protein, 18 aa, Homo sapiens
QVEGMEDWKQDSQLQKAR

SEQ ID NO: 44373 - protein, 11 aa, Homo sapiens
RFGCEIENNRS

SEQ ID NO: 44374 - protein, 16 aa, Homo sapiens
RGDVLHNGNGTYQSWV

SEQ ID NO: 44375 - protein, 26 aa, Homo sapiens
SKNILDRQDPPSVVVTSHQAPGEKKK

SEQ ID NO: 44376 - protein, 9 aa, Homo sapiens
SLNDLQFFR

SEQ ID NO: 44377 - protein, 8 aa, Homo sapiens
SQPMGLWR

SEQ ID NO: 44378 - protein, 24 aa, Homo sapiens
SQPMGLWRQVEGMEDWKQDSQLQK

SEQ ID NO: 44379 - protein, 7 aa, Homo sapiens
SSGAFWK

SEQ ID NO: 44380 - protein, 14 aa, Homo sapiens
SSLAQPLVVPWEAS

SEQ ID NO: 44381 - protein, 16 aa, Homo sapiens
VEYYNDSNGSHVLQGR

SEQ ID NO: 44382 - protein, 10 aa, Homo sapiens
WEAEPVYVQR

SEQ ID NO: 44383 - protein, 29 aa, Homo sapiens
YLKYSKNILDRQDPPSVVVTSHQAPGEKK

SEQ ID NO: 44384 - protein, 30 aa, Homo sapiens
YLKYSKNILDRQDPPSVVVTSHQAPGEKKK

SEQ ID NO: 44385 - protein, 13 aa, Homo sapiens
YNDSNGSHVLQGR

SEQ ID NO: 44386 - protein, 7 aa, Homo sapiens
YNSKDRK

SEQ ID NO: 44387 - protein, 10 aa, Homo sapiens
YSKNILDRQD

SEQ ID NO: 44388 - protein, 25 aa, Homo sapiens
YSKNILDRQDPPSVVVTSHQAPGEK

SEQ ID NO: 44389 - protein, 26 aa, Homo sapiens
YSKNILDRQDPPSVVVTSHQAPGEKK

SEQ ID NO: 44390 - protein, 27 aa, Homo sapiens
YSKNILDRQDPPSVVVTSHQAPGEKKK

SEQ ID NO: 44391 - protein, 29 aa, Homo sapiens
YSKNILDRQDPPSVVVTSHQAPGEKKKLK

SEQ ID NO: 44392 - protein, 12 aa, Homo sapiens
YSLTYIYTGLSK

SEQ ID NO: 44393 - protein, 12 aa, Homo sapiens
YYDGKDYIEFNK

SEQ ID NO: 44394 - protein, 14 aa, Homo sapiens
YYNDSNGSHVLQGR

SEQ ID NO: 44395 - protein, 6 aa, Homo sapiens
YYYDGK

SEQ ID NO: 44396 - protein, 13 aa, Homo sapiens
YYYDGKDYIEFNK

SEQ ID NO: 44397 - protein, 29 aa, Homo sapiens
YYYDGKDYIEFNKEIPAWVPFDPAAQITK

SEQ ID NO: 44398 - protein, 20 aa, Homo sapiens
YDASLTPLEFQGYNLSANKQ

SEQ ID NO: 44399 - protein, 25 aa, Homo sapiens
REVNSTDWDSKMGFWAPLVLSHSRR

SEQ ID NO: 44400 - protein, 19 aa, Homo sapiens
AFGFNVLFYDPYLSDGVER

SEQ ID NO: 44401 - protein, 27 aa, Homo sapiens
DHLTAATHWASMDPAVVHPELNGAAYR

SEQ ID NO: 44402 - protein, 19 aa, Homo sapiens
DVATVAFCDAQSTQEIHEK

SEQ ID NO: 44403 - protein, 20 aa, Homo sapiens
GAALDVHESEPFSFSQGPLK

SEQ ID NO: 44404 - protein, 33 aa, Homo sapiens
SAGDLGIAVCNVPAASVEETADSTLCHILNLYR

SEQ ID NO: 44405 - protein, 20 aa, Homo sapiens
EGAMSAQLGYPVVGWHIANK

SEQ ID NO: 44406 - protein, 26 aa, Homo sapiens
EGAMSAQLGYPVVGWHIANKKPPLPK

SEQ ID NO: 44407 - protein, 11 aa, Homo sapiens
GVHYISVSATR

SEQ ID NO: 44408 - protein, 11 aa, Homo sapiens
HLQFIPVVPPR

SEQ ID NO: 44409 - protein, 12 aa, Homo sapiens
KVVENGALLSWK

SEQ ID NO: 44410 - protein, 21 aa, Homo sapiens
LGCSLNQNSVPDIHGVEAPAR

SEQ ID NO: 44411 - protein, 19 aa, Homo sapiens
SFRVTIPTDLIASSGDIIK

SEQ ID NO: 44412 - protein, 11 aa, Homo sapiens
SFSEVELHNMK

SEQ ID NO: 44413 - protein, 16 aa, Homo sapiens
VTIPTDLIASSGDIIK

SEQ ID NO: 44414 - protein, 25 aa, Homo sapiens
ELESAHHPFTAPHPSDIHLLYTEPK

SEQ ID NO: 44415 - protein, 19 aa, Homo sapiens
EYLCNLHGFVDIETPTLFK

SEQ ID NO: 44416 - protein, 20 aa, Homo sapiens
ILCEAPVESVVQVSGTVISR

SEQ ID NO: 44417 - protein, 20 aa, Homo sapiens
NFAADHFNQEILPVFLNANR

SEQ ID NO: 44418 - protein, 19 aa, Homo sapiens
NTEIGFLQDALSKPHGTVK

SEQ ID NO: 44419 - protein, 24 aa, Homo sapiens
AGHAGHTSLPQCINPFTNLPHTPR

SEQ ID NO: 44420 - protein, 35 aa, Homo sapiens
ALELLNYLAALNDDGDLTELGSMMAEFPLDPQLAK

SEQ ID NO: 44421 - protein, 19 aa, Homo sapiens
FAHIDGDHLTLLNVYHAFK

SEQ ID NO: 44422 - protein, 14 aa, Homo sapiens
HQSFVLVGETGSGK

SEQ ID NO: 44423 - protein, 13 aa, Homo sapiens
HRLDLGEDYPSGK

SEQ ID NO: 44424 - protein, 11 aa, Homo sapiens
LDLGEDYPSGK

SEQ ID NO: 44425 - protein, 22 aa, Homo sapiens
LGIDDLVHFDFMDPPAPETLMR

SEQ ID NO: 44426 - protein, 9 aa, Homo sapiens
RGVACTQPR

SEQ ID NO: 44427 - protein, 12 aa, Homo sapiens
TCTDIKPEWLVK

SEQ ID NO: 44428 - protein, 11 aa, Homo sapiens
AEDDTWEPEQK

SEQ ID NO: 44429 - protein, 11 aa, Homo sapiens
IESSSLQGLGR

SEQ ID NO: 44430 - protein, 8 aa, Homo sapiens
IYWVDLER

SEQ ID NO: 44431 - protein, 11 aa, Homo sapiens
LFWTDTGINPR

SEQ ID NO: 44432 - protein, 12 aa, Homo sapiens
YPANVAVDPVER

SEQ ID NO: 44433 - protein, 21 aa, Homo sapiens
ATGQVCHALCSPEGCWGPEPR

SEQ ID NO: 44434 - protein, 23 aa, Homo sapiens
DTCPPLMLYNPTTYQMDVNPEGK

SEQ ID NO: 44435 - protein, 19 aa, Homo sapiens
ELVEPLTPSGEAPNQALLR

SEQ ID NO: 44436 - protein, 16 aa, Homo sapiens
FSNNPALCNVESIQWR

SEQ ID NO: 44437 - protein, 19 aa, Homo sapiens
GDSFTHTPPLDPQELDILK

SEQ ID NO: 44438 - protein, 19 aa, Homo sapiens
GPDNCIQCAHYIDGPHCVK

SEQ ID NO: 44439 - protein, 10 aa, Homo sapiens
IICAQQCSGR

SEQ ID NO: 44440 - protein, 10 aa, Homo sapiens
IPLENLQIIR

SEQ ID NO: 44441 - protein, 13 aa, Homo sapiens
KDSLSINATNIKH

SEQ ID NO: 44442 - protein, 18 aa, Homo sapiens
KTCPAGVMGENNTLVWKY

SEQ ID NO: 44443 - protein, 16 aa, Homo sapiens
LTQLGTFEDHFLSLQR

SEQ ID NO: 44444 - protein, 11 aa, Homo sapiens
NLQEILHGAVR

SEQ ID NO: 44445 - protein, 12 aa, Homo sapiens
NYVVTDHGSCVR

SEQ ID NO: 44446 - protein, 26 aa, Homo sapiens
RDIVSSDFLSNMSMDFQNHLGSCQKC

SEQ ID NO: 44447 - protein, 29 aa, Homo sapiens
REFVENSECIQCHPECLPQAMNITCTGRG

SEQ ID NO: 44448 - protein, 22 aa, Homo sapiens
RPAGSVQNPVYHNQPLNPAPSR

SEQ ID NO: 44449 - protein, 18 aa, Homo sapiens
SPSDCCHNQCAAGCTGPR

SEQ ID NO: 44450 - protein, 21 aa, Homo sapiens
TPLLSSLSATSNNSTVACIDR

SEQ ID NO: 44451 - protein, 12 aa, Homo sapiens
VSLNITSLGLRS

SEQ ID NO: 44452 - protein, 9 aa, Homo sapiens
YSFGATCVK

SEQ ID NO: 44453 - protein, 31 aa, Homo sapiens
YSSDPTGALTEDSIDDTFLPVPEYINQSVPK

SEQ ID NO: 44454 - protein, 24 aa, Homo sapiens
ECESVLVNDFFLVACLEDFIENAR

SEQ ID NO: 44455 - protein, 13 aa, Homo sapiens
HLVFPLLEFLSVK

SEQ ID NO: 44456 - protein, 19 aa, Homo sapiens
LASEILMQNWDAAMEDLTR

SEQ ID NO: 44457 - protein, 20 aa, Homo sapiens
LGHVVMGNNAVSPYQQVIEK

SEQ ID NO: 44458 - protein, 31 aa, Homo sapiens
VIQQESYTYKDPITEFVECLYVNFDFDGAQK

SEQ ID NO: 44459 - protein, 24 aa, Homo sapiens
RVKAISDSDGVSYPWYGNTTETVT

SEQ ID NO: 44460 - protein, 22 aa, Homo sapiens
IQAAASTPTNATAASDANTGDR

SEQ ID NO: 44461 - protein, 23 aa, Homo sapiens
IQAAASTPTNATAASDANTGDRG

SEQ ID NO: 44462 - protein, 21 aa, Homo sapiens
LTPLEACAHSFFDELRDPNVK

SEQ ID NO: 44463 - protein, 7 aa, Homo sapiens
SLLQFLR

SEQ ID NO: 44464 - protein, 13 aa, Homo sapiens
STNIAAAASEPHS

SEQ ID NO: 44465 - protein, 11 aa, Homo sapiens
ADLFYDVEALD

SEQ ID NO: 44466 - protein, 13 aa, Homo sapiens
ADLFYDVEALDLE

SEQ ID NO: 44467 - protein, 16 aa, Homo sapiens
ADLFYDVEALDLESPK

SEQ ID NO: 44468 - protein, 7 aa, Homo sapiens
ALDLINK

SEQ ID NO: 44469 - protein, 8 aa, Homo sapiens
ALDLINKR

SEQ ID NO: 44470 - protein, 16 aa, Homo sapiens
ALEKYKEENDDFASFR

SEQ ID NO: 44471 - protein, 22 aa, Homo sapiens
ALEKYKEENDDFASFRVDRIER

SEQ ID NO: 44472 - protein, 14 aa, Homo sapiens
CTTSSVSSALANTK

SEQ ID NO: 44473 - protein, 9 aa, Homo sapiens
DGYLFQLLR

SEQ ID NO: 44474 - protein, 20 aa, Homo sapiens
DHHHPHKPHEHGPPPPPDER

SEQ ID NO: 44475 - protein, 18 aa, Homo sapiens
DHSHGPPLPQGPPPLLPM

SEQ ID NO: 44476 - protein, 20 aa, Homo sapiens
DHSHGPPLPQGPPPLLPMSC

SEQ ID NO: 44477 - protein, 35 aa, Homo sapiens
DHSHGPPLPQGPPPLLPMSCSSCQHATFGTNGAQR

SEQ ID NO: 44478 - protein, 14 aa, Homo sapiens
DSPVLIDFFEDTER

SEQ ID NO: 44479 - protein, 16 aa, Homo sapiens
DSPVLIDFFEDTERYR

SEQ ID NO: 44480 - protein, 17 aa, Homo sapiens
DSPVLIDFFEDTERYRK

SEQ ID NO: 44481 - protein, 12 aa, Homo sapiens
DVQESDCSVLSR

SEQ ID NO: 44482 - protein, 10 aa, Homo sapiens
EENDDFASFR

SEQ ID NO: 44483 - protein, 18 aa, Homo sapiens
FKSGFPQVSMFFTHTFPK

SEQ ID NO: 44484 - protein, 14 aa, Homo sapiens
FPQVSMFFTHTFPK

SEQ ID NO: 44485 - protein, 12 aa, Homo sapiens
GEVLPLPEANFP

SEQ ID NO: 44486 - protein, 18 aa, Homo sapiens
GEVLPLPEANFPSFPLPH

SEQ ID NO: 44487 - protein, 20 aa, Homo sapiens
GEVLPLPEANFPSFPLPHHK

SEQ ID NO: 44488 - protein, 14 aa, Homo sapiens
GGEGTGYFVDFSVR

SEQ ID NO: 44489 - protein, 18 aa, Homo sapiens
GGEGTGYFVDFSVRNCPR

SEQ ID NO: 44490 - protein, 8 aa, Homo sapiens
GPRPFHCR

SEQ ID NO: 44491 - protein, 21 aa, Homo sapiens
HPLKPDNQPFPQSVSESCPGK

SEQ ID NO: 44492 - protein, 23 aa, Homo sapiens
HPLKPDNQPFPQSVSESCPGKFK

SEQ ID NO: 44493 - protein, 9 aa, Homo sapiens
HPNVFGFCR

SEQ ID NO: 44494 - protein, 9 aa, Homo sapiens
HSHESQDLR

SEQ ID NO: 44495 - protein, 8 aa, Homo sapiens
IADAHLDR

SEQ ID NO: 44496 - protein, 15 aa, Homo sapiens
IADAHLDRVENTTVY

SEQ ID NO: 44497 - protein, 31 aa, Homo sapiens
IADAHLDRVENTTVYYLVLDVQESDCSVLSR

SEQ ID NO: 44498 - protein, 19 aa, Homo sapiens
KGEVLPLPEANFPSFPLPH

SEQ ID NO: 44499 - protein, 21 aa, Homo sapiens
KGEVLPLPEANFPSFPLPHHK

SEQ ID NO: 44500 - protein, 12 aa, Homo sapiens
KYWNDCEPPDSR

SEQ ID NO: 44501 - protein, 23 aa, Homo sapiens
KYWNDCEPPDSRRPSEIVIGQCK

SEQ ID NO: 44502 - protein, 19 aa, Homo sapiens
LKPDNQPFPQSVSESCPGK

SEQ ID NO: 44503 - protein, 31 aa, Homo sapiens
NCEVFDPQEHENINGVPPHLGHPFHWGGHER

SEQ ID NO: 44504 - protein, 10 aa, Homo sapiens
NLVINCEVFD

SEQ ID NO: 44505 - protein, 18 aa, Homo sapiens
NLVINCEVFDPQEHENIN

SEQ ID NO: 44506 - protein, 13 aa, Homo sapiens
PEAEKALDLINKR

SEQ ID NO: 44507 - protein, 14 aa, Homo sapiens
PEANFPSFPLPHHK

SEQ ID NO: 44508 - protein, 16 aa, Homo sapiens
PHKPHEHGPPPPPDER

SEQ ID NO: 44509 - protein, 16 aa, Homo sapiens
PLPEANFPSFPLPHHK

SEQ ID NO: 44510 - protein, 25 aa, Homo sapiens
PQEHENINGVPPHLGHPFHWGGHER

SEQ ID NO: 44511 - protein, 13 aa, Homo sapiens
PQVSMFFTHTFPK

SEQ ID NO: 44512 - protein, 13 aa, Homo sapiens
PTDCSAVEPEAEK

SEQ ID NO: 44513 - protein, 21 aa, Homo sapiens
PTDCSAVEPEAEKALDLINKR

SEQ ID NO: 44514 - protein, 12 aa, Homo sapiens
PVLIDFFEDTER

SEQ ID NO: 44515 - protein, 7 aa, Homo sapiens
QIGSVYR

SEQ ID NO: 44516 - protein, 12 aa, Homo sapiens
QIGSVYRLPPLR

SEQ ID NO: 44517 - protein, 10 aa, Homo sapiens
RDGYLFQLLR

SEQ ID NO: 44518 - protein, 16 aa, Homo sapiens
RHSHNNNSSDLHPHKH

SEQ ID NO: 44519 - protein, 11 aa, Homo sapiens
RPSEIVIGQCK

SEQ ID NO: 44520 - protein, 16 aa, Homo sapiens
RPSEIVIGQCKVIATR

SEQ ID NO: 44521 - protein, 11 aa, Homo sapiens
RRDGYLFQLLR

SEQ ID NO: 44522 - protein, 25 aa, Homo sapiens
RVENTTVYYLVLDVQESDCSVLSRK

SEQ ID NO: 44523 - protein, 20 aa, Homo sapiens
RVIDFNCTTSSVSSALANTK

SEQ ID NO: 44524 - protein, 21 aa, Homo sapiens
RVIDFNCTTSSVSSALANTKD

SEQ ID NO: 44525 - protein, 17 aa, Homo sapiens
SCSSCQHATFGTNGAQR

SEQ ID NO: 44526 - protein, 16 aa, Homo sapiens
SGFPQVSMFFTHTFPK

SEQ ID NO: 44527 - protein, 13 aa, Homo sapiens
SPVLIDFFEDTER

SEQ ID NO: 44528 - protein, 15 aa, Homo sapiens
SSCQHATFGTNGAQR

SEQ ID NO: 44529 - protein, 14 aa, Homo sapiens
SSTTKPPFKPHGSR

SEQ ID NO: 44530 - protein, 16 aa, Homo sapiens
TKDSPVLIDFFEDTER

SEQ ID NO: 44531 - protein, 13 aa, Homo sapiens
TTSSVSSALANTK

SEQ ID NO: 44532 - protein, 23 aa, Homo sapiens
VENTTVYYLVLDVQESDCSVLSR

SEQ ID NO: 44533 - protein, 14 aa, Homo sapiens
VIATRHSHESQDLR

SEQ ID NO: 44534 - protein, 19 aa, Homo sapiens
VIDFNCTTSSVSSALANTK

SEQ ID NO: 44535 - protein, 33 aa, Homo sapiens
VIDFNCTTSSVSSALANTKDSPVLIDFFEDTER

SEQ ID NO: 44536 - protein, 16 aa, Homo sapiens
VRGGEGTGYFVDFSVR

SEQ ID NO: 44537 - protein, 20 aa, Homo sapiens
VRGGEGTGYFVDFSVRNCPR

SEQ ID NO: 44538 - protein, 15 aa, Homo sapiens
VSPTDCSAVEPEAEK

SEQ ID NO: 44539 - protein, 22 aa, Homo sapiens
VSPTDCSAVEPEAEKALDLINK

SEQ ID NO: 44540 - protein, 23 aa, Homo sapiens
VSPTDCSAVEPEAEKALDLINKR

SEQ ID NO: 44541 - protein, 12 aa, Homo sapiens
YKEENDDFASFR

SEQ ID NO: 44542 - protein, 15 aa, Homo sapiens
YKEENDDFASFRVDR

SEQ ID NO: 44543 - protein, 11 aa, Homo sapiens
YWNDCEPPDSR

SEQ ID NO: 44544 - protein, 12 aa, Homo sapiens
AQFEGIVTDLIR

SEQ ID NO: 44545 - protein, 24 aa, Homo sapiens
CELSSSVQTDINLPYLTMDSSGPK

SEQ ID NO: 44546 - protein, 12 aa, Homo sapiens
DAGQISGLNVLR

SEQ ID NO: 44547 - protein, 14 aa, Homo sapiens
EQQIVIQSSGGLSK

SEQ ID NO: 44548 - protein, 19 aa, Homo sapiens
ERVEAVNMAEGIIHDTETK

SEQ ID NO: 44549 - protein, 22 aa, Homo sapiens
GVPQIEVTFDIDANGIVHVSAK

SEQ ID NO: 44550 - protein, 17 aa, Homo sapiens
KNAVITVPAYFNDSQRQ

SEQ ID NO: 44551 - protein, 14 aa, Homo sapiens
LYSPSQIGAFVLMK

SEQ ID NO: 44552 - protein, 15 aa, Homo sapiens
MEEFKDQLPADECNK

SEQ ID NO: 44553 - protein, 14 aa, Homo sapiens
QAVTNPNNTFYATK

SEQ ID NO: 44554 - protein, 14 aa, Homo sapiens
SDIGEVILVGGMTR

SEQ ID NO: 44555 - protein, 17 aa, Homo sapiens
SQVFSTAADGQTQVEIK

SEQ ID NO: 44556 - protein, 19 aa, Homo sapiens
STNGDTFLGGEDFDQALLR

SEQ ID NO: 44557 - protein, 14 aa, Homo sapiens
TTPSVVAFTADGER

SEQ ID NO: 44558 - protein, 16 aa, Homo sapiens
VINEPTAAALAYGLDK

SEQ ID NO: 44559 - protein, 11 aa, Homo sapiens
VQQTVQDLFGR

SEQ ID NO: 44560 - protein, 22 aa, Homo sapiens
LDDYASAFQGHDVGFCCLGTTR

SEQ ID NO: 44561 - protein, 13 aa, Homo sapiens
YSVFRPGVLLCDR

SEQ ID NO: 44562 - protein, 15 aa, Homo sapiens
AWVNQLETQTGEASK

SEQ ID NO: 44563 - protein, 16 aa, Homo sapiens
VDQVQDIVTGNPTVIK

SEQ ID NO: 44564 - protein, 9 aa, Homo sapiens
VLQHAASNK

SEQ ID NO: 44565 - protein, 14 aa, Homo sapiens
HLESYEILLDCYDK

SEQ ID NO: 44566 - protein, 23 aa, Homo sapiens
IEDALDDSIGDVWDFNLDPIALK

SEQ ID NO: 44567 - protein, 18 aa, Homo sapiens
TSNGDLSDSTVSADPVVK

SEQ ID NO: 44568 - protein, 12 aa, Homo sapiens
AATGECTATVGK

SEQ ID NO: 44569 - protein, 13 aa, Homo sapiens
AATGECTATVGKR

SEQ ID NO: 44570 - protein, 10 aa, Homo sapiens
AENNATFYFK

SEQ ID NO: 44571 - protein, 9 aa, Homo sapiens
AGAEPASER

SEQ ID NO: 44572 - protein, 12 aa, Homo sapiens
AGAEPASEREVS

SEQ ID NO: 44573 - protein, 12 aa, Homo sapiens
AQRQVVAGLNFR

SEQ ID NO: 44574 - protein, 10 aa, Homo sapiens
ARVQVVAGKK

SEQ ID NO: 44575 - protein, 18 aa, Homo sapiens
ARVQVVAGKKYFIDFVAR

SEQ ID NO: 44576 - protein, 21 aa, Homo sapiens
ASFSQNCDIYPGKDFVQPPTK

SEQ ID NO: 44577 - protein, 11 aa, Homo sapiens
ATFYFKIDNVK

SEQ ID NO: 44578 - protein, 7 aa, Homo sapiens
AVDAALK

SEQ ID NO: 44579 - protein, 8 aa, Homo sapiens
AVDAALKK

SEQ ID NO: 44580 - protein, 23 aa, Homo sapiens
AVDAALKKYNSQNQSNNQFVLYR

SEQ ID NO: 44581 - protein, 17 aa, Homo sapiens
DAAKAATGECTATVGKR

SEQ ID NO: 44582 - protein, 8 aa, Homo sapiens
DFVQPPTK

SEQ ID NO: 44583 - protein, 15 aa, Homo sapiens
DIPTNSPELEETLTH

SEQ ID NO: 44584 - protein, 19 aa, Homo sapiens
DIPTNSPELEETLTHTITK

SEQ ID NO: 44585 - protein, 8 aa, Homo sapiens
EETTSHLR

SEQ ID NO: 44586 - protein, 10 aa, Homo sapiens
EGDCPVQSGK

SEQ ID NO: 44587 - protein, 22 aa, Homo sapiens
EGDCPVQSGKTWQDCEYKDAAK

SEQ ID NO: 44588 - protein, 11 aa, Homo sapiens
ENFLFLTPDCK

SEQ ID NO: 44589 - protein, 13 aa, Homo sapiens
ESNEELTESCETK

SEQ ID NO: 44590 - protein, 17 aa, Homo sapiens
FNNNTQHSSLFMLNEVK

SEQ ID NO: 44591 - protein, 12 aa, Homo sapiens
GEIKEETTSHLR

SEQ ID NO: 44592 - protein, 14 aa, Homo sapiens
GRPPKAGAEPASER

SEQ ID NO: 44593 - protein, 17 aa, Homo sapiens
GRPPKAGAEPASEREVS

SEQ ID NO: 44594 - protein, 8 aa, Homo sapiens
HGIQYFNN

SEQ ID NO: 44595 - protein, 11 aa, Homo sapiens
HGIQYFNNNTQ

SEQ ID NO: 44596 - protein, 12 aa, Homo sapiens
HGIQYFNNNTQH

SEQ ID NO: 44597 - protein, 16 aa, Homo sapiens
HGIQYFNNNTQHSSLF

SEQ ID NO: 44598 - protein, 19 aa, Homo sapiens
HGIQYFNNNTQHSSLFMLN

SEQ ID NO: 44599 - protein, 22 aa, Homo sapiens
HGIQYFNNNTQHSSLFMLNEVK

SEQ ID NO: 44600 - protein, 23 aa, Homo sapiens
HGIQYFNNNTQHSSLFMLNEVKR

SEQ ID NO: 44601 - protein, 11 aa, Homo sapiens
HSSLFMLNEVK

SEQ ID NO: 44602 - protein, 14 aa, Homo sapiens
IASFSQNCDIYPGK

SEQ ID NO: 44603 - protein, 22 aa, Homo sapiens
IASFSQNCDIYPGKDFVQPPTK

SEQ ID NO: 44604 - protein, 7 aa, Homo sapiens
ICVGCPR

SEQ ID NO: 44605 - protein, 13 aa, Homo sapiens
IGEIKEETTSHLR

SEQ ID NO: 44606 - protein, 14 aa, Homo sapiens
IGEIKEETTSHLRS

SEQ ID NO: 44607 - protein, 18 aa, Homo sapiens
IGEIKEETTSHLRSCEYK

SEQ ID NO: 44608 - protein, 19 aa, Homo sapiens
IGEIKEETTSHLRSCEYKG

SEQ ID NO: 44609 - protein, 23 aa, Homo sapiens
IGEIKEETTSHLRSCEYKGRPPK

SEQ ID NO: 44610 - protein, 18 aa, Homo sapiens
IPTNSPELEETLTHTITK

SEQ ID NO: 44611 - protein, 17 aa, Homo sapiens
ITEATKTVGSDTFYSFK

SEQ ID NO: 44612 - protein, 21 aa, Homo sapiens
ITEATKTVGSDTFYSFKYEIK

SEQ ID NO: 44613 - protein, 12 aa, Homo sapiens
ITYSIVQTNCSK

SEQ ID NO: 44614 - protein, 23 aa, Homo sapiens
ITYSIVQTNCSKENFLFLTPDCK

SEQ ID NO: 44615 - protein, 17 aa, Homo sapiens
IYPTVNCQPLGMISLMK

SEQ ID NO: 44616 - protein, 17 aa, Homo sapiens
KIYPTVNCQPLGMISLM

SEQ ID NO: 44617 - protein, 18 aa, Homo sapiens
KIYPTVNCQPLGMISLMK

SEQ ID NO: 44618 - protein, 19 aa, Homo sapiens
KLGQSLDCNAEVYVVPWEK

SEQ ID NO: 44619 - protein, 20 aa, Homo sapiens
KLGQSLDCNAEVYVVPWEKK

SEQ ID NO: 44620 - protein, 13 aa, Homo sapiens
KLNAENNATFYFK

SEQ ID NO: 44621 - protein, 14 aa, Homo sapiens
KLNAENNATFYFKI

SEQ ID NO: 44622 - protein, 9 aa, Homo sapiens
KYFIDFVAR

SEQ ID NO: 44623 - protein, 16 aa, Homo sapiens
KYNSQNQSNNQFVLYR

SEQ ID NO: 44624 - protein, 17 aa, Homo sapiens
KYNSQNQSNNQFVLYRI

SEQ ID NO: 44625 - protein, 18 aa, Homo sapiens
LGQSLDCNAEVYVVPWEK

SEQ ID NO: 44626 - protein, 19 aa, Homo sapiens
LGQSLDCNAEVYVVPWEKK

SEQ ID NO: 44627 - protein, 12 aa, Homo sapiens
LNAENNATFYFK

SEQ ID NO: 44628 - protein, 17 aa, Homo sapiens
LNAENNATFYFKIDNVK

SEQ ID NO: 44629 - protein, 18 aa, Homo sapiens
LNAENNATFYFKIDNVKK

SEQ ID NO: 44630 - protein, 7 aa, Homo sapiens
NATFYFK

SEQ ID NO: 44631 - protein, 9 aa, Homo sapiens
NAYIDIQLR

SEQ ID NO: 44632 - protein, 15 aa, Homo sapiens
NCSKENFLFLTPDCK

SEQ ID NO: 44633 - protein, 8 aa, Homo sapiens
NNATFYFK

SEQ ID NO: 44634 - protein, 15 aa, Homo sapiens
NNTQHSSLFMLNEVK

SEQ ID NO: 44635 - protein, 14 aa, Homo sapiens
NTQHSSLFMLNEVK

SEQ ID NO: 44636 - protein, 32 aa, Homo sapiens
PAEGPVVTAQYDCLGCVHPISTQSPDLEPILR

SEQ ID NO: 44637 - protein, 13 aa, Homo sapiens
PELEETLTHTITK

SEQ ID NO: 44638 - protein, 17 aa, Homo sapiens
PTNSPELEETLTHTITK

SEQ ID NO: 44639 - protein, 9 aa, Homo sapiens
QVVAGLNFR

SEQ ID NO: 44640 - protein, 14 aa, Homo sapiens
RHGIQYFNNNTQHS

SEQ ID NO: 44641 - protein, 24 aa, Homo sapiens
RHGIQYFNNNTQHSSLFMLNEVKR

SEQ ID NO: 44642 - protein, 13 aa, Homo sapiens
RITYSIVQTNCSK

SEQ ID NO: 44643 - protein, 14 aa, Homo sapiens
RITYSIVQTNCSKE

SEQ ID NO: 44644 - protein, 9 aa, Homo sapiens
RPPGFSPFR

SEQ ID NO: 44645 - protein, 10 aa, Homo sapiens
SCEYKGRPPK

SEQ ID NO: 44646 - protein, 19 aa, Homo sapiens
SCEYKGRPPKAGAEPASER

SEQ ID NO: 44647 - protein, 22 aa, Homo sapiens
SCEYKGRPPKAGAEPASEREVS

SEQ ID NO: 44648 - protein, 20 aa, Homo sapiens
SFSQNCDIYPGKDFVQPPTK

SEQ ID NO: 44649 - protein, 9 aa, Homo sapiens
SIVQTNCSK

SEQ ID NO: 44650 - protein, 20 aa, Homo sapiens
SIVQTNCSKENFLFLTPDCK

SEQ ID NO: 44651 - protein, 21 aa, Homo sapiens
SLWNGDTGECTDNAYIDIQLR

SEQ ID NO: 44652 - protein, 9 aa, Homo sapiens
SNNQFVLYR

SEQ ID NO: 44653 - protein, 9 aa, Homo sapiens
SPDLEPILR

SEQ ID NO: 44654 - protein, 14 aa, Homo sapiens
SPELEETLTHTITK

SEQ ID NO: 44655 - protein, 13 aa, Homo sapiens
SQNQSNNQFVLYR

SEQ ID NO: 44656 - protein, 10 aa, Homo sapiens
SSLFMLNEVK

SEQ ID NO: 44657 - protein, 16 aa, Homo sapiens
SSRIGEIKEETTSHLR

SEQ ID NO: 44658 - protein, 10 aa, Homo sapiens
TGECTATVGK

SEQ ID NO: 44659 - protein, 16 aa, Homo sapiens
TNSPELEETLTHTITK

SEQ ID NO: 44660 - protein, 13 aa, Homo sapiens
TQHSSLFMLNEVK

SEQ ID NO: 44661 - protein, 11 aa, Homo sapiens
TVGSDTFYSFK

SEQ ID NO: 44662 - protein, 15 aa, Homo sapiens
TVGSDTFYSFKYEIK

SEQ ID NO: 44663 - protein, 25 aa, Homo sapiens
TVGSDTFYSFKYEIKEGDCPVQSGK

SEQ ID NO: 44664 - protein, 8 aa, Homo sapiens
TWQDCEYK

SEQ ID NO: 44665 - protein, 12 aa, Homo sapiens
TWQDCEYKDAAK

SEQ ID NO: 44666 - protein, 22 aa, Homo sapiens
TYSIVQTNCSKENFLFLTPDCK

SEQ ID NO: 44667 - protein, 16 aa, Homo sapiens
VHPISTQSPDLEPILR

SEQ ID NO: 44668 - protein, 18 aa, Homo sapiens
VQTNCSKENFLFLTPDCK

SEQ ID NO: 44669 - protein, 7 aa, Homo sapiens
VQVVAGK

SEQ ID NO: 44670 - protein, 16 aa, Homo sapiens
VQVVAGKKYFIDFVAR

SEQ ID NO: 44671 - protein, 14 aa, Homo sapiens
YEIKEGDCPVQSGK

SEQ ID NO: 44672 - protein, 8 aa, Homo sapiens
YFIDFVAR

SEQ ID NO: 44673 - protein, 11 aa, Homo sapiens
YNSQNQSNNQF

SEQ ID NO: 44674 - protein, 14 aa, Homo sapiens
YNSQNQSNNQFVLY

SEQ ID NO: 44675 - protein, 15 aa, Homo sapiens
YNSQNQSNNQFVLYR

SEQ ID NO: 44676 - protein, 10 aa, Homo sapiens
YSIVQTNCSK

SEQ ID NO: 44677 - protein, 21 aa, Homo sapiens
YSIVQTNCSKENFLFLTPDCK

SEQ ID NO: 44678 - protein, 17 aa, Homo sapiens
DLSSHQLNEFLAQTLQR

SEQ ID NO: 44679 - protein, 15 aa, Homo sapiens
EHPYLFSQCQAIHCR

SEQ ID NO: 44680 - protein, 16 aa, Homo sapiens
HFNALGGWGELQNSVK

SEQ ID NO: 44681 - protein, 11 aa, Homo sapiens
LTYTAEVSVPK

SEQ ID NO: 44682 - protein, 21 aa, Homo sapiens
LVVDLTDIDPDVAYSSVPYEK

SEQ ID NO: 44683 - protein, 17 aa, Homo sapiens
PEIVDTCSLASPASVCR

SEQ ID NO: 44684 - protein, 22 aa, Homo sapiens
SLSNVIAHEISHSWTGNLVTNK

SEQ ID NO: 44685 - protein, 17 aa, Homo sapiens
TWDHFWLNEGHTVYLER

SEQ ID NO: 44686 - protein, 24 aa, Homo sapiens
TYQEHKASMHPVTAMLVGKDLKVD

SEQ ID NO: 44687 - protein, 18 aa, Homo sapiens
VPIPCYLIALVVGALESR

SEQ ID NO: 44688 - protein, 30 aa, Homo sapiens
EVLDVAAGMIKPGVTTEEIDHAVHLACIAR

SEQ ID NO: 44689 - protein, 21 aa, Homo sapiens
IKPGVTTEEIDHAVHLACIAR

SEQ ID NO: 44690 - protein, 13 aa, Homo sapiens
LFHTAPNVPHYAK

SEQ ID NO: 44691 - protein, 21 aa, Homo sapiens
LVQTTYECLMQAIDAVKPGVR

SEQ ID NO: 44692 - protein, 14 aa, Homo sapiens
NCYPSPLNYYNFPK

SEQ ID NO: 44693 - protein, 17 aa, Homo sapiens
RPLQEGDIVNVDITLYR

SEQ ID NO: 44694 - protein, 20 aa, Homo sapiens
SAQFEHTLLVTDTGCEILTR

SEQ ID NO: 44695 - protein, 17 aa, Homo sapiens
SCCTSVNEVICHGIPDR

SEQ ID NO: 44696 - protein, 9 aa, Homo sapiens
SYCGHGIHK

SEQ ID NO: 44697 - protein, 19 aa, Homo sapiens
AAQLPYDVQHADIDYMDER

SEQ ID NO: 44698 - protein, 10 aa, Homo sapiens
AYVAFPDFFR

SEQ ID NO: 44699 - protein, 16 aa, Homo sapiens
DASLNHPPYMPHLESR

SEQ ID NO: 44700 - protein, 10 aa, Homo sapiens
DFTYDSVDFK

SEQ ID NO: 44701 - protein, 11 aa, Homo sapiens
DPNNLAFNEIK

SEQ ID NO: 44702 - protein, 14 aa, Homo sapiens
EIEELYNNPQNPER

SEQ ID NO: 44703 - protein, 10 aa, Homo sapiens
FAGFPALINR

SEQ ID NO: 44704 - protein, 11 aa, Homo sapiens
GELFWDDGETK

SEQ ID NO: 44705 - protein, 15 aa, Homo sapiens
GFPEFVNELHNNGQK

SEQ ID NO: 44706 - protein, 9 aa, Homo sapiens
GVEDDVFIK

SEQ ID NO: 44707 - protein, 20 aa, Homo sapiens
GVEDDVFIKYPNDGDIVWGK

SEQ ID NO: 44708 - protein, 19 aa, Homo sapiens
HNGVPSQTSPTVTYDSNLK

SEQ ID NO: 44709 - protein, 9 aa, Homo sapiens
ILDGYLFCK

SEQ ID NO: 44710 - protein, 11 aa, Homo sapiens
INCIPDQPPTK

SEQ ID NO: 44711 - protein, 8 aa, Homo sapiens
IYDPNKNR

SEQ ID NO: 44712 - protein, 9 aa, Homo sapiens
KNPFGIEIR

SEQ ID NO: 44713 - protein, 7 aa, Homo sapiens
LDVTYHK

SEQ ID NO: 44714 - protein, 18 aa, Homo sapiens
LPSTNVYGLGEHVHQQYR

SEQ ID NO: 44715 - protein, 8 aa, Homo sapiens
LTDQTNNR

SEQ ID NO: 44716 - protein, 7 aa, Homo sapiens
MKADGMR

SEQ ID NO: 44717 - protein, 26 aa, Homo sapiens
NLPSSPVFGSNVDNVLLTAEYQTSNR

SEQ ID NO: 44718 - protein, 8 aa, Homo sapiens
NPFGIEIR

SEQ ID NO: 44719 - protein, 11 aa, Homo sapiens
QKVEMELPGDK

SEQ ID NO: 44720 - protein, 9 aa, Homo sapiens
QLDFTLSPK

SEQ ID NO: 44721 - protein, 11 aa, Homo sapiens
RDFTYDSVDFK

SEQ ID NO: 44722 - protein, 15 aa, Homo sapiens
REIEELYNNPQNPER

SEQ ID NO: 44723 - protein, 17 aa, Homo sapiens
SSVYANAFPSTPVNPLR

SEQ ID NO: 44724 - protein, 8 aa, Homo sapiens
STFAGSGK

SEQ ID NO: 44725 - protein, 9 aa, Homo sapiens
VEMELPGDK

SEQ ID NO: 44726 - protein, 13 aa, Homo sapiens
VYLLCEFSVTQNR

SEQ ID NO: 44727 - protein, 13 aa, Homo sapiens
WYDYYTGVDINAR

SEQ ID NO: 44728 - protein, 10 aa, Homo sapiens
YEYGTLDNMR

SEQ ID NO: 44729 - protein, 11 aa, Homo sapiens
YLYGFGETEHR

SEQ ID NO: 44730 - protein, 11 aa, Homo sapiens
YPNDGDIVWGK

SEQ ID NO: 44731 - protein, 29 aa, Homo sapiens
KSSLSASTNPELGSNVSGTQTYPVVTGRD

SEQ ID NO: 44732 - protein, 11 aa, Homo sapiens
ESVFTVEGGHR

SEQ ID NO: 44733 - protein, 17 aa, Homo sapiens
IGGVQQDTILAEGLHFR

SEQ ID NO: 44734 - protein, 13 aa, Homo sapiens
IPWFQYPIIYDIR

SEQ ID NO: 44735 - protein, 19 aa, Homo sapiens
IYLTADNLVLNLQDESFTR

SEQ ID NO: 44736 - protein, 16 aa, Homo sapiens
VLSRPNAQELPSMYQR

SEQ ID NO: 44737 - protein, 19 aa, Homo sapiens
ISVSINGVSIHSQGVDLHI

SEQ ID NO: 44738 - protein, 25 aa, Homo sapiens
KESGLDNCTRISGFLAFKNFDYGAM

SEQ ID NO: 44739 - protein, 33 aa, Homo sapiens
RLPQDGDNVTVENGQLLLLDTNTSILNLLHIKG

SEQ ID NO: 44740 - protein, 17 aa, Homo sapiens
RWQIVPNASSPFGFWSQ

SEQ ID NO: 44741 - protein, 12 aa, Homo sapiens
STGMISSLSSNK

SEQ ID NO: 44742 - protein, 15 aa, Homo sapiens
SPDTNYLFMGDYVDR

SEQ ID NO: 44743 - protein, 11 aa, Homo sapiens
YSFLQFDPAPR

SEQ ID NO: 44744 - protein, 12 aa, Homo sapiens
DTEDQEDQVDPR

SEQ ID NO: 44745 - protein, 17 aa, Homo sapiens
ELNQAGQETLVTGWGYH

SEQ ID NO: 44746 - protein, 20 aa, Homo sapiens
ELNQAGQETLVTGWGYHSSR

SEQ ID NO: 44747 - protein, 10 aa, Homo sapiens
EVFVHPNYSK

SEQ ID NO: 44748 - protein, 25 aa, Homo sapiens
EVSFLNCSLDNGGCTHYCLEEVGWR

SEQ ID NO: 44749 - protein, 30 aa, Homo sapiens
IPVVPHNECSEVMSNMVSENMLCAGILGDR

SEQ ID NO: 44750 - protein, 12 aa, Homo sapiens
KEVFVHPNYSKS

SEQ ID NO: 44751 - protein, 13 aa, Homo sapiens
LGDDLLQCHPAVK

SEQ ID NO: 44752 - protein, 7 aa, Homo sapiens
LGEYDLR

SEQ ID NO: 44753 - protein, 27 aa, Homo sapiens
REVSFLNCSLDNGGCTHYCLEEVGWRR

SEQ ID NO: 44754 - protein, 14 aa, Homo sapiens
RGDSPWQVVLLDSK

SEQ ID NO: 44755 - protein, 12 aa, Homo sapiens
RNRTFVLNFIKI

SEQ ID NO: 44756 - protein, 35 aa, Homo sapiens
STTDNDIALLHLAQPATLSQTIVPICLPDSGLAER

SEQ ID NO: 44757 - protein, 8 aa, Homo sapiens
TFVLNFIK

SEQ ID NO: 44758 - protein, 8 aa, Homo sapiens
WELDLDIK

SEQ ID NO: 44759 - protein, 8 aa, Homo sapiens
YLDWIHGH

SEQ ID NO: 44760 - protein, 10 aa, Homo sapiens
YLDWIHGHIR

SEQ ID NO: 44761 - protein, 15 aa, Homo sapiens
DAVSGMGVIVHIIEK

SEQ ID NO: 44762 - protein, 14 aa, Homo sapiens
FGIQAQMVTTDFQK

SEQ ID NO: 44763 - protein, 16 aa, Homo sapiens
FGPYYTEPVIAGLDPK

SEQ ID NO: 44764 - protein, 7 aa, Homo sapiens
LNLYELK

SEQ ID NO: 44765 - protein, 18 aa, Homo sapiens
LYIGLAGLATDVQTVAQR

SEQ ID NO: 44766 - protein, 18 aa, Homo sapiens
QIKPYTLMSMVANLLYEK

SEQ ID NO: 44767 - protein, 14 aa, Homo sapiens
SIMSYNGGAVMAMK

SEQ ID NO: 44768 - protein, 13 aa, Homo sapiens
TLMSMVANLLYEK

SEQ ID NO: 44769 - protein, 26 aa, Homo sapiens
RCRELRNFSSLRAILSALQSNPIYRL

SEQ ID NO: 44770 - protein, 21 aa, Homo sapiens
MSLNNSSNVFLDSVPSNTNRF

SEQ ID NO: 44771 - protein, 29 aa, Homo sapiens
RDATGNMNDTIISGMNCNGSAACGLGYDF

SEQ ID NO: 44772 - protein, 19 aa, Homo sapiens
ALSVGNIDDALQCYSEAIK

SEQ ID NO: 44773 - protein, 8 aa, Homo sapiens
DAIHFYNK

SEQ ID NO: 44774 - protein, 14 aa, Homo sapiens
DCEECIQLEPTFIK

SEQ ID NO: 44775 - protein, 10 aa, Homo sapiens
DPQALSEHLK

SEQ ID NO: 44776 - protein, 20 aa, Homo sapiens
ELDPTNMTYITNQAAVYFEK

SEQ ID NO: 44777 - protein, 13 aa, Homo sapiens
LAYINPDLALEEK

SEQ ID NO: 44778 - protein, 12 aa, Homo sapiens
LDPHNHVLYSNR

SEQ ID NO: 44779 - protein, 10 aa, Homo sapiens
TVDLKPDWGK

SEQ ID NO: 44780 - protein, 16 aa, Homo sapiens
TYEEGLKHEANNPQLK

SEQ ID NO: 44781 - protein, 14 aa, Homo sapiens
AKVIAAEGEMNASR

SEQ ID NO: 44782 - protein, 13 aa, Homo sapiens
AMAAEAEASREAR

SEQ ID NO: 44783 - protein, 16 aa, Homo sapiens
GPGLFFILPCTDSFIK

SEQ ID NO: 44784 - protein, 15 aa, Homo sapiens
IIKEYERAIIFRLGR

SEQ ID NO: 44785 - protein, 22 aa, Homo sapiens
KNSTIVFPLPIDMLQGIIGAKH

SEQ ID NO: 44786 - protein, 30 aa, Homo sapiens
NLSQILSDREEIAHNMQSTLDDATDAWGIK

SEQ ID NO: 44787 - protein, 20 aa, Homo sapiens
NSTIVFPLPIDMLQGIIGAK

SEQ ID NO: 44788 - protein, 19 aa, Homo sapiens
VQNATLAVANITNADSATR

SEQ ID NO: 44789 - protein, 28 aa, Homo sapiens
DGSNKSGAEEQGPIDGPSKSGAEEQTSK

SEQ ID NO: 44790 - protein, 30 aa, Homo sapiens
KDGSNKSGAEEQGPIDGPSKSGAEEQTSKD

SEQ ID NO: 44791 - protein, 30 aa, Homo sapiens
KQEEAGVRPSAGNVSTHPSLSQRPGGSTKS

SEQ ID NO: 44792 - protein, 20 aa, Homo sapiens
SGAEAQTPEDSPNRSGAEAK

SEQ ID NO: 44793 - protein, 22 aa, Homo sapiens
AVDLLNYTQWFPIVIFFNPDSR

SEQ ID NO: 44794 - protein, 9 aa, Homo sapiens
HALLDVTPK

SEQ ID NO: 44795 - protein, 33 aa, Homo sapiens
LAGGNDVGIFVAGIQEGTSAEQEGLQEGDQILK

SEQ ID NO: 44796 - protein, 16 aa, Homo sapiens
RPVVLFGPIADIAMEK

SEQ ID NO: 44797 - protein, 18 aa, Homo sapiens
STGDIAGTVVPETNKEPR

SEQ ID NO: 44798 - protein, 18 aa, Homo sapiens
TFLRPSPEDEAIYGPNTK

SEQ ID NO: 44799 - protein, 21 aa, Homo sapiens
THKPDPGTPQHTSSRPPEPQK

SEQ ID NO: 44800 - protein, 11 aa, Homo sapiens
VTENMSLTDAR

SEQ ID NO: 44801 - protein, 10 aa, Homo sapiens
RQRNASRDQV

SEQ ID NO: 44802 - protein, 17 aa, Homo sapiens
EKEEFAVPENSSVQQFK

SEQ ID NO: 44803 - protein, 13 aa, Homo sapiens
SHTDQLVLIFAGK

SEQ ID NO: 44804 - protein, 19 aa, Homo sapiens
FLLVYLHGDDHQDSDEFCR

SEQ ID NO: 44805 - protein, 17 aa, Homo sapiens
HTLEQHNWNIEAAVQDR

SEQ ID NO: 44806 - protein, 18 aa, Homo sapiens
KLECLPPEPSPDDPESVK

SEQ ID NO: 44807 - protein, 8 aa, Homo sapiens
KLPNDSRV

SEQ ID NO: 44808 - protein, 35 aa, Homo sapiens
VLPCIPSEEWPNPPTLQEAGLSHTEVLFVQDLTDE

SEQ ID NO: 44809 - protein, 18 aa, Homo sapiens
VTDPVGDIVSFMHSFEEK

SEQ ID NO: 44810 - protein, 39 aa, Homo sapiens
KEMEEFVQSSGENGVVVFSLGSMVSNMTEERANVIATAL

SEQ ID NO: 44811 - protein, 28 aa, Homo sapiens
KQPYIVSAAENGEMCVWNVTNGQCVEKA

SEQ ID NO: 44812 - protein, 12 aa, Homo sapiens
AAQVTIQSSGTF

SEQ ID NO: 44813 - protein, 15 aa, Homo sapiens
AAQVTIQSSGTFSSK

SEQ ID NO: 44814 - protein, 23 aa, Homo sapiens
AEALESQELCGTEVPSVPEHGRK

SEQ ID NO: 44815 - protein, 15 aa, Homo sapiens
AELSASSVYNLLPEK

SEQ ID NO: 44816 - protein, 15 aa, Homo sapiens
AENDVLHCVAFAVPK

SEQ ID NO: 44817 - protein, 10 aa, Homo sapiens
AFALAGNQDK

SEQ ID NO: 44818 - protein, 12 aa, Homo sapiens
AFALAGNQDKRK

SEQ ID NO: 44819 - protein, 17 aa, Homo sapiens
AFQPFFVELTMPYSVIR

SEQ ID NO: 44820 - protein, 24 aa, Homo sapiens
AFQPFFVELTMPYSVIRGEAFTLK

SEQ ID NO: 44821 - protein, 6 aa, Homo sapiens
AFTNSK

SEQ ID NO: 44822 - protein, 11 aa, Homo sapiens
AFTNSKIRKPK

SEQ ID NO: 44823 - protein, 21 aa, Homo sapiens
AGAFCLSEDAGLGISSTASLR

SEQ ID NO: 44824 - protein, 12 aa, Homo sapiens
AGLGISSTASLR

SEQ ID NO: 44825 - protein, 18 aa, Homo sapiens
AGVAEVGVTVPDTITEWK

SEQ ID NO: 44826 - protein, 17 aa, Homo sapiens
AHTSFQISLSVSYTGSR

SEQ ID NO: 44827 - protein, 11 aa, Homo sapiens
AIGYLNTGYQR

SEQ ID NO: 44828 - protein, 31 aa, Homo sapiens
AIGYLNTGYQRQLNYKHYDGSYSTFGERYGR

SEQ ID NO: 44829 - protein, 8 aa, Homo sapiens
ALAGNQDK

SEQ ID NO: 44830 - protein, 8 aa, Homo sapiens
ALIWLSQR

SEQ ID NO: 44831 - protein, 15 aa, Homo sapiens
ALLAYAFALAGNQDK

SEQ ID NO: 44832 - protein, 16 aa, Homo sapiens
ALLAYAFALAGNQDKR

SEQ ID NO: 44833 - protein, 17 aa, Homo sapiens
ALLAYAFALAGNQDKRK

SEQ ID NO: 44834 - protein, 21 aa, Homo sapiens
ALLAYAFALAGNQDKRKEVLK

SEQ ID NO: 44835 - protein, 15 aa, Homo sapiens
ALLEIPLTVTHPVVR

SEQ ID NO: 44836 - protein, 20 aa, Homo sapiens
APVGHFYEPQAPSAEVEMTS

SEQ ID NO: 44837 - protein, 21 aa, Homo sapiens
APVGHFYEPQAPSAEVEMTSY

SEQ ID NO: 44838 - protein, 46 aa, Homo sapiens
APVGHFYEPQAPSAEVEMTSYVLLAYLTAQPAPTSEDLTSATNIVK

SEQ ID NO: 44839 - protein, 18 aa, Homo sapiens
AQPAPTSEDLTSATNIVK

SEQ ID NO: 44840 - protein, 15 aa, Homo sapiens
ASDCHGEDSQAFCEK

SEQ ID NO: 44841 - protein, 12 aa, Homo sapiens
ASVSVLGDILGS

SEQ ID NO: 44842 - protein, 19 aa, Homo sapiens
ASVSVLGDILGSAMQNTQN

SEQ ID NO: 44843 - protein, 21 aa, Homo sapiens
ASVSVLGDILGSAMQNTQNLL

SEQ ID NO: 44844 - protein, 25 aa, Homo sapiens
ASVSVLGDILGSAMQNTQNLLQMPY

SEQ ID NO: 44845 - protein, 29 aa, Homo sapiens
ASVSVLGDILGSAMQNTQNLLQMPYGCGE

SEQ ID NO: 44846 - protein, 9 aa, Homo sapiens
ATVLNYLPK

SEQ ID NO: 44847 - protein, 12 aa, Homo sapiens
ATVLNYLPKCIR

SEQ ID NO: 44848 - protein, 10 aa, Homo sapiens
AVDQSVLLMK

SEQ ID NO: 44849 - protein, 12 aa, Homo sapiens
AVDQSVLLMKPD

SEQ ID NO: 44850 - protein, 15 aa, Homo sapiens
AVDQSVLLMKPDAEL

SEQ ID NO: 44851 - protein, 17 aa, Homo sapiens
AVDQSVLLMKPDAELSA

SEQ ID NO: 44852 - protein, 18 aa, Homo sapiens
AVDQSVLLMKPDAELSAS

SEQ ID NO: 44853 - protein, 21 aa, Homo sapiens
AVDQSVLLMKPDAELSASSVY

SEQ ID NO: 44854 - protein, 22 aa, Homo sapiens
AVDQSVLLMKPDAELSASSVYN

SEQ ID NO: 44855 - protein, 27 aa, Homo sapiens
AVDQSVLLMKPDAELSASSVYNLLPEK

SEQ ID NO: 44856 - protein, 29 aa, Homo sapiens
AVDQSVLLMKPDAELSASSVYNLLPEKDL

SEQ ID NO: 44857 - protein, 36 aa, Homo sapiens
AVDQSVLLMKPDAELSASSVYNLLPEKDLTGFPGPL

SEQ ID NO: 44858 - protein, 37 aa, Homo sapiens
AVDQSVLLMKPDAELSASSVYNLLPEKDLTGFPGPLN

SEQ ID NO: 44859 - protein, 47 aa, Homo sapiens
AVDQSVLLMKPDAELSASSVYNLLPEKDLTGFPGPLNDQDDEDCINR

SEQ ID NO: 44860 - protein, 14 aa, Homo sapiens
AVLPTGDVIGDSAK

SEQ ID NO: 44861 - protein, 9 aa, Homo sapiens
AYIFIDEAH

SEQ ID NO: 44862 - protein, 11 aa, Homo sapiens
AYIFIDEAHIT

SEQ ID NO: 44863 - protein, 12 aa, Homo sapiens
AYIFIDEAHITQ

SEQ ID NO: 44864 - protein, 13 aa, Homo sapiens
AYIFIDEAHITQA

SEQ ID NO: 44865 - protein, 14 aa, Homo sapiens
AYIFIDEAHITQAL

SEQ ID NO: 44866 - protein, 20 aa, Homo sapiens
AYIFIDEAHITQALIWLSQR

SEQ ID NO: 44867 - protein, 22 aa, Homo sapiens
AYLTAQPAPTSEDLTSATNIVK

SEQ ID NO: 44868 - protein, 17 aa, Homo sapiens
CLSEDAGLGISSTASLR

SEQ ID NO: 44869 - protein, 16 aa, Homo sapiens
CPQLQQYEMHGPEGLR

SEQ ID NO: 44870 - protein, 14 aa, Homo sapiens
CPSGGEVSEELSLK

SEQ ID NO: 44871 - protein, 26 aa, Homo sapiens
CYGYQWVSEEHEEAHHTAYLVFSPSK

SEQ ID NO: 44872 - protein, 16 aa, Homo sapiens
DASDCHGEDSQAFCEK

SEQ ID NO: 44873 - protein, 18 aa, Homo sapiens
DLEAENDVLHCVAFAVPK

SEQ ID NO: 44874 - protein, 8 aa, Homo sapiens
DLKPAIVK

SEQ ID NO: 44875 - protein, 18 aa, Homo sapiens
DLSFSPSQSLPASHAHLR

SEQ ID NO: 44876 - protein, 20 aa, Homo sapiens
DLTGFPGPLNDQDDEDCINR

SEQ ID NO: 44877 - protein, 12 aa, Homo sapiens
DMYSFLEDMGLK

SEQ ID NO: 44878 - protein, 8 aa, Homo sapiens
DNSVHWER

SEQ ID NO: 44879 - protein, 11 aa, Homo sapiens
DNSVHWERPQK

SEQ ID NO: 44880 - protein, 13 aa, Homo sapiens
DNSVHWERPQKPK

SEQ ID NO: 44881 - protein, 10 aa, Homo sapiens
DSLVFVQTDK

SEQ ID NO: 44882 - protein, 14 aa, Homo sapiens
DTVIKPLLVEPEGL

SEQ ID NO: 44883 - protein, 16 aa, Homo sapiens
DTVIKPLLVEPEGLEK

SEQ ID NO: 44884 - protein, 38 aa, Homo sapiens
DTVIKPLLVEPEGLEKETTFNSLLCPSGGEVSEELSLK

SEQ ID NO: 44885 - protein, 11 aa, Homo sapiens
DTVVALHALSK

SEQ ID NO: 44886 - protein, 16 aa, Homo sapiens
EAENDVLHCVAFAVPK

SEQ ID NO: 44887 - protein, 21 aa, Homo sapiens
EALESQELCGTEVPSVPEHGR

SEQ ID NO: 44888 - protein, 13 aa, Homo sapiens
EASPAFLAVPVEK

SEQ ID NO: 44889 - protein, 11 aa, Homo sapiens
EDSLVFVQTDK

SEQ ID NO: 44890 - protein, 20 aa, Homo sapiens
EEFPFALGVQTLPQTCDEPK

SEQ ID NO: 44891 - protein, 12 aa, Homo sapiens
EIPLTVTHPVVR

SEQ ID NO: 44892 - protein, 15 aa, Homo sapiens
ELCGTEVPSVPEHGR

SEQ ID NO: 44893 - protein, 17 aa, Homo sapiens
ELTMPYSVIRGEAFTLK

SEQ ID NO: 44894 - protein, 26 aa, Homo sapiens
EMNVSVCGLYTYGKPVPGHVTVSICR

SEQ ID NO: 44895 - protein, 14 aa, Homo sapiens
ENDVLHCVAFAVPK

SEQ ID NO: 44896 - protein, 12 aa, Homo sapiens
EQAPHCICANGR

SEQ ID NO: 44897 - protein, 18 aa, Homo sapiens
ESQELCGTEVPSVPEHGR

SEQ ID NO: 44898 - protein, 19 aa, Homo sapiens
ESQELCGTEVPSVPEHGRK

SEQ ID NO: 44899 - protein, 22 aa, Homo sapiens
ETTFNSLLCPSGGEVSEELSLK

SEQ ID NO: 44900 - protein, 33 aa, Homo sapiens
ETTFNSLLCPSGGEVSEELSLKLPPNVVEESAR

SEQ ID NO: 44901 - protein, 13 aa, Homo sapiens
EVLKSLNEEAVKK

SEQ ID NO: 44902 - protein, 26 aa, Homo sapiens
EVLKSLNEEAVKKDNSVHWERPQKPK

SEQ ID NO: 44903 - protein, 13 aa, Homo sapiens
EVSSNHVLIYLDK

SEQ ID NO: 44904 - protein, 24 aa, Homo sapiens
EYEMKLHTEAQIQEEGTVVELTGR

SEQ ID NO: 44905 - protein, 9 aa, Homo sapiens
FEVQVTVPK

SEQ ID NO: 44906 - protein, 11 aa, Homo sapiens
FFTVLQDVPVR

SEQ ID NO: 44907 - protein, 17 aa, Homo sapiens
FHPLNELIPLVYIQDPK

SEQ ID NO: 44908 - protein, 17 aa, Homo sapiens
FIDEAHITQALIWLSQR

SEQ ID NO: 44909 - protein, 16 aa, Homo sapiens
FPGPLNDQDDEDCINR

SEQ ID NO: 44910 - protein, 8 aa, Homo sapiens
FQVDNNNR

SEQ ID NO: 44911 - protein, 26 aa, Homo sapiens
FRVVSMDENFHPLNELIPLVYIQDPK

SEQ ID NO: 44912 - protein, 29 aa, Homo sapiens
FRVVSMDENFHPLNELIPLVYIQDPKGNR

SEQ ID NO: 44913 - protein, 16 aa, Homo sapiens
FSGQLNSHGCFYQQVK

SEQ ID NO: 44914 - protein, 18 aa, Homo sapiens
FSGQLNSHGCFYQQVKTK

SEQ ID NO: 44915 - protein, 23 aa, Homo sapiens
FSGQLNSHGCFYQQVKTKVFQLK

SEQ ID NO: 44916 - protein, 25 aa, Homo sapiens
FSGQLNSHGCFYQQVKTKVFQLKRK

SEQ ID NO: 44917 - protein, 29 aa, Homo sapiens
FSGQLNSHGCFYQQVKTKVFQLKRKEYEM

SEQ ID NO: 44918 - protein, 30 aa, Homo sapiens
FSGQLNSHGCFYQQVKTKVFQLKRKEYEMK

SEQ ID NO: 44919 - protein, 17 aa, Homo sapiens
FSINTTNVMGTSLTVRV

SEQ ID NO: 44920 - protein, 16 aa, Homo sapiens
FSSTQDTVVALHALSK

SEQ ID NO: 44921 - protein, 20 aa, Homo sapiens
FTDLEAENDVLHCVAFAVPK

SEQ ID NO: 44922 - protein, 10 aa, Homo sapiens
FTVLQDVPVR

SEQ ID NO: 44923 - protein, 26 aa, Homo sapiens
FTVSAEALESQELCGTEVPSVPEHGR

SEQ ID NO: 44924 - protein, 27 aa, Homo sapiens
FTVSAEALESQELCGTEVPSVPEHGRK

SEQ ID NO: 44925 - protein, 12 aa, Homo sapiens
FVELTMPYSVIR

SEQ ID NO: 44926 - protein, 9 aa, Homo sapiens
FVKVDSHFR

SEQ ID NO: 44927 - protein, 22 aa, Homo sapiens
GCVLLSYLNETVTVSASLESVR

SEQ ID NO: 44928 - protein, 10 aa, Homo sapiens
GDHGSHVYTK

SEQ ID NO: 44929 - protein, 7 aa, Homo sapiens
GEAFTLK

SEQ ID NO: 44930 - protein, 16 aa, Homo sapiens
GEAFTLKATVLNYLPK

SEQ ID NO: 44931 - protein, 17 aa, Homo sapiens
GFSSTQDTVVALHALSK

SEQ ID NO: 44932 - protein, 10 aa, Homo sapiens
GFYESDVMGR

SEQ ID NO: 44933 - protein, 11 aa, Homo sapiens
GGEVSEELSLK

SEQ ID NO: 44934 - protein, 18 aa, Homo sapiens
GGFSSTQDTVVALHALSK

SEQ ID NO: 44935 - protein, 14 aa, Homo sapiens
GGIVRTGTHGLLVK

SEQ ID NO: 44936 - protein, 12 aa, Homo sapiens
GGVEDEVTLSAY

SEQ ID NO: 44937 - protein, 30 aa, Homo sapiens
GGVEDEVTLSAYITIALLEIPLTVTHPVVR

SEQ ID NO: 44938 - protein, 10 aa, Homo sapiens
GHFSISIPVK

SEQ ID NO: 44939 - protein, 18 aa, Homo sapiens
GHFSISIPVKSDIAPVAR

SEQ ID NO: 44940 - protein, 36 aa, Homo sapiens
GHFSISIPVKSDIAPVARLLIYAVLPTGDVIGDSAK

SEQ ID NO: 44941 - protein, 9 aa, Homo sapiens
GIPFFGQVR

SEQ ID NO: 44942 - protein, 13 aa, Homo sapiens
GITYTPVSSTNEK

SEQ ID NO: 44943 - protein, 20 aa, Homo sapiens
GKPQYMVLVPSLLHTETTEK

SEQ ID NO: 44944 - protein, 14 aa, Homo sapiens
GKPVPGHVTVSICR

SEQ ID NO: 44945 - protein, 19 aa, Homo sapiens
GLYTYGKPVPGHVTVSICR

SEQ ID NO: 44946 - protein, 15 aa, Homo sapiens
GNEANYYSNATTDEH

SEQ ID NO: 44947 - protein, 20 aa, Homo sapiens
GNEANYYSNATTDEHGLVQF

SEQ ID NO: 44948 - protein, 35 aa, Homo sapiens
GNEANYYSNATTDEHGLVQFSINTTNVMGTSLTVR

SEQ ID NO: 44949 - protein, 31 aa, Homo sapiens
GNVNFTVSAEALESQELCGTEVPSVPEHGRK

SEQ ID NO: 44950 - protein, 7 aa, Homo sapiens
GPTQEFK

SEQ ID NO: 44951 - protein, 8 aa, Homo sapiens
GPTQEFKK

SEQ ID NO: 44952 - protein, 9 aa, Homo sapiens
GPTQEFKKR

SEQ ID NO: 44953 - protein, 14 aa, Homo sapiens
GQLNSHGCFYQQVK

SEQ ID NO: 44954 - protein, 17 aa, Homo sapiens
GVAEVGVTVPDTITEWK

SEQ ID NO: 44955 - protein, 7 aa, Homo sapiens
GVPIPNK

SEQ ID NO: 44956 - protein, 12 aa, Homo sapiens
GVPIPNKVIFIR

SEQ ID NO: 44957 - protein, 17 aa, Homo sapiens
GVPIPNKVIFIRGNEAN

SEQ ID NO: 44958 - protein, 24 aa, Homo sapiens
GYQWVSEEHEEAHHTAYLVFSPSK

SEQ ID NO: 44959 - protein, 16 aa, Homo sapiens
HEEAHHTAYLVFSPSK

SEQ ID NO: 44960 - protein, 17 aa, Homo sapiens
HFSISIPVKSDIAPVAR

SEQ ID NO: 44961 - protein, 9 aa, Homo sapiens
HGCFYQQVK

SEQ ID NO: 44962 - protein, 12 aa, Homo sapiens
HHTAYLVFSPSK

SEQ ID NO: 44963 - protein, 7 aa, Homo sapiens
HNVYING

SEQ ID NO: 44964 - protein, 17 aa, Homo sapiens
HNVYINGITYTPVSSTN

SEQ ID NO: 44965 - protein, 19 aa, Homo sapiens
HNVYINGITYTPVSSTNEK

SEQ ID NO: 44966 - protein, 31 aa, Homo sapiens
HNVYINGITYTPVSSTNEKDMYSFLEDMGLK

SEQ ID NO: 44967 - protein, 11 aa, Homo sapiens
HTAYLVFSPSK

SEQ ID NO: 44968 - protein, 7 aa, Homo sapiens
HTETTEK

SEQ ID NO: 44969 - protein, 20 aa, Homo sapiens
HTQTVQAHYILNGGTLLGLK

SEQ ID NO: 44970 - protein, 21 aa, Homo sapiens
HTQTVQAHYILNGGTLLGLKK

SEQ ID NO: 44971 - protein, 11 aa, Homo sapiens
HVEEPHTETVR

SEQ ID NO: 44972 - protein, 8 aa, Homo sapiens
HVLIYLDK

SEQ ID NO: 44973 - protein, 9 aa, Homo sapiens
HYDGSYSTF

SEQ ID NO: 44974 - protein, 12 aa, Homo sapiens
HYDGSYSTFGER

SEQ ID NO: 44975 - protein, 15 aa, Homo sapiens
HYDGSYSTFGERYGR

SEQ ID NO: 44976 - protein, 16 aa, Homo sapiens
IALLEIPLTVTHPVVR

SEQ ID NO: 44977 - protein, 14 aa, Homo sapiens
IAQWQSFQLEGGLK

SEQ ID NO: 44978 - protein, 16 aa, Homo sapiens
IAQWQSFQLEGGLKQF

SEQ ID NO: 44979 - protein, 30 aa, Homo sapiens
IAQWQSFQLEGGLKQFSFPLSSEPFQGSYK

SEQ ID NO: 44980 - protein, 35 aa, Homo sapiens
IAQWQSFQLEGGLKQFSFPLSSEPFQGSYKVVVQK

SEQ ID NO: 44981 - protein, 16 aa, Homo sapiens
IDEAHITQALIWLSQR

SEQ ID NO: 44982 - protein, 18 aa, Homo sapiens
IFIDEAHITQALIWLSQR

SEQ ID NO: 44983 - protein, 33 aa, Homo sapiens
IITILEEEMNVSVCGLYTYGKPVPGHVTVSICR

SEQ ID NO: 44984 - protein, 11 aa, Homo sapiens
ILNGGTLLGLK

SEQ ID NO: 44985 - protein, 15 aa, Homo sapiens
INGITYTPVSSTNEK

SEQ ID NO: 44986 - protein, 12 aa, Homo sapiens
IPVKSDIAPVAR

SEQ ID NO: 44987 - protein, 13 aa, Homo sapiens
IQEEGTVVELTGR

SEQ ID NO: 44988 - protein, 11 aa, Homo sapiens
ISLSVSYTGSR

SEQ ID NO: 44989 - protein, 18 aa, Homo sapiens
ITIALLEIPLTVTHPVVR

SEQ ID NO: 44990 - protein, 11 aa, Homo sapiens
ITQALIWLSQR

SEQ ID NO: 44991 - protein, 9 aa, Homo sapiens
KDNSVHWER

SEQ ID NO: 44992 - protein, 12 aa, Homo sapiens
KDNSVHWERPQK

SEQ ID NO: 44993 - protein, 14 aa, Homo sapiens
KDNSVHWERPQKPK

SEQ ID NO: 44994 - protein, 17 aa, Homo sapiens
KDTVIKPLLVEPEGLEK

SEQ ID NO: 44995 - protein, 24 aa, Homo sapiens
KGCVLLSYLNETVTVSASLESVRG

SEQ ID NO: 44996 - protein, 13 aa, Homo sapiens
KGVPIPNKVIFIR

SEQ ID NO: 44997 - protein, 35 aa, Homo sapiens
KIITILEEEMNVSVCGLYTYGKPVPGHVTVSICRK

SEQ ID NO: 44998 - protein, 11 aa, Homo sapiens
KLSFYYLIMAK

SEQ ID NO: 44999 - protein, 16 aa, Homo sapiens
KLSFYYLIMAKGGIVR

SEQ ID NO: 45000 - protein, 18 aa, Homo sapiens
KPDAELSASSVYNLLPEK

SEQ ID NO: 45001 - protein, 12 aa, Homo sapiens
KPLLVEPEGLEK

SEQ ID NO: 45002 - protein, 19 aa, Homo sapiens
KPQYMVLVPSLLHTETTEK

SEQ ID NO: 45003 - protein, 27 aa, Homo sapiens
KRKEYEMKLHTEAQIQEEGTVVELTGR

SEQ ID NO: 45004 - protein, 19 aa, Homo sapiens
KSGGRTEHPFTVEEFVLPK

SEQ ID NO: 45005 - protein, 33 aa, Homo sapiens
KSLGNVNFTVSAEALESQELCGTEVPSVPEHGR

SEQ ID NO: 45006 - protein, 34 aa, Homo sapiens
KSLGNVNFTVSAEALESQELCGTEVPSVPEHGRK

SEQ ID NO: 45007 - protein, 20 aa, Homo sapiens
KVDLSFSPSQSLPASHAHLR

SEQ ID NO: 45008 - protein, 21 aa, Homo sapiens
KVSNQTLSLFFTVLQDVPVRD

SEQ ID NO: 45009 - protein, 15 aa, Homo sapiens
KYFPETWIWDLVVVN

SEQ ID NO: 45010 - protein, 34 aa, Homo sapiens
KYFPETWIWDLVVVNSAGVAEVGVTVPDTITEWK

SEQ ID NO: 45011 - protein, 12 aa, Homo sapiens
KYSDASDCHGED

SEQ ID NO: 45012 - protein, 19 aa, Homo sapiens
KYSDASDCHGEDSQAFCEK

SEQ ID NO: 45013 - protein, 23 aa, Homo sapiens
LAYLTAQPAPTSEDLTSATNIVK

SEQ ID NO: 45014 - protein, 17 aa, Homo sapiens
LEAENDVLHCVAFAVPK

SEQ ID NO: 45015 - protein, 13 aa, Homo sapiens
LEIPLTVTHPVVR

SEQ ID NO: 45016 - protein, 20 aa, Homo sapiens
LESQELCGTEVPSVPEHGRK

SEQ ID NO: 45017 - protein, 12 aa, Homo sapiens
LFFTVLQDVPVR

SEQ ID NO: 45018 - protein, 19 aa, Homo sapiens
LHTEAQIQEEGTVVELTGR

SEQ ID NO: 45019 - protein, 11 aa, Homo sapiens
LIPLVYIQDPK

SEQ ID NO: 45020 - protein, 14 aa, Homo sapiens
LLEIPLTVTHPVVR

SEQ ID NO: 45021 - protein, 15 aa, Homo sapiens
LLIYAVLPTGDVIGD

SEQ ID NO: 45022 - protein, 18 aa, Homo sapiens
LLIYAVLPTGDVIGDSAK

SEQ ID NO: 45023 - protein, 15 aa, Homo sapiens
LLLQQVSLPELPGEY

SEQ ID NO: 45024 - protein, 18 aa, Homo sapiens
LLLQQVSLPELPGEYSMK

SEQ ID NO: 45025 - protein, 21 aa, Homo sapiens
LLMKPDAELSASSVYNLLPEK

SEQ ID NO: 45026 - protein, 11 aa, Homo sapiens
LPPNVVEESAR

SEQ ID NO: 45027 - protein, 12 aa, Homo sapiens
LPTGDVIGDSAK

SEQ ID NO: 45028 - protein, 13 aa, Homo sapiens
LQQYEMHGPEGLR

SEQ ID NO: 45029 - protein, 16 aa, Homo sapiens
LSEDAGLGISSTASLR

SEQ ID NO: 45030 - protein, 17 aa, Homo sapiens
LSFSPSQSLPASHAHLR

SEQ ID NO: 45031 - protein, 11 aa, Homo sapiens
LSFVKVDSHFR

SEQ ID NO: 45032 - protein, 21 aa, Homo sapiens
LSFVKVDSHFRQGIPFFGQVR

SEQ ID NO: 45033 - protein, 10 aa, Homo sapiens
LSFYYLIMAK

SEQ ID NO: 45034 - protein, 14 aa, Homo sapiens
LSLFFTVLQDVPVR

SEQ ID NO: 45035 - protein, 20 aa, Homo sapiens
LTAQPAPTSEDLTSATNIVK

SEQ ID NO: 45036 - protein, 12 aa, Homo sapiens
LVDGKGVPIPNK

SEQ ID NO: 45037 - protein, 17 aa, Homo sapiens
LVDGKGVPIPNKVIFIR

SEQ ID NO: 45038 - protein, 9 aa, Homo sapiens
LVEPEGLEK

SEQ ID NO: 45039 - protein, 13 aa, Homo sapiens
LVHVEEPHTETVR

SEQ ID NO: 45040 - protein, 14 aa, Homo sapiens
LVHVEEPHTETVRK

SEQ ID NO: 45041 - protein, 13 aa, Homo sapiens
LVPSLLHTETTEK

SEQ ID NO: 45042 - protein, 18 aa, Homo sapiens
LYTYGKPVPGHVTVSICR

SEQ ID NO: 45043 - protein, 20 aa, Homo sapiens
MAIVDVKMVSGFIPLKPTVK

SEQ ID NO: 45044 - protein, 12 aa, Homo sapiens
MCPQLQQYEMHG

SEQ ID NO: 45045 - protein, 15 aa, Homo sapiens
MCPQLQQYEMHGPEG

SEQ ID NO: 45046 - protein, 17 aa, Homo sapiens
MCPQLQQYEMHGPEGLR

SEQ ID NO: 45047 - protein, 28 aa, Homo sapiens
MCPQLQQYEMHGPEGLRVGFYESDVMGR

SEQ ID NO: 45048 - protein, 32 aa, Homo sapiens
MCPQLQQYEMHGPEGLRVGFYESDVMGRGHAR

SEQ ID NO: 45049 - protein, 21 aa, Homo sapiens
MDENFHPLNELIPLVYIQDPK

SEQ ID NO: 45050 - protein, 19 aa, Homo sapiens
MKPDAELSASSVYNLLPEK

SEQ ID NO: 45051 - protein, 29 aa, Homo sapiens
MTSYVLLAYLTAQPAPTSEDLTSATNIVK

SEQ ID NO: 45052 - protein, 15 aa, Homo sapiens
MVLVPSLLHTETTEK

SEQ ID NO: 45053 - protein, 11 aa, Homo sapiens
MVSGFIPLKPT

SEQ ID NO: 45054 - protein, 13 aa, Homo sapiens
MVSGFIPLKPTVK

SEQ ID NO: 45055 - protein, 11 aa, Homo sapiens
NALFCLESAWK

SEQ ID NO: 45056 - protein, 6 aa, Homo sapiens
NEDSLV

SEQ ID NO: 45057 - protein, 12 aa, Homo sapiens
NEDSLVFVQTDK

SEQ ID NO: 45058 - protein, 22 aa, Homo sapiens
NEDSLVFVQTDKSIYKPGQTVK

SEQ ID NO: 45059 - protein, 27 aa, Homo sapiens
NFTVSAEALESQELCGTEVPSVPEHGR

SEQ ID NO: 45060 - protein, 28 aa, Homo sapiens
NFTVSAEALESQELCGTEVPSVPEHGRK

SEQ ID NO: 45061 - protein, 10 aa, Homo sapiens
NQGNTWLTAF

SEQ ID NO: 45062 - protein, 13 aa, Homo sapiens
NQGNTWLTAFVLK

SEQ ID NO: 45063 - protein, 19 aa, Homo sapiens
NQGNTWLTAFVLKTFAQAR

SEQ ID NO: 45064 - protein, 39 aa, Homo sapiens
NQGNTWLTAFVLKTFAQARAYIFIDEAHITQALIWLSQR

SEQ ID NO: 45065 - protein, 10 aa, Homo sapiens
PAFLAVPVEK

SEQ ID NO: 45066 - protein, 16 aa, Homo sapiens
PAPTSEDLTSATNIVK

SEQ ID NO: 45067 - protein, 8 aa, Homo sapiens
PASHAHLR

SEQ ID NO: 45068 - protein, 23 aa, Homo sapiens
PCGHTQTVQAHYILNGGTLLGLK

SEQ ID NO: 45069 - protein, 17 aa, Homo sapiens
PDAELSASSVYNLLPEK

SEQ ID NO: 45070 - protein, 23 aa, Homo sapiens
PEKDLTGFPGPLNDQDDEDCINR

SEQ ID NO: 45071 - protein, 10 aa, Homo sapiens
PELPGEYSMK

SEQ ID NO: 45072 - protein, 14 aa, Homo sapiens
PFFVELTMPYSVIR

SEQ ID NO: 45073 - protein, 21 aa, Homo sapiens
PFFVELTMPYSVIRGEAFTLK

SEQ ID NO: 45074 - protein, 22 aa, Homo sapiens
PFFVELTMPYSVIRGEAFTLKA

SEQ ID NO: 45075 - protein, 10 aa, Homo sapiens
PGHVTVSICR

SEQ ID NO: 45076 - protein, 15 aa, Homo sapiens
PGPLNDQDDEDCINR

SEQ ID NO: 45077 - protein, 7 aa, Homo sapiens
PHTETVR

SEQ ID NO: 45078 - protein, 10 aa, Homo sapiens
PIPNKVIFIR

SEQ ID NO: 45079 - protein, 11 aa, Homo sapiens
PLLVEPEGLEK

SEQ ID NO: 45080 - protein, 12 aa, Homo sapiens
PLSSEPFQGSYK

SEQ ID NO: 45081 - protein, 10 aa, Homo sapiens
PLTVTHPVVR

SEQ ID NO: 45082 - protein, 9 aa, Homo sapiens
PLVYIQDPK

SEQ ID NO: 45083 - protein, 8 aa, Homo sapiens
PNKVIFIR

SEQ ID NO: 45084 - protein, 9 aa, Homo sapiens
PNVVEESAR

SEQ ID NO: 45085 - protein, 10 aa, Homo sapiens
PPNVVEESAR

SEQ ID NO: 45086 - protein, 15 aa, Homo sapiens
PQLQQYEMHGPEGLR

SEQ ID NO: 45087 - protein, 18 aa, Homo sapiens
PQYMVLVPSLLHTETTEK

SEQ ID NO: 45088 - protein, 13 aa, Homo sapiens
PSGGEVSEELSLK

SEQ ID NO: 45089 - protein, 11 aa, Homo sapiens
PSLLHTETTEK

SEQ ID NO: 45090 - protein, 13 aa, Homo sapiens
PSQSLPASHAHLR

SEQ ID NO: 45091 - protein, 11 aa, Homo sapiens
PTGDVIGDSAK

SEQ ID NO: 45092 - protein, 14 aa, Homo sapiens
PTSEDLTSATNIVK

SEQ ID NO: 45093 - protein, 11 aa, Homo sapiens
PVKSDIAPVAR

SEQ ID NO: 45094 - protein, 12 aa, Homo sapiens
PVPGHVTVSICR

SEQ ID NO: 45095 - protein, 20 aa, Homo sapiens
PVSSTNEKDMYSFLEDMGLK

SEQ ID NO: 45096 - protein, 15 aa, Homo sapiens
QAHYILNGGTLLGLK

SEQ ID NO: 45097 - protein, 9 aa, Homo sapiens
QALIWLSQR

SEQ ID NO: 45098 - protein, 15 aa, Homo sapiens
QEDMKGHFSISIPVK

SEQ ID NO: 45099 - protein, 23 aa, Homo sapiens
QEDMKGHFSISIPVKSDIAPVAR

SEQ ID NO: 45100 - protein, 12 aa, Homo sapiens
QEGDHGSHVYTK

SEQ ID NO: 45101 - protein, 11 aa, Homo sapiens
QFSFPLSSEPF

SEQ ID NO: 45102 - protein, 15 aa, Homo sapiens
QFSFPLSSEPFQGSY

SEQ ID NO: 45103 - protein, 16 aa, Homo sapiens
QFSFPLSSEPFQGSYK

SEQ ID NO: 45104 - protein, 21 aa, Homo sapiens
QFSFPLSSEPFQGSYKVVVQK

SEQ ID NO: 45105 - protein, 10 aa, Homo sapiens
QGIPFFGQVR

SEQ ID NO: 45106 - protein, 12 aa, Homo sapiens
QISLSVSYTGSR

SEQ ID NO: 45107 - protein, 8 aa, Homo sapiens
QKDNGCFR

SEQ ID NO: 45108 - protein, 17 aa, Homo sapiens
QLNYKHYDGSYSTFGER

SEQ ID NO: 45109 - protein, 20 aa, Homo sapiens
QLNYKHYDGSYSTFGERYGR

SEQ ID NO: 45110 - protein, 14 aa, Homo sapiens
QLQQYEMHGPEGLR

SEQ ID NO: 45111 - protein, 17 aa, Homo sapiens
QPAPTSEDLTSATNIVK

SEQ ID NO: 45112 - protein, 15 aa, Homo sapiens
QPFFVELTMPYSVIR

SEQ ID NO: 45113 - protein, 18 aa, Homo sapiens
QQNAQGGFSSTQDTVVAL

SEQ ID NO: 45114 - protein, 19 aa, Homo sapiens
QQNAQGGFSSTQDTVVALH

SEQ ID NO: 45115 - protein, 21 aa, Homo sapiens
QQNAQGGFSSTQDTVVALHAL

SEQ ID NO: 45116 - protein, 23 aa, Homo sapiens
QQNAQGGFSSTQDTVVALHALSK

SEQ ID NO: 45117 - protein, 31 aa, Homo sapiens
QQNAQGGFSSTQDTVVALHALSKYGAATFTR

SEQ ID NO: 45118 - protein, 7 aa, Homo sapiens
QSSEITR

SEQ ID NO: 45119 - protein, 10 aa, Homo sapiens
QTVSWAVTPK

SEQ ID NO: 45120 - protein, 22 aa, Homo sapiens
QWVSEEHEEAHHTAYLVFSPSK

SEQ ID NO: 45121 - protein, 37 aa, Homo sapiens
RGNEANYYSNATTDEHGLVQFSINTTNVMGTSLTVRV

SEQ ID NO: 45122 - protein, 27 aa, Homo sapiens
RGNRSLFTDLEAENDVLHCVAFAVPKS

SEQ ID NO: 45123 - protein, 23 aa, Homo sapiens
RSLFTDLEAENDVLHCVAFAVPK

SEQ ID NO: 45124 - protein, 12 aa, Homo sapiens
RVGFYESDVMGR

SEQ ID NO: 45125 - protein, 23 aa, Homo sapiens
SAEALESQELCGTEVPSVPEHGR

SEQ ID NO: 45126 - protein, 24 aa, Homo sapiens
SAEALESQELCGTEVPSVPEHGRK

SEQ ID NO: 45127 - protein, 19 aa, Homo sapiens
SAGVAEVGVTVPDTITEWK

SEQ ID NO: 45128 - protein, 11 aa, Homo sapiens
SASNMAIVDVK

SEQ ID NO: 45129 - protein, 24 aa, Homo sapiens
SASNMAIVDVKMVSGFIPLKPTVK

SEQ ID NO: 45130 - protein, 32 aa, Homo sapiens
SASSVYNLLPEKDLTGFPGPLNDQDDEDCINR

SEQ ID NO: 45131 - protein, 17 aa, Homo sapiens
SDASDCHGEDSQAFCEK

SEQ ID NO: 45132 - protein, 8 aa, Homo sapiens
SDIAPVAR

SEQ ID NO: 45133 - protein, 15 aa, Homo sapiens
SEDAGLGISSTASLR

SEQ ID NO: 45134 - protein, 19 aa, Homo sapiens
SEEHEEAHHTAYLVFSPSK

SEQ ID NO: 45135 - protein, 14 aa, Homo sapiens
SFPLSSEPFQGSYK

SEQ ID NO: 45136 - protein, 16 aa, Homo sapiens
SFSPSQSLPASHAHLR

SEQ ID NO: 45137 - protein, 8 aa, Homo sapiens
SFVHLEPM

SEQ ID NO: 45138 - protein, 10 aa, Homo sapiens
SFVHLEPMSH

SEQ ID NO: 45139 - protein, 14 aa, Homo sapiens
SFVHLEPMSHELPC

SEQ ID NO: 45140 - protein, 16 aa, Homo sapiens
SFVHLEPMSHELPCGH

SEQ ID NO: 45141 - protein, 23 aa, Homo sapiens
SFVHLEPMSHELPCGHTQTVQAH

SEQ ID NO: 45142 - protein, 24 aa, Homo sapiens
SFVHLEPMSHELPCGHTQTVQAHY

SEQ ID NO: 45143 - protein, 29 aa, Homo sapiens
SFVHLEPMSHELPCGHTQTVQAHYILNGG

SEQ ID NO: 45144 - protein, 32 aa, Homo sapiens
SFVHLEPMSHELPCGHTQTVQAHYILNGGTLL

SEQ ID NO: 45145 - protein, 35 aa, Homo sapiens
SFVHLEPMSHELPCGHTQTVQAHYILNGGTLLGLK

SEQ ID NO: 45146 - protein, 10 aa, Homo sapiens
SFVKVDSHFR

SEQ ID NO: 45147 - protein, 11 aa, Homo sapiens
SGFIPLKPTVK

SEQ ID NO: 45148 - protein, 18 aa, Homo sapiens
SGGRTEHPFTVEEFVLPK

SEQ ID NO: 45149 - protein, 27 aa, Homo sapiens
SGGRTEHPFTVEEFVLPKFEVQVTVPK

SEQ ID NO: 45150 - protein, 21 aa, Homo sapiens
SGKPQYMVLVPSLLHTETTEK

SEQ ID NO: 45151 - protein, 15 aa, Homo sapiens
SGQLNSHGCFYQQVK

SEQ ID NO: 45152 - protein, 27 aa, Homo sapiens
SHELPCGHTQTVQAHYILNGGTLLGLK

SEQ ID NO: 45153 - protein, 10 aa, Homo sapiens
SHGCFYQQVK

SEQ ID NO: 45154 - protein, 15 aa, Homo sapiens
SINTTNVMGTSLTVR

SEQ ID NO: 45155 - protein, 10 aa, Homo sapiens
SIYKPGQTVK

SEQ ID NO: 45156 - protein, 12 aa, Homo sapiens
SIYKPGQTVKFR

SEQ ID NO: 45157 - protein, 13 aa, Homo sapiens
SKAIGYLNTGYQR

SEQ ID NO: 45158 - protein, 13 aa, Homo sapiens
SLFFTVLQDVPVR

SEQ ID NO: 45159 - protein, 14 aa, Homo sapiens
SLFTDLEAENDVLH

SEQ ID NO: 45160 - protein, 15 aa, Homo sapiens
SLFTDLEAENDVLHC

SEQ ID NO: 45161 - protein, 17 aa, Homo sapiens
SLFTDLEAENDVLHCVA

SEQ ID NO: 45162 - protein, 18 aa, Homo sapiens
SLFTDLEAENDVLHCVAF

SEQ ID NO: 45163 - protein, 22 aa, Homo sapiens
SLFTDLEAENDVLHCVAFAVPK

SEQ ID NO: 45164 - protein, 32 aa, Homo sapiens
SLGNVNFTVSAEALESQELCGTEVPSVPEHGR

SEQ ID NO: 45165 - protein, 33 aa, Homo sapiens
SLGNVNFTVSAEALESQELCGTEVPSVPEHGRK

SEQ ID NO: 45166 - protein, 17 aa, Homo sapiens
SLLCPSGGEVSEELSLK

SEQ ID NO: 45167 - protein, 8 aa, Homo sapiens
SLNEEAVK

SEQ ID NO: 45168 - protein, 9 aa, Homo sapiens
SLNEEAVKK

SEQ ID NO: 45169 - protein, 22 aa, Homo sapiens
SLNEEAVKKDNSVHWERPQKPK

SEQ ID NO: 45170 - protein, 10 aa, Homo sapiens
SLPASHAHLR

SEQ ID NO: 45171 - protein, 9 aa, Homo sapiens
SLVFVQTDK

SEQ ID NO: 45172 - protein, 22 aa, Homo sapiens
SMDENFHPLNELIPLVYIQDPK

SEQ ID NO: 45173 - protein, 25 aa, Homo sapiens
SMDENFHPLNELIPLVYIQDPKGNR

SEQ ID NO: 45174 - protein, 28 aa, Homo sapiens
SNATTDEHGLVQFSINTTNVMGTSLTVR

SEQ ID NO: 45175 - protein, 9 aa, Homo sapiens
SNMAIVDVK

SEQ ID NO: 45176 - protein, 11 aa, Homo sapiens
SPAFLAVPVEK

SEQ ID NO: 45177 - protein, 21 aa, Homo sapiens
SPCYGYQWVSEEHEEAHHTAY

SEQ ID NO: 45178 - protein, 22 aa, Homo sapiens
SPCYGYQWVSEEHEEAHHTAYL

SEQ ID NO: 45179 - protein, 28 aa, Homo sapiens
SPCYGYQWVSEEHEEAHHTAYLVFSPSK

SEQ ID NO: 45180 - protein, 14 aa, Homo sapiens
SPSQSLPASHAHLR

SEQ ID NO: 45181 - protein, 17 aa, Homo sapiens
SQELCGTEVPSVPEHGR

SEQ ID NO: 45182 - protein, 10 aa, Homo sapiens
SSEPFQGSYK

SEQ ID NO: 45183 - protein, 11 aa, Homo sapiens
SSGSLLNNAIK

SEQ ID NO: 45184 - protein, 41 aa, Homo sapiens
SSGSLLNNAIKGGVEDEVTLSAYITIALLEIPLTVTHPVVR

SEQ ID NO: 45185 - protein, 11 aa, Homo sapiens
SSNHVLIYLDK

SEQ ID NO: 45186 - protein, 15 aa, Homo sapiens
SSSNEEVMFLTVQVK

SEQ ID NO: 45187 - protein, 22 aa, Homo sapiens
SSSNEEVMFLTVQVKGPTQEFK

SEQ ID NO: 45188 - protein, 15 aa, Homo sapiens
SSTQDTVVALHALSK

SEQ ID NO: 45189 - protein, 11 aa, Homo sapiens
SVHWERPQKPK

SEQ ID NO: 45190 - protein, 24 aa, Homo sapiens
SVPEHGRKDTVIKPLLVEPEGLEK

SEQ ID NO: 45191 - protein, 23 aa, Homo sapiens
SVSGKPQYMVLVPSLLHTETTEK

SEQ ID NO: 45192 - protein, 12 aa, Homo sapiens
TAQEGDHGSHVY

SEQ ID NO: 45193 - protein, 13 aa, Homo sapiens
TAQEGDHGSHVYT

SEQ ID NO: 45194 - protein, 14 aa, Homo sapiens
TAQEGDHGSHVYTK

SEQ ID NO: 45195 - protein, 29 aa, Homo sapiens
TAQEGDHGSHVYTKALLAYAFALAGNQDK

SEQ ID NO: 45196 - protein, 19 aa, Homo sapiens
TAQPAPTSEDLTSATNIVK

SEQ ID NO: 45197 - protein, 10 aa, Homo sapiens
TAYLVFSPSK

SEQ ID NO: 45198 - protein, 19 aa, Homo sapiens
TDLEAENDVLHCVAFAVPK

SEQ ID NO: 45199 - protein, 17 aa, Homo sapiens
TEAQIQEEGTVVELTGR

SEQ ID NO: 45200 - protein, 10 aa, Homo sapiens
TEHPFTVEEF

SEQ ID NO: 45201 - protein, 14 aa, Homo sapiens
TEHPFTVEEFVLPK

SEQ ID NO: 45202 - protein, 23 aa, Homo sapiens
TEHPFTVEEFVLPKFEVQVTVPK

SEQ ID NO: 45203 - protein, 11 aa, Homo sapiens
TEVPSVPEHGR

SEQ ID NO: 45204 - protein, 14 aa, Homo sapiens
TEVSSNHVLIYLDK

SEQ ID NO: 45205 - protein, 33 aa, Homo sapiens
TEVSSNHVLIYLDKVSNQTLSLFFTVLQDVPVR

SEQ ID NO: 45206 - protein, 6 aa, Homo sapiens
TFAQAR

SEQ ID NO: 45207 - protein, 18 aa, Homo sapiens
TGFPGPLNDQDDEDCINR

SEQ ID NO: 45208 - protein, 18 aa, Homo sapiens
TGKAAQVTIQSSGTFSSK

SEQ ID NO: 45209 - protein, 26 aa, Homo sapiens
TGKAAQVTIQSSGTFSSKFQVDNNNR

SEQ ID NO: 45210 - protein, 9 aa, Homo sapiens
TGTHGLLVK

SEQ ID NO: 45211 - protein, 14 aa, Homo sapiens
TGTHGLLVKQEDMK

SEQ ID NO: 45212 - protein, 24 aa, Homo sapiens
TGTHGLLVKQEDMKGHFSISIPVK

SEQ ID NO: 45213 - protein, 32 aa, Homo sapiens
TGTHGLLVKQEDMKGHFSISIPVKSDIAPVAR

SEQ ID NO: 45214 - protein, 9 aa, Homo sapiens
TITKLSFVK

SEQ ID NO: 45215 - protein, 15 aa, Homo sapiens
TITKLSFVKVDSHFR

SEQ ID NO: 45216 - protein, 24 aa, Homo sapiens
TITKLSFVKVDSHFRQGIPFFGQV

SEQ ID NO: 45217 - protein, 25 aa, Homo sapiens
TITKLSFVKVDSHFRQGIPFFGQVR

SEQ ID NO: 45218 - protein, 30 aa, Homo sapiens
TITKLSFVKVDSHFRQGIPFFGQVRLVDGK

SEQ ID NO: 45219 - protein, 13 aa, Homo sapiens
TKLSFVKVDSHFR

SEQ ID NO: 45220 - protein, 23 aa, Homo sapiens
TKLSFVKVDSHFRQGIPFFGQVR

SEQ ID NO: 45221 - protein, 7 aa, Homo sapiens
TKVFQLK

SEQ ID NO: 45222 - protein, 15 aa, Homo sapiens
TLSLFFTVLQDVPVR

SEQ ID NO: 45223 - protein, 19 aa, Homo sapiens
TQTVQAHYILNGGTLLGLK

SEQ ID NO: 45224 - protein, 20 aa, Homo sapiens
TQTVQAHYILNGGTLLGLKK

SEQ ID NO: 45225 - protein, 12 aa, Homo sapiens
TTNVMGTSLTVR

SEQ ID NO: 45226 - protein, 6 aa, Homo sapiens
TTVMVK

SEQ ID NO: 45227 - protein, 18 aa, Homo sapiens
TTVMVKNEDSLVFVQTDK

SEQ ID NO: 45228 - protein, 28 aa, Homo sapiens
TTVMVKNEDSLVFVQTDKSIYKPGQTVK

SEQ ID NO: 45229 - protein, 9 aa, Homo sapiens
TVEEFVLPK

SEQ ID NO: 45230 - protein, 15 aa, Homo sapiens
TVIKPLLVEPEGLEK

SEQ ID NO: 45231 - protein, 8 aa, Homo sapiens
TVLNYLPK

SEQ ID NO: 45232 - protein, 9 aa, Homo sapiens
TVLQDVPVR

SEQ ID NO: 45233 - protein, 17 aa, Homo sapiens
TVQAHYILNGGTLLGLK

SEQ ID NO: 45234 - protein, 25 aa, Homo sapiens
TVSAEALESQELCGTEVPSVPEHGR

SEQ ID NO: 45235 - protein, 10 aa, Homo sapiens
TVVALHALSK

SEQ ID NO: 45236 - protein, 16 aa, Homo sapiens
TYGKPVPGHVTVSICR

SEQ ID NO: 45237 - protein, 10 aa, Homo sapiens
VDLSFSPSQS

SEQ ID NO: 45238 - protein, 13 aa, Homo sapiens
VDLSFSPSQSLPA

SEQ ID NO: 45239 - protein, 15 aa, Homo sapiens
VDLSFSPSQSLPASH

SEQ ID NO: 45240 - protein, 17 aa, Homo sapiens
VDLSFSPSQSLPASHAH

SEQ ID NO: 45241 - protein, 19 aa, Homo sapiens
VDLSFSPSQSLPASHAHLR

SEQ ID NO: 45242 - protein, 6 aa, Homo sapiens
VDSHFR

SEQ ID NO: 45243 - protein, 16 aa, Homo sapiens
VDSHFRQGIPFFGQVR

SEQ ID NO: 45244 - protein, 21 aa, Homo sapiens
VEDEVTLSAYITIALLEIPLT

SEQ ID NO: 45245 - protein, 10 aa, Homo sapiens
VEEPHTETVR

SEQ ID NO: 45246 - protein, 18 aa, Homo sapiens
VELTMPYSVIRGEAFTLK

SEQ ID NO: 45247 - protein, 11 aa, Homo sapiens
VGFYESDVMGR

SEQ ID NO: 45248 - protein, 15 aa, Homo sapiens
VGFYESDVMGRGHAR

SEQ ID NO: 45249 - protein, 12 aa, Homo sapiens
VHVEEPHTETVR

SEQ ID NO: 45250 - protein, 14 aa, Homo sapiens
VIKPLLVEPEGLEK

SEQ ID NO: 45251 - protein, 25 aa, Homo sapiens
VLLAYLTAQPAPTSEDLTSATNIVK

SEQ ID NO: 45252 - protein, 7 aa, Homo sapiens
VLNYLPK

SEQ ID NO: 45253 - protein, 13 aa, Homo sapiens
VLPTGDVIGDSAK

SEQ ID NO: 45254 - protein, 8 aa, Homo sapiens
VLQDVPVR

SEQ ID NO: 45255 - protein, 14 aa, Homo sapiens
VLVPSLLHTETTEK

SEQ ID NO: 45256 - protein, 16 aa, Homo sapiens
VMFLTVQVKGPTQEFK

SEQ ID NO: 45257 - protein, 9 aa, Homo sapiens
VMGTSLTVR

SEQ ID NO: 45258 - protein, 28 aa, Homo sapiens
VNFTVSAEALESQELCGTEVPSVPEHGR

SEQ ID NO: 45259 - protein, 12 aa, Homo sapiens
VPSLLHTETTEK

SEQ ID NO: 45260 - protein, 11 aa, Homo sapiens
VPSVPEHGRKD

SEQ ID NO: 45261 - protein, 20 aa, Homo sapiens
VSEEHEEAHHTAYLVFSPSK

SEQ ID NO: 45262 - protein, 22 aa, Homo sapiens
VSGKPQYMVLVPSLLHTETTEK

SEQ ID NO: 45263 - protein, 10 aa, Homo sapiens
VSNQTLSLFF

SEQ ID NO: 45264 - protein, 19 aa, Homo sapiens
VSNQTLSLFFTVLQDVPVR

SEQ ID NO: 45265 - protein, 27 aa, Homo sapiens
VSNQTLSLFFTVLQDVPVRDLKPAIVK

SEQ ID NO: 45266 - protein, 12 aa, Homo sapiens
VSSNHVLIYLDK

SEQ ID NO: 45267 - protein, 11 aa, Homo sapiens
VSVQLEASPAF

SEQ ID NO: 45268 - protein, 18 aa, Homo sapiens
VSVQLEASPAFLAVPVEK

SEQ ID NO: 45269 - protein, 30 aa, Homo sapiens
VSVQLEASPAFLAVPVEKEQAPHCICANGR

SEQ ID NO: 45270 - protein, 12 aa, Homo sapiens
VTAAPQSVCALR

SEQ ID NO: 45271 - protein, 14 aa, Homo sapiens
VTGEGCVYLQTSLK

SEQ ID NO: 45272 - protein, 12 aa, Homo sapiens
VVSMDENFHPLN

SEQ ID NO: 45273 - protein, 17 aa, Homo sapiens
VVSMDENFHPLNELIPL

SEQ ID NO: 45274 - protein, 19 aa, Homo sapiens
VVSMDENFHPLNELIPLVY

SEQ ID NO: 45275 - protein, 24 aa, Homo sapiens
VVSMDENFHPLNELIPLVYIQDPK

SEQ ID NO: 45276 - protein, 27 aa, Homo sapiens
VVSMDENFHPLNELIPLVYIQDPKGNR

SEQ ID NO: 45277 - protein, 19 aa, Homo sapiens
VYDYYETDEFAIAEYNAPC

SEQ ID NO: 45278 - protein, 21 aa, Homo sapiens
VYDYYETDEFAIAEYNAPCSK

SEQ ID NO: 45279 - protein, 17 aa, Homo sapiens
VYINGITYTPVSSTNEK

SEQ ID NO: 45280 - protein, 27 aa, Homo sapiens
WITKQQNAQGGFSSTQDTVVALHALSK

SEQ ID NO: 45281 - protein, 21 aa, Homo sapiens
WVSEEHEEAHHTAYLVFSPSK

SEQ ID NO: 45282 - protein, 10 aa, Homo sapiens
YDVENCLANK

SEQ ID NO: 45283 - protein, 19 aa, Homo sapiens
YDVENCLANKVDLSFSPSQ

SEQ ID NO: 45284 - protein, 29 aa, Homo sapiens
YDVENCLANKVDLSFSPSQSLPASHAHLR

SEQ ID NO: 45285 - protein, 8 aa, Homo sapiens
YESDVMGR

SEQ ID NO: 45286 - protein, 12 aa, Homo sapiens
YESDVMGRGHAR

SEQ ID NO: 45287 - protein, 14 aa, Homo sapiens
YFPETWIWDLVVVN

SEQ ID NO: 45288 - protein, 33 aa, Homo sapiens
YFPETWIWDLVVVNSAGVAEVGVTVPDTITEWK

SEQ ID NO: 45289 - protein, 8 aa, Homo sapiens
YGAATFTR

SEQ ID NO: 45290 - protein, 11 aa, Homo sapiens
YGAATFTRTGK

SEQ ID NO: 45291 - protein, 25 aa, Homo sapiens
YGYQWVSEEHEEAHHTAYLVFSPSK

SEQ ID NO: 45292 - protein, 12 aa, Homo sapiens
YILNGGTLLGLK

SEQ ID NO: 45293 - protein, 19 aa, Homo sapiens
YITIALLEIPLTVTHPVVR

SEQ ID NO: 45294 - protein, 21 aa, Homo sapiens
YLTAQPAPTSEDLTSATNIVK

SEQ ID NO: 45295 - protein, 16 aa, Homo sapiens
YMVLVPSLLHTETTEK

SEQ ID NO: 45296 - protein, 7 aa, Homo sapiens
YNILPEK

SEQ ID NO: 45297 - protein, 15 aa, Homo sapiens
YNILPEKEEFPFALG

SEQ ID NO: 45298 - protein, 17 aa, Homo sapiens
YNILPEKEEFPFALGVQ

SEQ ID NO: 45299 - protein, 19 aa, Homo sapiens
YNILPEKEEFPFALGVQTL

SEQ ID NO: 45300 - protein, 21 aa, Homo sapiens
YNILPEKEEFPFALGVQTLPQ

SEQ ID NO: 45301 - protein, 23 aa, Homo sapiens
YNILPEKEEFPFALGVQTLPQTC

SEQ ID NO: 45302 - protein, 24 aa, Homo sapiens
YNILPEKEEFPFALGVQTLPQTCD

SEQ ID NO: 45303 - protein, 27 aa, Homo sapiens
YNILPEKEEFPFALGVQTLPQTCDEPK

SEQ ID NO: 45304 - protein, 28 aa, Homo sapiens
YNILPEKEEFPFALGVQTLPQTCDEPKA

SEQ ID NO: 45305 - protein, 7 aa, Homo sapiens
YNLLPEK

SEQ ID NO: 45306 - protein, 18 aa, Homo sapiens
YSDASDCHGEDSQAFCEK

SEQ ID NO: 45307 - protein, 10 aa, Homo sapiens
YSFLEDMGLK

SEQ ID NO: 45308 - protein, 29 aa, Homo sapiens
YSNATTDEHGLVQFSINTTNVMGTSLTVR

SEQ ID NO: 45309 - protein, 30 aa, Homo sapiens
YYSNATTDEHGLVQFSINTTNVMGTSLTVR

SEQ ID NO: 45310 - protein, 34 aa, Homo sapiens
RQNIAIEVDAFGTRNGTDDPSYNGAIIVSGDEKD

SEQ ID NO: 45311 - protein, 19 aa, Homo sapiens
KMDTELAESGSNFSVGQRQ

SEQ ID NO: 45312 - protein, 27 aa, Homo sapiens
RRGDNDSHQGDLEPILEASVLSSHHKK

SEQ ID NO: 45313 - protein, 25 aa, Homo sapiens
ADIDVSGPKVDVDVPDVNIEGPDAK

SEQ ID NO: 45314 - protein, 25 aa, Homo sapiens
ADIDVSGPSVDTDAPDLDIEGPEGK

SEQ ID NO: 45315 - protein, 9 aa, Homo sapiens
ADVVVSGPK

SEQ ID NO: 45316 - protein, 12 aa, Homo sapiens
AEGPEVDVNLPK

SEQ ID NO: 45317 - protein, 16 aa, Homo sapiens
APDVDVNIAGPDAALK

SEQ ID NO: 45318 - protein, 17 aa, Homo sapiens
DDGVFVQEVTQNSPAAR

SEQ ID NO: 45319 - protein, 25 aa, Homo sapiens
EFSGPSTPTGTLEFEGGEVSLEGGK

SEQ ID NO: 45320 - protein, 35 aa, Homo sapiens
EGDQIVGATIYFDNLQSGEVTQLLNTMGHHTVGLK

SEQ ID NO: 45321 - protein, 20 aa, Homo sapiens
ELLLPNWQGSGSHGLTIAQR

SEQ ID NO: 45322 - protein, 11 aa, Homo sapiens
FAGGLHFSGPK

SEQ ID NO: 45323 - protein, 19 aa, Homo sapiens
FSMPGFKGEGPDGDVKLPK

SEQ ID NO: 45324 - protein, 41 aa, Homo sapiens
GAKPQGHIGVDASAPQIGGSITGPSVEVQAPDIDVQGPGSK

SEQ ID NO: 45325 - protein, 21 aa, Homo sapiens
GDVPSVGLEGPDVDLQGPEAK

SEQ ID NO: 45326 - protein, 37 aa, Homo sapiens
GEETGIDVTLPTGEVTVPGVSGDVSLPEIATGGLEGK

SEQ ID NO: 45327 - protein, 12 aa, Homo sapiens
GEGPDVDVNLPK

SEQ ID NO: 45328 - protein, 12 aa, Homo sapiens
GEGPEVDVNLPK

SEQ ID NO: 45329 - protein, 24 aa, Homo sapiens
GGADVSGGVSAPDISLGEGHLSVK

SEQ ID NO: 45330 - protein, 28 aa, Homo sapiens
GGKPGLTIQAPQLEVSVPSANIEGLEGK

SEQ ID NO: 45331 - protein, 26 aa, Homo sapiens
GGQIGLQAPGLSVSGPQGHLESGSGK

SEQ ID NO: 45332 - protein, 18 aa, Homo sapiens
GPAFNMASPESDFGINLK

SEQ ID NO: 45333 - protein, 19 aa, Homo sapiens
GPHVDVSGPDIDIEGPEGK

SEQ ID NO: 45334 - protein, 19 aa, Homo sapiens
GPSLDIDTPDVNIEGPEGK

SEQ ID NO: 45335 - protein, 16 aa, Homo sapiens
GSEVGFHGAAPDISVK

SEQ ID NO: 45336 - protein, 16 aa, Homo sapiens
IDVTAPDVSIEEPEGK

SEQ ID NO: 45337 - protein, 34 aa, Homo sapiens
IGVDASAPQIGGSITGPSVEVQAPDIDVQGPGSK

SEQ ID NO: 45338 - protein, 7 aa, Homo sapiens
IHMSGPK

SEQ ID NO: 45339 - protein, 11 aa, Homo sapiens
IKGDVDVSAPK

SEQ ID NO: 45340 - protein, 23 aa, Homo sapiens
IKGDVPSVGLEGPDVDLQGPEAK

SEQ ID NO: 45341 - protein, 11 aa, Homo sapiens
ISMPDIDLNLK

SEQ ID NO: 45342 - protein, 11 aa, Homo sapiens
ISMPDLDLHLK

SEQ ID NO: 45343 - protein, 11 aa, Homo sapiens
ISMPDVDFNLK

SEQ ID NO: 45344 - protein, 11 aa, Homo sapiens
ISMPDVDLHLK

SEQ ID NO: 45345 - protein, 11 aa, Homo sapiens
ISMPDVDLHVK

SEQ ID NO: 45346 - protein, 11 aa, Homo sapiens
ISMPDVNLNLK

SEQ ID NO: 45347 - protein, 25 aa, Homo sapiens
LEGDLTGPSVDVEVPDVELECPDAK

SEQ ID NO: 45348 - protein, 25 aa, Homo sapiens
LEGDLTGPSVGVEVPDVELECPDAK

SEQ ID NO: 45349 - protein, 23 aa, Homo sapiens
LEGELQAPDLELSLPAIHVEGLD

SEQ ID NO: 45350 - protein, 25 aa, Homo sapiens
LEGELQAPDLELSLPAIHVEGLDIK

SEQ ID NO: 45351 - protein, 17 aa, Homo sapiens
LKGDVDVSLPEVEGEMK

SEQ ID NO: 45352 - protein, 18 aa, Homo sapiens
LKGPQITGPSLEGDLGLK

SEQ ID NO: 45353 - protein, 18 aa, Homo sapiens
LPQFGISTPGSDLHVNAK

SEQ ID NO: 45354 - protein, 16 aa, Homo sapiens
MDAEVPDVNIEGPDAK

SEQ ID NO: 45355 - protein, 18 aa, Homo sapiens
MDIDAPDVDVHGPDWHLK

SEQ ID NO: 45356 - protein, 18 aa, Homo sapiens
MDIDAPDVEVQGPDWHLK

SEQ ID NO: 45357 - protein, 18 aa, Homo sapiens
MDIDVPDVEVQGPDWHLK

SEQ ID NO: 45358 - protein, 16 aa, Homo sapiens
MDVNVGDIDIEGPEGK

SEQ ID NO: 45359 - protein, 20 aa, Homo sapiens
MEGGGAEVHAQLPSLEGDLR

SEQ ID NO: 45360 - protein, 8 aa, Homo sapiens
MPKIKMPK

SEQ ID NO: 45361 - protein, 11 aa, Homo sapiens
MSLPDVDLDLK

SEQ ID NO: 45362 - protein, 11 aa, Homo sapiens
PDVELECPDAK

SEQ ID NO: 45363 - protein, 25 aa, Homo sapiens
PGLTIQAPQLEVSVPSANIEGLEGK

SEQ ID NO: 45364 - protein, 25 aa, Homo sapiens
SPSLDVTVPEAELNLETPEISVGGK

SEQ ID NO: 45365 - protein, 20 aa, Homo sapiens
SVPSMKVHAPGLNLSGVGGK

SEQ ID NO: 45366 - protein, 21 aa, Homo sapiens
TPSFGISAPQVSIPDVNVNLK

SEQ ID NO: 45367 - protein, 18 aa, Homo sapiens
VDIDAPDVDVHGPDWHLK

SEQ ID NO: 45368 - protein, 18 aa, Homo sapiens
VDIDAPDVEVHDPDWHLK

SEQ ID NO: 45369 - protein, 16 aa, Homo sapiens
VDIDAPDVSIEGPDAK

SEQ ID NO: 45370 - protein, 18 aa, Homo sapiens
VDIDVPDVDVQGPDWHLK

SEQ ID NO: 45371 - protein, 16 aa, Homo sapiens
VDIDVPDVNIEGPDAK

SEQ ID NO: 45372 - protein, 16 aa, Homo sapiens
VDIDVPDVNLEAPEGK

SEQ ID NO: 45373 - protein, 16 aa, Homo sapiens
VDIEAPDVSLEGPEGK

SEQ ID NO: 45374 - protein, 16 aa, Homo sapiens
VDIEGPDVNIEGPEGK

SEQ ID NO: 45375 - protein, 16 aa, Homo sapiens
VDIETPNLEGTLTGPR

SEQ ID NO: 45376 - protein, 18 aa, Homo sapiens
VDINAPDVEVHGPDWHLK

SEQ ID NO: 45377 - protein, 18 aa, Homo sapiens
VDINAPDVGVQGPDWHLK

SEQ ID NO: 45378 - protein, 18 aa, Homo sapiens
VDINTPDVDVHGPDWHLK

SEQ ID NO: 45379 - protein, 18 aa, Homo sapiens
VDISAPDVDVHGPDWHLK

SEQ ID NO: 45380 - protein, 16 aa, Homo sapiens
VDTNAPDLSLEGPEGK

SEQ ID NO: 45381 - protein, 16 aa, Homo sapiens
VDVDVPDVNIEGPDAK

SEQ ID NO: 45382 - protein, 16 aa, Homo sapiens
VDVEVPDVSLEGPEGK

SEQ ID NO: 45383 - protein, 16 aa, Homo sapiens
VDVNAPDVQAPDWHLK

SEQ ID NO: 45384 - protein, 18 aa, Homo sapiens
VDVSAPDVEAHGPEWNLK

SEQ ID NO: 45385 - protein, 18 aa, Homo sapiens
VDVSAPDVEMQGPDWNLK

SEQ ID NO: 45386 - protein, 23 aa, Homo sapiens
VEAPSLDVHMDSPDINIEGPDVK

SEQ ID NO: 45387 - protein, 16 aa, Homo sapiens
VGIDTPDIDIHGPEGK

SEQ ID NO: 45388 - protein, 14 aa, Homo sapiens
VHAPGLNLSGVGGK

SEQ ID NO: 45389 - protein, 11 aa, Homo sapiens
VKGDFDVSVPK

SEQ ID NO: 45390 - protein, 11 aa, Homo sapiens
VKGDVDVSLPK

SEQ ID NO: 45391 - protein, 16 aa, Homo sapiens
VNVEAPDVNLEGLGGK

SEQ ID NO: 45392 - protein, 18 aa, Homo sapiens
VQANLGAPDINIEGLDAK

SEQ ID NO: 45393 - protein, 11 aa, Homo sapiens
VSAPEVSVGHK

SEQ ID NO: 45394 - protein, 18 aa, Homo sapiens
VSVGAPDLSLEASEGSIK

SEQ ID NO: 45395 - protein, 11 aa, Homo sapiens
VTAPDVDLHLK

SEQ ID NO: 45396 - protein, 32 aa, Homo sapiens
KMENESATEGEDSAMTDMPPTEEVTDIVEMRE

SEQ ID NO: 45397 - protein, 9 aa, Homo sapiens
EASEVKPPR

SEQ ID NO: 45398 - protein, 17 aa, Homo sapiens
NGYSCVPVALAEGLDIK

SEQ ID NO: 45399 - protein, 22 aa, Homo sapiens
ADGTVNQIEGEATPVNLTEPAK

SEQ ID NO: 45400 - protein, 26 aa, Homo sapiens
ADGTVNQIEGEATPVNLTEPAKLEVK

SEQ ID NO: 45401 - protein, 11 aa, Homo sapiens
ATPVNLTEPAK

SEQ ID NO: 45402 - protein, 13 aa, Homo sapiens
CIQANYSLMENGK

SEQ ID NO: 45403 - protein, 15 aa, Homo sapiens
CIQANYSLMENGKIK

SEQ ID NO: 45404 - protein, 14 aa, Homo sapiens
CPNPPVQENFDVNK

SEQ ID NO: 45405 - protein, 18 aa, Homo sapiens
CPNPPVQENFDVNKYLGR

SEQ ID NO: 45406 - protein, 21 aa, Homo sapiens
DGTVNQIEGEATPVNLTEPAK

SEQ ID NO: 45407 - protein, 12 aa, Homo sapiens
EATPVNLTEPAK

SEQ ID NO: 45408 - protein, 14 aa, Homo sapiens
EGEATPVNLTEPAK

SEQ ID NO: 45409 - protein, 13 aa, Homo sapiens
GEATPVNLTEPAK

SEQ ID NO: 45410 - protein, 17 aa, Homo sapiens
GEATPVNLTEPAKLEVK

SEQ ID NO: 45411 - protein, 20 aa, Homo sapiens
GTVNQIEGEATPVNLTEPAK

SEQ ID NO: 45412 - protein, 24 aa, Homo sapiens
GTVNQIEGEATPVNLTEPAKLEVK

SEQ ID NO: 45413 - protein, 10 aa, Homo sapiens
HVDFAWILAR

SEQ ID NO: 45414 - protein, 15 aa, Homo sapiens
IEGEATPVNLTEPAK

SEQ ID NO: 45415 - protein, 9 aa, Homo sapiens
IKVLNQELR

SEQ ID NO: 45416 - protein, 10 aa, Homo sapiens
ILTSNNIDVK

SEQ ID NO: 45417 - protein, 9 aa, Homo sapiens
IPTTFENGR

SEQ ID NO: 45418 - protein, 22 aa, Homo sapiens
IPTTFENGRCIQANYSLMENGK

SEQ ID NO: 45419 - protein, 12 aa, Homo sapiens
IQANYSLMENGK

SEQ ID NO: 45420 - protein, 12 aa, Homo sapiens
KMTVTDQVNCPK

SEQ ID NO: 45421 - protein, 14 aa, Homo sapiens
KMTVTDQVNCPKLS

SEQ ID NO: 45422 - protein, 11 aa, Homo sapiens
MTVTDQVNCPK

SEQ ID NO: 45423 - protein, 13 aa, Homo sapiens
MTVTDQVNCPKLS

SEQ ID NO: 45424 - protein, 11 aa, Homo sapiens
NILTSNNIDVK

SEQ ID NO: 45425 - protein, 12 aa, Homo sapiens
NILTSNNIDVKK

SEQ ID NO: 45426 - protein, 13 aa, Homo sapiens
NPNLPPETVDSLK

SEQ ID NO: 45427 - protein, 24 aa, Homo sapiens
NPNLPPETVDSLKNILTSNNIDVK

SEQ ID NO: 45428 - protein, 25 aa, Homo sapiens
NPNLPPETVDSLKNILTSNNIDVKK

SEQ ID NO: 45429 - protein, 12 aa, Homo sapiens
NPPVQENFDVNK

SEQ ID NO: 45430 - protein, 17 aa, Homo sapiens
NQIEGEATPVNLTEPAK

SEQ ID NO: 45431 - protein, 21 aa, Homo sapiens
NQIEGEATPVNLTEPAKLEVK

SEQ ID NO: 45432 - protein, 9 aa, Homo sapiens
NYSLMENGK

SEQ ID NO: 45433 - protein, 20 aa, Homo sapiens
PPETVDSLKNILTSNNIDVK

SEQ ID NO: 45434 - protein, 11 aa, Homo sapiens
PPVQENFDVNK

SEQ ID NO: 45435 - protein, 15 aa, Homo sapiens
PPVQENFDVNKYLGR

SEQ ID NO: 45436 - protein, 8 aa, Homo sapiens
PTTFENGR

SEQ ID NO: 45437 - protein, 9 aa, Homo sapiens
PVNLTEPAK

SEQ ID NO: 45438 - protein, 13 aa, Homo sapiens
PVNLTEPAKLEVK

SEQ ID NO: 45439 - protein, 14 aa, Homo sapiens
PVQENFDVNKYLGR

SEQ ID NO: 45440 - protein, 7 aa, Homo sapiens
QAFHLGK

SEQ ID NO: 45441 - protein, 16 aa, Homo sapiens
QIEGEATPVNLTEPAK

SEQ ID NO: 45442 - protein, 24 aa, Homo sapiens
RADGTVNQIEGEATPVNLTEPAKL

SEQ ID NO: 45443 - protein, 15 aa, Homo sapiens
RCIQANYSLMENGKI

SEQ ID NO: 45444 - protein, 10 aa, Homo sapiens
TPVNLTEPAK

SEQ ID NO: 45445 - protein, 14 aa, Homo sapiens
TPVNLTEPAKLEVK

SEQ ID NO: 45446 - protein, 7 aa, Homo sapiens
VLNQELR

SEQ ID NO: 45447 - protein, 33 aa, Homo sapiens
VLNQELRADGTVNQIEGEATPVNLTEPAKLEVK

SEQ ID NO: 45448 - protein, 18 aa, Homo sapiens
VNQIEGEATPVNLTEPAK

SEQ ID NO: 45449 - protein, 6 aa, Homo sapiens
WYEIEK

SEQ ID NO: 45450 - protein, 15 aa, Homo sapiens
WYEIEKIPTTFENGR

SEQ ID NO: 45451 - protein, 14 aa, Homo sapiens
YEIEKIPTTFENGR

SEQ ID NO: 45452 - protein, 19 aa, Homo sapiens
YLGRWYEIEKIPTTFENGR

SEQ ID NO: 45453 - protein, 19 aa, Homo sapiens
IADNNNHYKKFPQMSSYQR

SEQ ID NO: 45454 - protein, 16 aa, Homo sapiens
MLVHRVAAYFGLDHNV

SEQ ID NO: 45455 - protein, 34 aa, Homo sapiens
KNSTFTYFTSDHGGHLEARDGHSQLGGWNGIYKG

SEQ ID NO: 45456 - protein, 24 aa, Homo sapiens
RALQWNAGSGGLPENETTFARILQ

SEQ ID NO: 45457 - protein, 8 aa, Homo sapiens
DMDSSYAK

SEQ ID NO: 45458 - protein, 17 aa, Homo sapiens
GPEVTSQGVQTSSPACK

SEQ ID NO: 45459 - protein, 18 aa, Homo sapiens
RGPEVTSQGVQTSSPACK

SEQ ID NO: 45460 - protein, 31 aa, Homo sapiens
APPQTHLPSGASSGTGSASATHGGGSPPGTR

SEQ ID NO: 45461 - protein, 19 aa, Homo sapiens
SFFHQHYLGGQEPTPSNIR

SEQ ID NO: 45462 - protein, 28 aa, Homo sapiens
TNLEFLQEQFNSIAAHVLHCTDSGFGAR

SEQ ID NO: 45463 - protein, 13 aa, Homo sapiens
RIHNVTASDSGKY

SEQ ID NO: 45464 - protein, 23 aa, Homo sapiens
APPWVPAMGFTLAPSLGCFVGSR

SEQ ID NO: 45465 - protein, 8 aa, Homo sapiens
FVHGEGLR

SEQ ID NO: 45466 - protein, 13 aa, Homo sapiens
TLAPSLGCFVGSR

SEQ ID NO: 45467 - protein, 12 aa, Homo sapiens
LRDPLQVHLPLR

SEQ ID NO: 45468 - protein, 14 aa, Homo sapiens
LVINDLTYHVRPPK

SEQ ID NO: 45469 - protein, 19 aa, Homo sapiens
TLVQQLYTTLCIEQHQLNK

SEQ ID NO: 45470 - protein, 18 aa, Homo sapiens
MGMIFTLFTINVSTDMRH

SEQ ID NO: 45471 - protein, 10 aa, Homo sapiens
LETFIQEHLR

SEQ ID NO: 45472 - protein, 34 aa, Homo sapiens
RYHQPGHEAVTSAVDQLQQEFHCCGSNNSQDWRD

SEQ ID NO: 45473 - protein, 23 aa, Homo sapiens
SAVDQLQQEFHCCGSNNSQDWRD

SEQ ID NO: 45474 - protein, 9 aa, Homo sapiens
TVVALCGQR

SEQ ID NO: 45475 - protein, 32 aa, Homo sapiens
YHQPGHEAVTSAVDQLQQEFHCCGSNNSQDWR

SEQ ID NO: 45476 - protein, 20 aa, Homo sapiens
FICNEGYYLIGEEILYCELK

SEQ ID NO: 45477 - protein, 15 aa, Homo sapiens
GSVAIWSGKPPICEK

SEQ ID NO: 45478 - protein, 26 aa, Homo sapiens
KGFYLDGSDTIVCDSNSTWDPPVPKC

SEQ ID NO: 45479 - protein, 23 aa, Homo sapiens
RDPLNGQAVPANGTYEFGYQMHF

SEQ ID NO: 45480 - protein, 13 aa, Homo sapiens
ALNIKQNKAMLAK

SEQ ID NO: 45481 - protein, 27 aa, Homo sapiens
KAESRQPSENSVTDSNSDSEDESGMNF

SEQ ID NO: 45482 - protein, 12 aa, Homo sapiens
LEKRALNIKQNK

SEQ ID NO: 45483 - protein, 8 aa, Homo sapiens
RVPQKDLR

SEQ ID NO: 45484 - protein, 40 aa, Homo sapiens
MAAANPWDPASAPNGAGLVLGHFIASGMVNQEMLNMSKKT

SEQ ID NO: 45485 - protein, 11 aa, Homo sapiens
AEIKRLQEANK

SEQ ID NO: 45486 - protein, 6 aa, Homo sapiens
DLALLK

SEQ ID NO: 45487 - protein, 6 aa, Homo sapiens
EIEYTK

SEQ ID NO: 45488 - protein, 10 aa, Homo sapiens
ENEKKLNGEK

SEQ ID NO: 45489 - protein, 22 aa, Homo sapiens
FLPLFGHIGGTQSKGPWEELAK

SEQ ID NO: 45490 - protein, 14 aa, Homo sapiens
IQLSNQELLGDDQK

SEQ ID NO: 45491 - protein, 7 aa, Homo sapiens
KEKPAEK

SEQ ID NO: 45492 - protein, 23 aa, Homo sapiens
KELNATSRILDMSDGKVGESSKK

SEQ ID NO: 45493 - protein, 8 aa, Homo sapiens
KERQLILK

SEQ ID NO: 45494 - protein, 18 aa, Homo sapiens
LAGASINYGSAWNTEYDV

SEQ ID NO: 45495 - protein, 9 aa, Homo sapiens
LASSLPDNK

SEQ ID NO: 45496 - protein, 22 aa, Homo sapiens
LLAQLCKRQTDSSSSDMQACSQ

SEQ ID NO: 45497 - protein, 16 aa, Homo sapiens
NPAASRTTTENMAPIP

SEQ ID NO: 45498 - protein, 14 aa, Homo sapiens
PGYQPSGESDKENK

SEQ ID NO: 45499 - protein, 12 aa, Homo sapiens
QALAAWDKELIK

SEQ ID NO: 45500 - protein, 11 aa, Homo sapiens
RFNMEKRRGHH

SEQ ID NO: 45501 - protein, 11 aa, Homo sapiens
RRLDAEEAEIR

SEQ ID NO: 45502 - protein, 21 aa, Homo sapiens
SLSMTQSETTSDQSDIEGRIR

SEQ ID NO: 45503 - protein, 18 aa, Homo sapiens
VRSPGPKPQGLLAQLCKR

SEQ ID NO: 45504 - protein, 21 aa, Homo sapiens
KANMTLTSGIMFIVSGLCAIA

SEQ ID NO: 45505 - protein, 11 aa, Homo sapiens
DALKSSVDAVK

SEQ ID NO: 45506 - protein, 15 aa, Homo sapiens
DALKSSVDAVKYFGK

SEQ ID NO: 45507 - protein, 13 aa, Homo sapiens
GLEQLLVGGSHLK

SEQ ID NO: 45508 - protein, 9 aa, Homo sapiens
GVFHQTVSR

SEQ ID NO: 45509 - protein, 25 aa, Homo sapiens
KENYAELLEDAFLKNVTAQICIDKK

SEQ ID NO: 45510 - protein, 19 aa, Homo sapiens
LLLFSDGNSQGATPAAIEK

SEQ ID NO: 45511 - protein, 16 aa, Homo sapiens
VAVVQYSGTGQQRPER

SEQ ID NO: 45512 - protein, 14 aa, Homo sapiens
VFSVAITPDHLEPR

SEQ ID NO: 45513 - protein, 9 aa, Homo sapiens
VPSYQALLR

SEQ ID NO: 45514 - protein, 13 aa, Homo sapiens
HLSLCHGLSDLAR

SEQ ID NO: 45515 - protein, 27 aa, Homo sapiens
HVHQIDAVLLSHPDPLHLGALPYAVGK

SEQ ID NO: 45516 - protein, 13 aa, Homo sapiens
IGLEGCLCQDFYR

SEQ ID NO: 45517 - protein, 28 aa, Homo sapiens
RTKDAGLGVYSLALLNNVSYNVVEFSKS

SEQ ID NO: 45518 - protein, 28 aa, Homo sapiens
KALWNSSVPVCEQIFCPNPPAILNGRHT

SEQ ID NO: 45519 - protein, 16 aa, Homo sapiens
KPGLTPSPSATTPLTK

SEQ ID NO: 45520 - protein, 20 aa, Homo sapiens
LSKPELLTLFSILEGELEAR

SEQ ID NO: 45521 - protein, 13 aa, Homo sapiens
DHVQMIVLDEADK

SEQ ID NO: 45522 - protein, 10 aa, Homo sapiens
GNEFEDYCLK

SEQ ID NO: 45523 - protein, 24 aa, Homo sapiens
GPVKPTGGPGGGGTQTQQQMNQLK

SEQ ID NO: 45524 - protein, 19 aa, Homo sapiens
LLSQDFVQIMEDIILTLPK

SEQ ID NO: 45525 - protein, 18 aa, Homo sapiens
QVNQSATALKHVFASLRL

SEQ ID NO: 45526 - protein, 16 aa, Homo sapiens
GVQGIIVVNTEGIPIK

SEQ ID NO: 45527 - protein, 21 aa, Homo sapiens
STMDNPTTTQYASLMHSFILK

SEQ ID NO: 45528 - protein, 27 aa, Homo sapiens
KAMAETFYLSNIVPQDFDNNSGYWNRI

SEQ ID NO: 45529 - protein, 18 aa, Homo sapiens
AGFGNQESEFWLGNENLH

SEQ ID NO: 45530 - protein, 20 aa, Homo sapiens
AGFGNQESEFWLGNENLHQL

SEQ ID NO: 45531 - protein, 22 aa, Homo sapiens
AGFGNQESEFWLGNENLHQLTL

SEQ ID NO: 45532 - protein, 29 aa, Homo sapiens
AGFGNQESEFWLGNENLHQLTLQGNWELR

SEQ ID NO: 45533 - protein, 20 aa, Homo sapiens
ALPVFCDMDTEGGGWLVFQR

SEQ ID NO: 45534 - protein, 13 aa, Homo sapiens
ELLSQGATLSGWY

SEQ ID NO: 45535 - protein, 14 aa, Homo sapiens
ELLSQGATLSGWYH

SEQ ID NO: 45536 - protein, 21 aa, Homo sapiens
ELLSQGATLSGWYHLCLPEGR

SEQ ID NO: 45537 - protein, 13 aa, Homo sapiens
FSEGTAGDSLSLH

SEQ ID NO: 45538 - protein, 16 aa, Homo sapiens
FSEGTAGDSLSLHSGR

SEQ ID NO: 45539 - protein, 18 aa, Homo sapiens
FSEGTAGDSLSLHSGRPF

SEQ ID NO: 45540 - protein, 11 aa, Homo sapiens
GEPGDPVNLLR

SEQ ID NO: 45541 - protein, 12 aa, Homo sapiens
GEVDHYQLALGK

SEQ ID NO: 45542 - protein, 13 aa, Homo sapiens
LGEVDHYQLALGK

SEQ ID NO: 45543 - protein, 14 aa, Homo sapiens
LLGEVDHYQLALGK

SEQ ID NO: 45544 - protein, 9 aa, Homo sapiens
PGDPVNLLR

SEQ ID NO: 45545 - protein, 9 aa, Homo sapiens
QDGSVDFFR

SEQ ID NO: 45546 - protein, 10 aa, Homo sapiens
RQDGSVDFFR

SEQ ID NO: 45547 - protein, 12 aa, Homo sapiens
RVELEDFNGNRT

SEQ ID NO: 45548 - protein, 8 aa, Homo sapiens
TFAHYATF

SEQ ID NO: 45549 - protein, 9 aa, Homo sapiens
TFAHYATFR

SEQ ID NO: 45550 - protein, 10 aa, Homo sapiens
VELEDFNGNR

SEQ ID NO: 45551 - protein, 19 aa, Homo sapiens
VELEDFNGNRTFAHYATFR

SEQ ID NO: 45552 - protein, 17 aa, Homo sapiens
VVLLPSCPGAPGSPGEK

SEQ ID NO: 45553 - protein, 10 aa, Homo sapiens
YAVSEAAAHK

SEQ ID NO: 45554 - protein, 19 aa, Homo sapiens
YAVSEAAAHKYGIDWASGR

SEQ ID NO: 45555 - protein, 9 aa, Homo sapiens
YGIDWASGR

SEQ ID NO: 45556 - protein, 31 aa, Homo sapiens
KEANPTPLTPGASSLSQLGAYLDSDDSNGSN

SEQ ID NO: 45557 - protein, 35 aa, Homo sapiens
RQCSSEPNITDNPDGLEEGARGSQEGSELNCASLS

SEQ ID NO: 45558 - protein, 30 aa, Homo sapiens
AEISCTDNQDGTCSVSYLPVLPGDYSILVK

SEQ ID NO: 45559 - protein, 14 aa, Homo sapiens
AGNNMLLVGVHGPR

SEQ ID NO: 45560 - protein, 24 aa, Homo sapiens
AHEPTYFTVDCAEAGQGDVSIGIK

SEQ ID NO: 45561 - protein, 11 aa, Homo sapiens
AHVVPCFDASK

SEQ ID NO: 45562 - protein, 24 aa, Homo sapiens
ALGALVDSCAPGLCPDWDSWDASK

SEQ ID NO: 45563 - protein, 30 aa, Homo sapiens
ALGALVDSCAPGLCPDWDSWDASKPVTNAR

SEQ ID NO: 45564 - protein, 11 aa, Homo sapiens
ALTQTGGPHVK

SEQ ID NO: 45565 - protein, 16 aa, Homo sapiens
APSVANVGSHCDLSLK

SEQ ID NO: 45566 - protein, 24 aa, Homo sapiens
ASGPGLNTTGVPASLPVEFTIDAK

SEQ ID NO: 45567 - protein, 19 aa, Homo sapiens
ATCAPQHGAPGPGPADASK

SEQ ID NO: 45568 - protein, 13 aa, Homo sapiens
AWGPGLEGGVVGK

SEQ ID NO: 45569 - protein, 19 aa, Homo sapiens
CAPGVVGPAEADIDFDIIR

SEQ ID NO: 45570 - protein, 24 aa, Homo sapiens
CSYQPTMEGVHTVHVTFAGVPIPR

SEQ ID NO: 45571 - protein, 16 aa, Homo sapiens
DAGEGGLSLAIEGPSK

SEQ ID NO: 45572 - protein, 17 aa, Homo sapiens
DAGEGLLAVQITDPEGK

SEQ ID NO: 45573 - protein, 19 aa, Homo sapiens
DAGEGLLAVQITDPEGKPK

SEQ ID NO: 45574 - protein, 30 aa, Homo sapiens
DAGYGGLSLSIEGPSKVDINTEDLEDGTCR

SEQ ID NO: 45575 - protein, 21 aa, Homo sapiens
DGSCGVAYVVQEPGDYEVSVK

SEQ ID NO: 45576 - protein, 33 aa, Homo sapiens
DGSCSVEYIPYEAGTYSLNVTYGGHQVPGSPFK

SEQ ID NO: 45577 - protein, 10 aa, Homo sapiens
DKGEYTLVVK

SEQ ID NO: 45578 - protein, 14 aa, Homo sapiens
DNGNGTYSCSYVPR

SEQ ID NO: 45579 - protein, 15 aa, Homo sapiens
DVDIIDHHDNTYTVK

SEQ ID NO: 45580 - protein, 33 aa, Homo sapiens
EEGPYEVEVTYDGVPVPGSPFPLEAVAPTKPSK

SEQ ID NO: 45581 - protein, 10 aa, Homo sapiens
ETGEHLVHVK

SEQ ID NO: 45582 - protein, 14 aa, Homo sapiens
FADQHVPGSPFSVK

SEQ ID NO: 45583 - protein, 28 aa, Homo sapiens
FGGEHVPNSPFQVTALAGDQPSVQPPLR

SEQ ID NO: 45584 - protein, 23 aa, Homo sapiens
FNEEHIPDSPFVVPVASPSGDAR

SEQ ID NO: 45585 - protein, 12 aa, Homo sapiens
FNGTHIPGSPFK

SEQ ID NO: 45586 - protein, 14 aa, Homo sapiens
FVPAEMGTHTVSVK

SEQ ID NO: 45587 - protein, 18 aa, Homo sapiens
GAGTGGLGLAVEGPSEAK

SEQ ID NO: 45588 - protein, 21 aa, Homo sapiens
GLNTTGVPASLPVEFTIDAKD

SEQ ID NO: 45589 - protein, 24 aa, Homo sapiens
GLVEPVDVVDNADGTQTVNYVPSR

SEQ ID NO: 45590 - protein, 23 aa, Homo sapiens
GQHVPGSPFQFTVGPLGEGGAHK

SEQ ID NO: 45591 - protein, 18 aa, Homo sapiens
HTAMVSWGGVSIPNSPFR

SEQ ID NO: 45592 - protein, 13 aa, Homo sapiens
IANLQTDLSDGLR

SEQ ID NO: 45593 - protein, 19 aa, Homo sapiens
IPEISIQDMTAQVTSPSGK

SEQ ID NO: 45594 - protein, 12 aa, Homo sapiens
IVGPSGAAVPCK

SEQ ID NO: 45595 - protein, 22 aa, Homo sapiens
KDGSCGVAYVVQEPGDYEVSVK

SEQ ID NO: 45596 - protein, 25 aa, Homo sapiens
KNGQHVASSPIPVVISQSEIGDASR

SEQ ID NO: 45597 - protein, 23 aa, Homo sapiens
KTHIQDNHDGTYTVAYVPDVTGR

SEQ ID NO: 45598 - protein, 26 aa, Homo sapiens
LQVEPAVDTSGVQCYGPGIEGQGVFR

SEQ ID NO: 45599 - protein, 20 aa, Homo sapiens
LVSNHSLHETSSVFVDSLTK

SEQ ID NO: 45600 - protein, 9 aa, Homo sapiens
LYSVSYLLK

SEQ ID NO: 45601 - protein, 24 aa, Homo sapiens
NGQHVASSPIPVVISQSEIGDASR

SEQ ID NO: 45602 - protein, 17 aa, Homo sapiens
RAPSVANVGSHCDLSLK

SEQ ID NO: 45603 - protein, 22 aa, Homo sapiens
SAGQGEVLVYVEDPAGHQEEAK

SEQ ID NO: 45604 - protein, 9 aa, Homo sapiens
SPFEVYVDK

SEQ ID NO: 45605 - protein, 17 aa, Homo sapiens
SPYTVTVGQACNPSACR

SEQ ID NO: 45606 - protein, 9 aa, Homo sapiens
SSFTVDCSK

SEQ ID NO: 45607 - protein, 15 aa, Homo sapiens
TFSVWYVPEVTGTHK

SEQ ID NO: 45608 - protein, 16 aa, Homo sapiens
TGVAVNKPAEFTVDAK

SEQ ID NO: 45609 - protein, 14 aa, Homo sapiens
TGVELGKPTHFTVN

SEQ ID NO: 45610 - protein, 16 aa, Homo sapiens
TGVELGKPTHFTVNAK

SEQ ID NO: 45611 - protein, 17 aa, Homo sapiens
THEAEIVEGENHTYCIR

SEQ ID NO: 45612 - protein, 22 aa, Homo sapiens
THIQDNHDGTYTVAYVPDVTGR

SEQ ID NO: 45613 - protein, 9 aa, Homo sapiens
TPCEEILVK

SEQ ID NO: 45614 - protein, 16 aa, Homo sapiens
VANPSGNLTETYVQDR

SEQ ID NO: 45615 - protein, 10 aa, Homo sapiens
VAQPTITDNK

SEQ ID NO: 45616 - protein, 14 aa, Homo sapiens
VDINTEDLEDGTCR

SEQ ID NO: 45617 - protein, 12 aa, Homo sapiens
VDVGKDQEFTVK

SEQ ID NO: 45618 - protein, 29 aa, Homo sapiens
VGSAADIPINISETDLSLLTATVVPPSGR

SEQ ID NO: 45619 - protein, 9 aa, Homo sapiens
VGTECGNQK

SEQ ID NO: 45620 - protein, 16 aa, Homo sapiens
VHGPGIQSGTTNKPNK

SEQ ID NO: 45621 - protein, 20 aa, Homo sapiens
VHSPSGALEECYVTEIDQDK

SEQ ID NO: 45622 - protein, 24 aa, Homo sapiens
VHSPSGALEECYVTEIDQDKYAVR

SEQ ID NO: 45623 - protein, 9 aa, Homo sapiens
VLPTHDASK

SEQ ID NO: 45624 - protein, 11 aa, Homo sapiens
VNVGAGSHPNK

SEQ ID NO: 45625 - protein, 11 aa, Homo sapiens
VPVHDVTDASK

SEQ ID NO: 45626 - protein, 16 aa, Homo sapiens
VQVQDNEGCPVEALVK

SEQ ID NO: 45627 - protein, 22 aa, Homo sapiens
VSGQGLHEGHTFEPAEFIIDTR

SEQ ID NO: 45628 - protein, 17 aa, Homo sapiens
VTAQGPGLEPSGNIANK

SEQ ID NO: 45629 - protein, 12 aa, Homo sapiens
VTVLFAGQHIAK

SEQ ID NO: 45630 - protein, 16 aa, Homo sapiens
VTYCPTEPGNYIINIK

SEQ ID NO: 45631 - protein, 16 aa, Homo sapiens
VTYTPMAPGSYLISIK

SEQ ID NO: 45632 - protein, 14 aa, Homo sapiens
YAPSEAGLHEMDIR

SEQ ID NO: 45633 - protein, 13 aa, Homo sapiens
YGGPYHIGGSPFK

SEQ ID NO: 45634 - protein, 14 aa, Homo sapiens
YNEQHVPGSPFTAR

SEQ ID NO: 45635 - protein, 22 aa, Homo sapiens
YTPVQQGPVGVNVTYGGDPIPK

SEQ ID NO: 45636 - protein, 21 aa, Homo sapiens
YWPQEAGEYAVHVLCNSEDIR

SEQ ID NO: 45637 - protein, 14 aa, Homo sapiens
FVIHCHIPQWGSDK

SEQ ID NO: 45638 - protein, 24 aa, Homo sapiens
FVIHCHIPQWGSDKCEEQLEETIK

SEQ ID NO: 45639 - protein, 18 aa, Homo sapiens
AAHLPAEFTPAVHASLDK

SEQ ID NO: 45640 - protein, 12 aa, Homo sapiens
AAWGKVGAHAGE

SEQ ID NO: 45641 - protein, 13 aa, Homo sapiens
AAWGKVGAHAGEY

SEQ ID NO: 45642 - protein, 14 aa, Homo sapiens
AAWGKVGAHAGEYG

SEQ ID NO: 45643 - protein, 15 aa, Homo sapiens
AAWGKVGAHAGEYGA

SEQ ID NO: 45644 - protein, 16 aa, Homo sapiens
AAWGKVGAHAGEYGAE

SEQ ID NO: 45645 - protein, 17 aa, Homo sapiens
AAWGKVGAHAGEYGAEA

SEQ ID NO: 45646 - protein, 19 aa, Homo sapiens
AAWGKVGAHAGEYGAEALE

SEQ ID NO: 45647 - protein, 20 aa, Homo sapiens
AAWGKVGAHAGEYGAEALER

SEQ ID NO: 45648 - protein, 21 aa, Homo sapiens
AAWGKVGAHAGEYGAEALERM

SEQ ID NO: 45649 - protein, 29 aa, Homo sapiens
AAWGKVGAHAGEYGAEALERMFLSFPTTK

SEQ ID NO: 45650 - protein, 28 aa, Homo sapiens
ADALTNAVAHVDDMPNALSALSDLHAHK

SEQ ID NO: 45651 - protein, 37 aa, Homo sapiens
ADALTNAVAHVDDMPNALSALSDLHAHKLRVDPVNFK

SEQ ID NO: 45652 - protein, 15 aa, Homo sapiens
AEALERMFLSFPTTK

SEQ ID NO: 45653 - protein, 20 aa, Homo sapiens
AGEYGAEALERMFLSFPTTK

SEQ ID NO: 45654 - protein, 13 aa, Homo sapiens
AHAGEYGAEALER

SEQ ID NO: 45655 - protein, 22 aa, Homo sapiens
AHAGEYGAEALERMFLSFPTTK

SEQ ID NO: 45656 - protein, 13 aa, Homo sapiens
ALERMFLSFPTTK

SEQ ID NO: 45657 - protein, 12 aa, Homo sapiens
ALSALSDLHAHK

SEQ ID NO: 45658 - protein, 14 aa, Homo sapiens
ALSALSDLHAHKLR

SEQ ID NO: 45659 - protein, 26 aa, Homo sapiens
ALTNAVAHVDDMPNALSALSDLHAHK

SEQ ID NO: 45660 - protein, 22 aa, Homo sapiens
AVAHVDDMPNALSALSDLHAHK

SEQ ID NO: 45661 - protein, 24 aa, Homo sapiens
AVAHVDDMPNALSALSDLHAHKLR

SEQ ID NO: 45662 - protein, 19 aa, Homo sapiens
AWGKVGAHAGEYGAEALER

SEQ ID NO: 45663 - protein, 27 aa, Homo sapiens
DALTNAVAHVDDMPNALSALSDLHAHK

SEQ ID NO: 45664 - protein, 10 aa, Homo sapiens
DLSHGSAQVK

SEQ ID NO: 45665 - protein, 11 aa, Homo sapiens
FDLSHGSAQVK

SEQ ID NO: 45666 - protein, 15 aa, Homo sapiens
FDLSHGSAQVKGHGK

SEQ ID NO: 45667 - protein, 16 aa, Homo sapiens
FDLSHGSAQVKGHGKK

SEQ ID NO: 45668 - protein, 12 aa, Homo sapiens
FLASVSTVLTSK

SEQ ID NO: 45669 - protein, 14 aa, Homo sapiens
FLASVSTVLTSKYR

SEQ ID NO: 45670 - protein, 14 aa, Homo sapiens
FPHFDLSHGSAQVK

SEQ ID NO: 45671 - protein, 18 aa, Homo sapiens
FPHFDLSHGSAQVKGHGK

SEQ ID NO: 45672 - protein, 19 aa, Homo sapiens
FPHFDLSHGSAQVKGHGKK

SEQ ID NO: 45673 - protein, 16 aa, Homo sapiens
GAEALERMFLSFPTTK

SEQ ID NO: 45674 - protein, 14 aa, Homo sapiens
GAHAGEYGAEALER

SEQ ID NO: 45675 - protein, 23 aa, Homo sapiens
GAHAGEYGAEALERMFLSFPTTK

SEQ ID NO: 45676 - protein, 19 aa, Homo sapiens
GEYGAEALERMFLSFPTTK

SEQ ID NO: 45677 - protein, 13 aa, Homo sapiens
GHGKKVADALTNA

SEQ ID NO: 45678 - protein, 34 aa, Homo sapiens
GHGKKVADALTNAVAHVDDMPNALSALSDLHAHK

SEQ ID NO: 45679 - protein, 17 aa, Homo sapiens
GKVGAHAGEYGAEALER

SEQ ID NO: 45680 - protein, 12 aa, Homo sapiens
HAGEYGAEALER

SEQ ID NO: 45681 - protein, 12 aa, Homo sapiens
HFDLSHGSAQVK

SEQ ID NO: 45682 - protein, 16 aa, Homo sapiens
HFDLSHGSAQVKGHGK

SEQ ID NO: 45683 - protein, 17 aa, Homo sapiens
HFDLSHGSAQVKGHGKK

SEQ ID NO: 45684 - protein, 21 aa, Homo sapiens
KAAWGKVGAHAGEYGAEALER

SEQ ID NO: 45685 - protein, 10 aa, Homo sapiens
KTNVKAAWGK

SEQ ID NO: 45686 - protein, 25 aa, Homo sapiens
KTNVKAAWGKVGAHAGEYGAEALER

SEQ ID NO: 45687 - protein, 17 aa, Homo sapiens
KTYFPHFDLSHGSAQVK

SEQ ID NO: 45688 - protein, 18 aa, Homo sapiens
KVADALTNAVAHVDDMPN

SEQ ID NO: 45689 - protein, 27 aa, Homo sapiens
KVADALTNAVAHVDDMPNALSALSDLH

SEQ ID NO: 45690 - protein, 28 aa, Homo sapiens
KVADALTNAVAHVDDMPNALSALSDLHA

SEQ ID NO: 45691 - protein, 30 aa, Homo sapiens
KVADALTNAVAHVDDMPNALSALSDLHAHK

SEQ ID NO: 45692 - protein, 32 aa, Homo sapiens
KVADALTNAVAHVDDMPNALSALSDLHAHKLR

SEQ ID NO: 45693 - protein, 34 aa, Homo sapiens
KVADALTNAVAHVDDMPNALSALSDLHAHKLRVD

SEQ ID NO: 45694 - protein, 37 aa, Homo sapiens
KVADALTNAVAHVDDMPNALSALSDLHAHKLRVDPVN

SEQ ID NO: 45695 - protein, 16 aa, Homo sapiens
KVGAHAGEYGAEALER

SEQ ID NO: 45696 - protein, 25 aa, Homo sapiens
KVGAHAGEYGAEALERMFLSFPTTK

SEQ ID NO: 45697 - protein, 23 aa, Homo sapiens
LLVTLAAHLPAEFTPAVHASLDK

SEQ ID NO: 45698 - protein, 9 aa, Homo sapiens
LRVDPVNFK

SEQ ID NO: 45699 - protein, 25 aa, Homo sapiens
LTNAVAHVDDMPNALSALSDLHAHK

SEQ ID NO: 45700 - protein, 9 aa, Homo sapiens
MFLSFPTTK

SEQ ID NO: 45701 - protein, 19 aa, Homo sapiens
MFLSFPTTKTYFPHFDLSH

SEQ ID NO: 45702 - protein, 20 aa, Homo sapiens
MFLSFPTTKTYFPHFDLSHG

SEQ ID NO: 45703 - protein, 21 aa, Homo sapiens
MFLSFPTTKTYFPHFDLSHGS

SEQ ID NO: 45704 - protein, 22 aa, Homo sapiens
MFLSFPTTKTYFPHFDLSHGSA

SEQ ID NO: 45705 - protein, 23 aa, Homo sapiens
MFLSFPTTKTYFPHFDLSHGSAQ

SEQ ID NO: 45706 - protein, 25 aa, Homo sapiens
MFLSFPTTKTYFPHFDLSHGSAQVK

SEQ ID NO: 45707 - protein, 29 aa, Homo sapiens
MFLSFPTTKTYFPHFDLSHGSAQVKGHGK

SEQ ID NO: 45708 - protein, 30 aa, Homo sapiens
MFLSFPTTKTYFPHFDLSHGSAQVKGHGKK

SEQ ID NO: 45709 - protein, 15 aa, Homo sapiens
MPNALSALSDLHAHK

SEQ ID NO: 45710 - protein, 13 aa, Homo sapiens
NALSALSDLHAHK

SEQ ID NO: 45711 - protein, 23 aa, Homo sapiens
NAVAHVDDMPNALSALSDLHAHK

SEQ ID NO: 45712 - protein, 9 aa, Homo sapiens
PAVHASLDK

SEQ ID NO: 45713 - protein, 13 aa, Homo sapiens
PHFDLSHGSAQVK

SEQ ID NO: 45714 - protein, 17 aa, Homo sapiens
PHFDLSHGSAQVKGHGK

SEQ ID NO: 45715 - protein, 18 aa, Homo sapiens
PHFDLSHGSAQVKGHGKK

SEQ ID NO: 45716 - protein, 20 aa, Homo sapiens
PTTKTYFPHFDLSHGSAQVK

SEQ ID NO: 45717 - protein, 10 aa, Homo sapiens
RMFLSFPTTK

SEQ ID NO: 45718 - protein, 8 aa, Homo sapiens
RVDPVNFK

SEQ ID NO: 45719 - protein, 10 aa, Homo sapiens
SALSDLHAHK

SEQ ID NO: 45720 - protein, 16 aa, Homo sapiens
SDLHAHKLRVDPVNFK

SEQ ID NO: 45721 - protein, 16 aa, Homo sapiens
SLDKFLASVSTVLTSK

SEQ ID NO: 45722 - protein, 18 aa, Homo sapiens
TKTYFPHFDLSHGSAQVK

SEQ ID NO: 45723 - protein, 22 aa, Homo sapiens
TKTYFPHFDLSHGSAQVKGHGK

SEQ ID NO: 45724 - protein, 20 aa, Homo sapiens
TLAAHLPAEFTPAVHASLDK

SEQ ID NO: 45725 - protein, 24 aa, Homo sapiens
TNAVAHVDDMPNALSALSDLHAHK

SEQ ID NO: 45726 - protein, 9 aa, Homo sapiens
TNVKAAWGK

SEQ ID NO: 45727 - protein, 24 aa, Homo sapiens
TNVKAAWGKVGAHAGEYGAEALER

SEQ ID NO: 45728 - protein, 8 aa, Homo sapiens
TYFPHFDL

SEQ ID NO: 45729 - protein, 10 aa, Homo sapiens
TYFPHFDLSH

SEQ ID NO: 45730 - protein, 11 aa, Homo sapiens
TYFPHFDLSHG

SEQ ID NO: 45731 - protein, 12 aa, Homo sapiens
TYFPHFDLSHGS

SEQ ID NO: 45732 - protein, 13 aa, Homo sapiens
TYFPHFDLSHGSA

SEQ ID NO: 45733 - protein, 14 aa, Homo sapiens
TYFPHFDLSHGSAQ

SEQ ID NO: 45734 - protein, 15 aa, Homo sapiens
TYFPHFDLSHGSAQV

SEQ ID NO: 45735 - protein, 16 aa, Homo sapiens
TYFPHFDLSHGSAQVK

SEQ ID NO: 45736 - protein, 17 aa, Homo sapiens
TYFPHFDLSHGSAQVKG

SEQ ID NO: 45737 - protein, 19 aa, Homo sapiens
TYFPHFDLSHGSAQVKGHG

SEQ ID NO: 45738 - protein, 20 aa, Homo sapiens
TYFPHFDLSHGSAQVKGHGK

SEQ ID NO: 45739 - protein, 21 aa, Homo sapiens
TYFPHFDLSHGSAQVKGHGKK

SEQ ID NO: 45740 - protein, 23 aa, Homo sapiens
TYFPHFDLSHGSAQVKGHGKKVA

SEQ ID NO: 45741 - protein, 24 aa, Homo sapiens
TYFPHFDLSHGSAQVKGHGKKVAD

SEQ ID NO: 45742 - protein, 25 aa, Homo sapiens
TYFPHFDLSHGSAQVKGHGKKVADA

SEQ ID NO: 45743 - protein, 26 aa, Homo sapiens
TYFPHFDLSHGSAQVKGHGKKVADAL

SEQ ID NO: 45744 - protein, 28 aa, Homo sapiens
TYFPHFDLSHGSAQVKGHGKKVADALTN

SEQ ID NO: 45745 - protein, 34 aa, Homo sapiens
TYFPHFDLSHGSAQVKGHGKKVADALTNAVAHVD

SEQ ID NO: 45746 - protein, 14 aa, Homo sapiens
VADALTNAVAHVDD

SEQ ID NO: 45747 - protein, 28 aa, Homo sapiens
VADALTNAVAHVDDMPNALSALSDLHAH

SEQ ID NO: 45748 - protein, 29 aa, Homo sapiens
VADALTNAVAHVDDMPNALSALSDLHAHK

SEQ ID NO: 45749 - protein, 31 aa, Homo sapiens
VADALTNAVAHVDDMPNALSALSDLHAHKLR

SEQ ID NO: 45750 - protein, 12 aa, Homo sapiens
VGAHAGEYGAEA

SEQ ID NO: 45751 - protein, 15 aa, Homo sapiens
VGAHAGEYGAEALER

SEQ ID NO: 45752 - protein, 16 aa, Homo sapiens
VGAHAGEYGAEALERM

SEQ ID NO: 45753 - protein, 18 aa, Homo sapiens
VGAHAGEYGAEALERMFL

SEQ ID NO: 45754 - protein, 24 aa, Homo sapiens
VGAHAGEYGAEALERMFLSFPTTK

SEQ ID NO: 45755 - protein, 22 aa, Homo sapiens
VKAAWGKVGAHAGEYGAEALER

SEQ ID NO: 45756 - protein, 7 aa, Homo sapiens
VLSPADK

SEQ ID NO: 45757 - protein, 11 aa, Homo sapiens
VLSPADKTNVK

SEQ ID NO: 45758 - protein, 21 aa, Homo sapiens
VTLAAHLPAEFTPAVHASLDK

SEQ ID NO: 45759 - protein, 18 aa, Homo sapiens
WGKVGAHAGEYGAEALER

SEQ ID NO: 45760 - protein, 15 aa, Homo sapiens
YFPHFDLSHGSAQVK

SEQ ID NO: 45761 - protein, 17 aa, Homo sapiens
YGAEALERMFLSFPTTK

SEQ ID NO: 45762 - protein, 22 aa, Homo sapiens
RYNQSEAGSHTLQGMNGCDMGP

SEQ ID NO: 45763 - protein, 31 aa, Homo sapiens
ADAGKEGNNPAENGDAKTDQAQKAEGAGDAK

SEQ ID NO: 45764 - protein, 15 aa, Homo sapiens
LSAKPAPPKPEPKPK

SEQ ID NO: 45765 - protein, 14 aa, Homo sapiens
SAKPAPPKPEPKPK

SEQ ID NO: 45766 - protein, 17 aa, Homo sapiens
GLCESVVEADLVEALEK

SEQ ID NO: 45767 - protein, 16 aa, Homo sapiens
HDGYGSHGPLLPLPSR

SEQ ID NO: 45768 - protein, 26 aa, Homo sapiens
NIIQPPSCVLHYYNVPLCVTEETFTK

SEQ ID NO: 45769 - protein, 13 aa, Homo sapiens
DCPTGHLTVDEFK

SEQ ID NO: 45770 - protein, 14 aa, Homo sapiens
DCPTGHLTVDEFKK

SEQ ID NO: 45771 - protein, 15 aa, Homo sapiens
ENTEFTDHELQEWYK

SEQ ID NO: 45772 - protein, 33 aa, Homo sapiens
EEGIENFDVYAIKPGHPLQPDFFLDEYPEAVSK

SEQ ID NO: 45773 - protein, 17 aa, Homo sapiens
KVDIIADAAYSIFQKPK

SEQ ID NO: 45774 - protein, 19 aa, Homo sapiens
VAHILNISPPLNLNPVWFK

SEQ ID NO: 45775 - protein, 30 aa, Homo sapiens
RLPLANMSYYVSPQAVDAVHRGLGLPLPRT

SEQ ID NO: 45776 - protein, 20 aa, Homo sapiens
DEQGFSLFPVIGAPAQNEIK

SEQ ID NO: 45777 - protein, 18 aa, Homo sapiens
KFIHNENGANYSVTATRS

SEQ ID NO: 45778 - protein, 17 aa, Homo sapiens
DSGNILQLIISAYEELR

SEQ ID NO: 45779 - protein, 18 aa, Homo sapiens
GCQLNFIENPVSQVEILK

SEQ ID NO: 45780 - protein, 27 aa, Homo sapiens
HIIIKPVGLGDALELLVSPECNCDCQK

SEQ ID NO: 45781 - protein, 17 aa, Homo sapiens
LAGIVIPNDGLCHLDSK

SEQ ID NO: 45782 - protein, 14 aa, Homo sapiens
LRPGGAQTLQVHVR

SEQ ID NO: 45783 - protein, 27 aa, Homo sapiens
QTEDYPVDLYYLMDLSASMDDDLNTIK

SEQ ID NO: 45784 - protein, 23 aa, Homo sapiens
RSEVELEVLGDTEGLNLSFTAIC

SEQ ID NO: 45785 - protein, 14 aa, Homo sapiens
SCIECHLSAAGQAR

SEQ ID NO: 45786 - protein, 18 aa, Homo sapiens
VGDTASFSVTVNIPHCER

SEQ ID NO: 45787 - protein, 10 aa, Homo sapiens
WQTGTNPLYR

SEQ ID NO: 45788 - protein, 12 aa, Homo sapiens
AKQEELEAALQR

SEQ ID NO: 45789 - protein, 10 aa, Homo sapiens
FETLQAQAGK

SEQ ID NO: 45790 - protein, 13 aa, Homo sapiens
LPDIFEAQIAGLR

SEQ ID NO: 45791 - protein, 12 aa, Homo sapiens
SLDLDGIIAEVK

SEQ ID NO: 45792 - protein, 27 aa, Homo sapiens
TLNETELTELQSQISDTSVVLSMDNSR

SEQ ID NO: 45793 - protein, 12 aa, Homo sapiens
VDALNDEINFLR

SEQ ID NO: 45794 - protein, 13 aa, Homo sapiens
KTGIYQVLNGSRL

SEQ ID NO: 45795 - protein, 17 aa, Homo sapiens
ADHPPAEVTSHAASGAK

SEQ ID NO: 45796 - protein, 17 aa, Homo sapiens
AVSKQSSSTNYTNELKA

SEQ ID NO: 45797 - protein, 18 aa, Homo sapiens
ENVPPGPEVCITHQEGEK

SEQ ID NO: 45798 - protein, 13 aa, Homo sapiens
GNYDEGFGHRPHK

SEQ ID NO: 45799 - protein, 12 aa, Homo sapiens
IYCKPHFNQLFK

SEQ ID NO: 45800 - protein, 14 aa, Homo sapiens
LLANQQVFHISCFR

SEQ ID NO: 45801 - protein, 11 aa, Homo sapiens
PKWPPEDEISK

SEQ ID NO: 45802 - protein, 13 aa, Homo sapiens
RSNTENLSQHFRK

SEQ ID NO: 45803 - protein, 16 aa, Homo sapiens
SRPFTVAASFQSTSVK

SEQ ID NO: 45804 - protein, 15 aa, Homo sapiens
VSKQSSSTNYTNELK

SEQ ID NO: 45805 - protein, 9 aa, Homo sapiens
YYDEDEDEE

SEQ ID NO: 45806 - protein, 19 aa, Homo sapiens
AAGQQQPPREPPAAPGAWR

SEQ ID NO: 45807 - protein, 22 aa, Homo sapiens
APPAAGQQQPPREPPAAPGAWR

SEQ ID NO: 45808 - protein, 11 aa, Homo sapiens
HWFQAGYSTSR

SEQ ID NO: 45809 - protein, 20 aa, Homo sapiens
PAAGQQQPPREPPAAPGAWR

SEQ ID NO: 45810 - protein, 19 aa, Homo sapiens
RDPGAAVPGAANASAQQPR

SEQ ID NO: 45811 - protein, 20 aa, Homo sapiens
RRDPGAAVPGAANASAQQPR

SEQ ID NO: 45812 - protein, 7 aa, Homo sapiens
TPILLIR

SEQ ID NO: 45813 - protein, 17 aa, Homo sapiens
AVLLSPDLQAEEWSCLR

SEQ ID NO: 45814 - protein, 11 aa, Homo sapiens
DVAGLYEEIWK

SEQ ID NO: 45815 - protein, 8 aa, Homo sapiens
FEDESFDR

SEQ ID NO: 45816 - protein, 10 aa, Homo sapiens
FTSQPGYIGR

SEQ ID NO: 45817 - protein, 23 aa, Homo sapiens
LVYQITTSSESLSDPSQLNLYMR

SEQ ID NO: 45818 - protein, 15 aa, Homo sapiens
WNPNVNWFVGGGSIR

SEQ ID NO: 45819 - protein, 38 aa, Homo sapiens
RNGVNFSLAVVVIYLILLTAGAGLLVVQVLNLQARLRV

SEQ ID NO: 45820 - protein, 14 aa, Homo sapiens
RVDNFTQNPGMFRI

SEQ ID NO: 45821 - protein, 12 aa, Homo sapiens
VDNFTQNPGMFR

SEQ ID NO: 45822 - protein, 9 aa, Homo sapiens
VSHEHLLQR

SEQ ID NO: 45823 - protein, 15 aa, Homo sapiens
KPQGQWAEDVLGNKT

SEQ ID NO: 45824 - protein, 13 aa, Homo sapiens
CELARANSTSDEL

SEQ ID NO: 45825 - protein, 16 aa, Homo sapiens
DILQSCQTSEECELAR

SEQ ID NO: 45826 - protein, 11 aa, Homo sapiens
DKEPLTAYNYK

SEQ ID NO: 45827 - protein, 14 aa, Homo sapiens
DPVASSLSPYFGTK

SEQ ID NO: 45828 - protein, 19 aa, Homo sapiens
FLTEVEKNATALYHVEAFK

SEQ ID NO: 45829 - protein, 9 aa, Homo sapiens
GYGYTINSR

SEQ ID NO: 45830 - protein, 21 aa, Homo sapiens
KFLTEVEKNATALYHVEAFKT

SEQ ID NO: 45831 - protein, 11 aa, Homo sapiens
LASLFPALFSR

SEQ ID NO: 45832 - protein, 9 aa, Homo sapiens
RANSTSDEL

SEQ ID NO: 45833 - protein, 15 aa, Homo sapiens
SSCTLFQDIFQHLDK

SEQ ID NO: 45834 - protein, 9 aa, Homo sapiens
VLEYLNDLK

SEQ ID NO: 45835 - protein, 18 aa, Homo sapiens
VLPLAYSQETVSFYEDLK

SEQ ID NO: 45836 - protein, 22 aa, Homo sapiens
VLPLAYSQETVSFYEDLKNHYK

SEQ ID NO: 45837 - protein, 8 aa, Homo sapiens
VQMLLNEK

SEQ ID NO: 45838 - protein, 17 aa, Homo sapiens
YEDVNPVLLSGPEAPWR

SEQ ID NO: 45839 - protein, 26 aa, Homo sapiens
AVEGPSTVLTTAVMTDLPVISNILSR

SEQ ID NO: 45840 - protein, 16 aa, Homo sapiens
PLTGHLLEVCQHPNSR

SEQ ID NO: 45841 - protein, 26 aa, Homo sapiens
KGKICMIVNISQCYLAYDETLNVLKF

SEQ ID NO: 45842 - protein, 12 aa, Homo sapiens
ALGGLACDLPGR

SEQ ID NO: 45843 - protein, 12 aa, Homo sapiens
GLLPVLGQPIIR

SEQ ID NO: 45844 - protein, 14 aa, Homo sapiens
IQSFLGGAPTEDLK

SEQ ID NO: 45845 - protein, 18 aa, Homo sapiens
KALSQQNVSMDLATFMKL

SEQ ID NO: 45846 - protein, 16 aa, Homo sapiens
LRTDAVLPLTVAEVQK

SEQ ID NO: 45847 - protein, 13 aa, Homo sapiens
RKWNVTSLETLKA

SEQ ID NO: 45848 - protein, 15 aa, Homo sapiens
VNAIPFTYEQLDVLK

SEQ ID NO: 45849 - protein, 18 aa, Homo sapiens
LITLADHICQIITQDFAR

SEQ ID NO: 45850 - protein, 17 aa, Homo sapiens
VPGTANTSVVTSGETRR

SEQ ID NO: 45851 - protein, 17 aa, Homo sapiens
KEFNFNLGEMNKSNMKT

SEQ ID NO: 45852 - protein, 18 aa, Homo sapiens
AEDSGEYHCVYHFVSAPK

SEQ ID NO: 45853 - protein, 18 aa, Homo sapiens
CNATNAIGSASVVTVLRV

SEQ ID NO: 45854 - protein, 10 aa, Homo sapiens
KANATIEVKA

SEQ ID NO: 45855 - protein, 16 aa, Homo sapiens
KENGMPMDIVNTSGRF

SEQ ID NO: 45856 - protein, 10 aa, Homo sapiens
KNASNMEYRI

SEQ ID NO: 45857 - protein, 29 aa, Homo sapiens
LTGDAFELYCDVVGSPTPEIQWWYAEVNR

SEQ ID NO: 45858 - protein, 12 aa, Homo sapiens
SVGYPHPDWIWR

SEQ ID NO: 45859 - protein, 11 aa, Homo sapiens
APAAHPEGQLK

SEQ ID NO: 45860 - protein, 13 aa, Homo sapiens
AQRLSQETEALGR

SEQ ID NO: 45861 - protein, 10 aa, Homo sapiens
ELDFVSHHVR

SEQ ID NO: 45862 - protein, 12 aa, Homo sapiens
ELQQAVLHMEQR

SEQ ID NO: 45863 - protein, 13 aa, Homo sapiens
ELQQAVLHMEQRK

SEQ ID NO: 45864 - protein, 22 aa, Homo sapiens
KQQQQQQQGHKAPAAHPEGQLK

SEQ ID NO: 45865 - protein, 10 aa, Homo sapiens
LPEVEVPQHL

SEQ ID NO: 45866 - protein, 13 aa, Homo sapiens
LQAANAEDIKSGK

SEQ ID NO: 45867 - protein, 10 aa, Homo sapiens
LSQETEALGR

SEQ ID NO: 45868 - protein, 13 aa, Homo sapiens
LVTLEEFLASTQR

SEQ ID NO: 45869 - protein, 9 aa, Homo sapiens
RFEEELAAR

SEQ ID NO: 45870 - protein, 25 aa, Homo sapiens
TFFILHDINSDGVLDEQELEALFTK

SEQ ID NO: 45871 - protein, 8 aa, Homo sapiens
TKLDELKR

SEQ ID NO: 45872 - protein, 13 aa, Homo sapiens
TKLDELKRQEVSR

SEQ ID NO: 45873 - protein, 11 aa, Homo sapiens
VNVPGSQAQLK

SEQ ID NO: 45874 - protein, 9 aa, Homo sapiens
YEMLKEHER

SEQ ID NO: 45875 - protein, 16 aa, Homo sapiens
ACDGNVDHAATHITNR

SEQ ID NO: 45876 - protein, 21 aa, Homo sapiens
EYGIALPCLLDADKYFCECCR

SEQ ID NO: 45877 - protein, 14 aa, Homo sapiens
HSLDASQGTATGPR

SEQ ID NO: 45878 - protein, 19 aa, Homo sapiens
STVPHAYATADCDLGAVLK

SEQ ID NO: 45879 - protein, 14 aa, Homo sapiens
IPGAPPANFTIQKE

SEQ ID NO: 45880 - protein, 14 aa, Homo sapiens
KDDVLFYNISSMKS

SEQ ID NO: 45881 - protein, 21 aa, Homo sapiens
KEGKPFYQMTSNATQAFWTKQ

SEQ ID NO: 45882 - protein, 9 aa, Homo sapiens
KVLENSTKN

SEQ ID NO: 45883 - protein, 31 aa, Homo sapiens
KVSSIVVNITELFSKPELESSFTHLDQGERL

SEQ ID NO: 45884 - protein, 11 aa, Homo sapiens
RVNCSVPEEKA

SEQ ID NO: 45885 - protein, 17 aa, Homo sapiens
EIFLSQPILLELEAPLK

SEQ ID NO: 45886 - protein, 10 aa, Homo sapiens
GNHECASINR

SEQ ID NO: 45887 - protein, 8 aa, Homo sapiens
HDLDLICR

SEQ ID NO: 45888 - protein, 14 aa, Homo sapiens
ICGDIHGQYTDLLR

SEQ ID NO: 45889 - protein, 19 aa, Homo sapiens
IFCCHGGLSPDLQSMEQIR

SEQ ID NO: 45890 - protein, 11 aa, Homo sapiens
IKYPENFFLLR

SEQ ID NO: 45891 - protein, 33 aa, Homo sapiens
IMRPTDVPDTGLLCDLLWSDPDKDVQGWGENDR

SEQ ID NO: 45892 - protein, 13 aa, Homo sapiens
QSLETICLLLAYK

SEQ ID NO: 45893 - protein, 18 aa, Homo sapiens
TFTDCFNCLPIAAIVDEK

SEQ ID NO: 45894 - protein, 12 aa, Homo sapiens
AVENSSTAIGIR

SEQ ID NO: 45895 - protein, 9 aa, Homo sapiens
DGVVFGVEK

SEQ ID NO: 45896 - protein, 7 aa, Homo sapiens
EEASNFR

SEQ ID NO: 45897 - protein, 14 aa, Homo sapiens
HVGMAVAGLLADAR

SEQ ID NO: 45898 - protein, 10 aa, Homo sapiens
IIYIVHDEVK

SEQ ID NO: 45899 - protein, 12 aa, Homo sapiens
IIYIVHDEVKDK

SEQ ID NO: 45900 - protein, 9 aa, Homo sapiens
LYEEGSNKR

SEQ ID NO: 45901 - protein, 10 aa, Homo sapiens
SNFGYNIPLK

SEQ ID NO: 45902 - protein, 9 aa, Homo sapiens
VFQVEYAMK

SEQ ID NO: 45903 - protein, 23 aa, Homo sapiens
FSAQPPPSLQWLFEDETPITNRS

SEQ ID NO: 45904 - protein, 28 aa, Homo sapiens
GHELVLANIAESDAGVYTCHAANLAGQR

SEQ ID NO: 45905 - protein, 24 aa, Homo sapiens
KPQDSQLEEGKPGYLDCLTQATPK

SEQ ID NO: 45906 - protein, 12 aa, Homo sapiens
LQDSGTFQCVAR

SEQ ID NO: 45907 - protein, 17 aa, Homo sapiens
RATVFANGSLLLTQVRP

SEQ ID NO: 45908 - protein, 19 aa, Homo sapiens
RDGTPLSDGQSNHTVSSKE

SEQ ID NO: 45909 - protein, 23 aa, Homo sapiens
RMHIFQNGSLVIHDVAPEDSGRY

SEQ ID NO: 45910 - protein, 17 aa, Homo sapiens
RQDVNITVATVPSWLKK

SEQ ID NO: 45911 - protein, 11 aa, Homo sapiens
RSANASFNIKW

SEQ ID NO: 45912 - protein, 24 aa, Homo sapiens
HAVDSLFNTTFVCTVTNAVGMGRA

SEQ ID NO: 45913 - protein, 21 aa, Homo sapiens
HGLTVEDEGNYTCEFATFPKG

SEQ ID NO: 45914 - protein, 12 aa, Homo sapiens
INVNEIFYDLVR

SEQ ID NO: 45915 - protein, 11 aa, Homo sapiens
LVVLGSGGVGK

SEQ ID NO: 45916 - protein, 16 aa, Homo sapiens
MREYKLVVLGSGGVGK

SEQ ID NO: 45917 - protein, 24 aa, Homo sapiens
NGQGFALVYSITAQSTFNDLQDLR

SEQ ID NO: 45918 - protein, 13 aa, Homo sapiens
QWNNCAFLESSAK

SEQ ID NO: 45919 - protein, 29 aa, Homo sapiens
GAEVKFVLKHQNVSEFASSSGGSQLLFKQ

SEQ ID NO: 45920 - protein, 9 aa, Homo sapiens
AELNEFLTR

SEQ ID NO: 45921 - protein, 13 aa, Homo sapiens
DEILPTTPISEQK

SEQ ID NO: 45922 - protein, 13 aa, Homo sapiens
ELAEDGYSGVEVR

SEQ ID NO: 45923 - protein, 14 aa, Homo sapiens
FGFPEGSVELYAEK

SEQ ID NO: 45924 - protein, 8 aa, Homo sapiens
FVADGIFK

SEQ ID NO: 45925 - protein, 22 aa, Homo sapiens
FVDGLMIHSGDPVNYYVDTAVR

SEQ ID NO: 45926 - protein, 9 aa, Homo sapiens
GCEVVVSGK

SEQ ID NO: 45927 - protein, 16 aa, Homo sapiens
GGKPEPPAMPQPVPTA

SEQ ID NO: 45928 - protein, 12 aa, Homo sapiens
GLCAIAQAESLR

SEQ ID NO: 45929 - protein, 13 aa, Homo sapiens
KPLPDHVSIVEPK

SEQ ID NO: 45930 - protein, 19 aa, Homo sapiens
DLNKNCTVTVTLGDERGRV

SEQ ID NO: 45931 - protein, 22 aa, Homo sapiens
DMVVMLLSLLEGNVVNGTIGKQ

SEQ ID NO: 45932 - protein, 22 aa, Homo sapiens
KVDPETNKNITRGQSLDNLIKV

SEQ ID NO: 45933 - protein, 21 aa, Homo sapiens
RNNQSQDLENLIKVIPSALRN

SEQ ID NO: 45934 - protein, 16 aa, Homo sapiens
ALTDAGCNLNPLQYIK

SEQ ID NO: 45935 - protein, 17 aa, Homo sapiens
HILYGCSELFNATQFIK

SEQ ID NO: 45936 - protein, 17 aa, Homo sapiens
LIDLHTNVATAVLEHIK

SEQ ID NO: 45937 - protein, 19 aa, Homo sapiens
VNLEESSGVENSPAGARPK

SEQ ID NO: 45938 - protein, 15 aa, Homo sapiens
ECELLLQECAHQTTK

SEQ ID NO: 45939 - protein, 20 aa, Homo sapiens
ENVQDVLPALPNPDDYFLLR

SEQ ID NO: 45940 - protein, 22 aa, Homo sapiens
FRENVQDVLPALPNPDDYFLLR

SEQ ID NO: 45941 - protein, 18 aa, Homo sapiens
GSSHQVEYEILFPGCVLR

SEQ ID NO: 45942 - protein, 17 aa, Homo sapiens
KVETITIIYDCEGLGLK

SEQ ID NO: 45943 - protein, 11 aa, Homo sapiens
QQYEHSVQISR

SEQ ID NO: 45944 - protein, 23 aa, Homo sapiens
YNSHLVPEDGTLTCSDPGIYVLR

SEQ ID NO: 45945 - protein, 23 aa, Homo sapiens
KMYSEGSDIVPQSNETALHYFKK

SEQ ID NO: 45946 - protein, 15 aa, Homo sapiens
REASIVGENETYPRA

SEQ ID NO: 45947 - protein, 20 aa, Homo sapiens
DKLESEMEDAYHEHQANLLR

SEQ ID NO: 45948 - protein, 14 aa, Homo sapiens
FAQHGTFEYEYSQR

SEQ ID NO: 45949 - protein, 11 aa, Homo sapiens
FATHAAALSVR

SEQ ID NO: 45950 - protein, 16 aa, Homo sapiens
LFVGNLPADITEDEFK

SEQ ID NO: 45951 - protein, 17 aa, Homo sapiens
LFVGNLPADITEDEFKR

SEQ ID NO: 45952 - protein, 23 aa, Homo sapiens
NLSPYVSNELLEEAFSQFGPIER

SEQ ID NO: 45953 - protein, 19 aa, Homo sapiens
PGGGPGLSTPGGHPKPPHR

SEQ ID NO: 45954 - protein, 19 aa, Homo sapiens
PVIVEPLEQLDDEDGLPEK

SEQ ID NO: 45955 - protein, 11 aa, Homo sapiens
YGEPGEVFINK

SEQ ID NO: 45956 - protein, 18 aa, Homo sapiens
ALALPPLGLAPLLNLWAK

SEQ ID NO: 45957 - protein, 9 aa, Homo sapiens
DDWFMLGLR

SEQ ID NO: 45958 - protein, 22 aa, Homo sapiens
DGRPEIQLHNHWAQLTVGAGPR

SEQ ID NO: 45959 - protein, 19 aa, Homo sapiens
DIPQPHAEPWAFSLDLGLK

SEQ ID NO: 45960 - protein, 21 aa, Homo sapiens
GPLATSRLLLLLLLLLLRHTR

SEQ ID NO: 45961 - protein, 14 aa, Homo sapiens
IALGGLLFPASNLR

SEQ ID NO: 45962 - protein, 9 aa, Homo sapiens
LDVDQALNR

SEQ ID NO: 45963 - protein, 12 aa, Homo sapiens
LPLVPALDGCLR

SEQ ID NO: 45964 - protein, 17 aa, Homo sapiens
MEGDSVLLEVDGEEVLR

SEQ ID NO: 45965 - protein, 24 aa, Homo sapiens
PPAVHLSNGPGQEPIAVMTFDLTK

SEQ ID NO: 45966 - protein, 28 aa, Homo sapiens
QAAGSGHLLALGTPENPSWLSLHLQDQK

SEQ ID NO: 45967 - protein, 13 aa, Homo sapiens
QAEISASAPTSLR

SEQ ID NO: 45968 - protein, 9 aa, Homo sapiens
QVSGPLTSK

SEQ ID NO: 45969 - protein, 11 aa, Homo sapiens
RLDVDQALNRS

SEQ ID NO: 45970 - protein, 22 aa, Homo sapiens
RSHEIWTHSCPQSPGNGTDASH

SEQ ID NO: 45971 - protein, 23 aa, Homo sapiens
SCDVESNPGIFLPPGTQAEFNLR

SEQ ID NO: 45972 - protein, 20 aa, Homo sapiens
SHEIWTHSCPQSPGNGTDAS

SEQ ID NO: 45973 - protein, 21 aa, Homo sapiens
SHEIWTHSCPQSPGNGTDASH

SEQ ID NO: 45974 - protein, 8 aa, Homo sapiens
TSSSFEVR

SEQ ID NO: 45975 - protein, 16 aa, Homo sapiens
TWDPEGVIFYGDTNPK

SEQ ID NO: 45976 - protein, 8 aa, Homo sapiens
VVLSQGSK

SEQ ID NO: 45977 - protein, 24 aa, Homo sapiens
VVLSSGSGPGLDLPLVLGLPLQLK

SEQ ID NO: 45978 - protein, 7 aa, Homo sapiens
WHQVEVK

SEQ ID NO: 45979 - protein, 13 aa, Homo sapiens
KDNITAHNISWRN

SEQ ID NO: 45980 - protein, 12 aa, Homo sapiens
NPSNETLAQWKK

SEQ ID NO: 45981 - protein, 15 aa, Homo sapiens
RSCILNGTVMLDMRA

SEQ ID NO: 45982 - protein, 22 aa, Homo sapiens
RDCSCIPQNLSSGFGHATAGKC

SEQ ID NO: 45983 - protein, 27 aa, Homo sapiens
KASPSENNAGGGSPSSGSGGNPTNTSG

SEQ ID NO: 45984 - protein, 13 aa, Homo sapiens
HMNLILCDCDEFR

SEQ ID NO: 45985 - protein, 14 aa, Homo sapiens
HMNLILCDCDEFRK

SEQ ID NO: 45986 - protein, 13 aa, Homo sapiens
PPMGPPMGIPPGR

SEQ ID NO: 45987 - protein, 20 aa, Homo sapiens
AAHIFFTDTCPEPLFSELGR

SEQ ID NO: 45988 - protein, 30 aa, Homo sapiens
EIHLAFLPYEAQVFSLDAPHSTYNLYCPFR

SEQ ID NO: 45989 - protein, 16 aa, Homo sapiens
LIVPVLLDAAVPAYDK

SEQ ID NO: 45990 - protein, 18 aa, Homo sapiens
MSDILAEGITIVEDINKR

SEQ ID NO: 45991 - protein, 18 aa, Homo sapiens
REPIPSLEAIYLLSPTEK

SEQ ID NO: 45992 - protein, 20 aa, Homo sapiens
SQLLIMDRAADPVSPLLHEL

SEQ ID NO: 45993 - protein, 13 aa, Homo sapiens
YSTHLHLADDCMK

SEQ ID NO: 45994 - protein, 17 aa, Homo sapiens
GSVHFALHYEPGAAELR

SEQ ID NO: 45995 - protein, 13 aa, Homo sapiens
VHVIQCQGLAAAR

SEQ ID NO: 45996 - protein, 20 aa, Homo sapiens
ILYENNVITIDLVQNSSQKT

SEQ ID NO: 45997 - protein, 21 aa, Homo sapiens
KAKQCNGTSTCWCVNTAGVRR

SEQ ID NO: 45998 - protein, 18 aa, Homo sapiens
KLAAKCLVMKAEMNGSKL

SEQ ID NO: 45999 - protein, 23 aa, Homo sapiens
KLRKEQLKEELNENQSTPKKEKQ

SEQ ID NO: 46000 - protein, 25 aa, Homo sapiens
KSVSTSSPAGAAIASTSGASNNSSS

SEQ ID NO: 46001 - protein, 14 aa, Homo sapiens
ITGPDNKGIYKGDR

SEQ ID NO: 46002 - protein, 23 aa, Homo sapiens
LKKTETQEKNTLPTKETIEQEKR

SEQ ID NO: 46003 - protein, 27 aa, Homo sapiens
LKKTETQEKNTLPTKETIEQEKRSEIS

SEQ ID NO: 46004 - protein, 19 aa, Homo sapiens
LLNGPGDVETGTSITVPQK

SEQ ID NO: 46005 - protein, 25 aa, Homo sapiens
NKEPPAPAQQLQPQPVAVQGPEPAR

SEQ ID NO: 46006 - protein, 24 aa, Homo sapiens
GNLECLNAILIHGVDITTSDTAGR

SEQ ID NO: 46007 - protein, 16 aa, Homo sapiens
KLLKEQAHNLTIEMKN

SEQ ID NO: 46008 - protein, 13 aa, Homo sapiens
KYEEVCEEVLHAK

SEQ ID NO: 46009 - protein, 16 aa, Homo sapiens
LLQYNCPTEHADLQGR

SEQ ID NO: 46010 - protein, 29 aa, Homo sapiens
MMSNQYVPVKTHEEVKMTLNDTLAKTNRE

SEQ ID NO: 46011 - protein, 28 aa, Homo sapiens
RLSSSGSNCSSGSEGEPVALHAGICVRQ

SEQ ID NO: 46012 - protein, 16 aa, Homo sapiens
TQTSAFSRIMKLCEEK

SEQ ID NO: 46013 - protein, 10 aa, Homo sapiens
YQEETSFAEK

SEQ ID NO: 46014 - protein, 23 aa, Homo sapiens
AVCGFHLGYLDGEVELVSGVVAR

SEQ ID NO: 46015 - protein, 21 aa, Homo sapiens
ENGVTHPIDYHTTDYVDEIKK

SEQ ID NO: 46016 - protein, 16 aa, Homo sapiens
GVDIVMDPLGGSDTAK

SEQ ID NO: 46017 - protein, 13 aa, Homo sapiens
IKPHIDSVWPFEK

SEQ ID NO: 46018 - protein, 11 aa, Homo sapiens
VLLVPGPEKEN

SEQ ID NO: 46019 - protein, 14 aa, Homo sapiens
VVTYGMANLLTGPK

SEQ ID NO: 46020 - protein, 8 aa, Homo sapiens
EMTLASNR

SEQ ID NO: 46021 - protein, 26 aa, Homo sapiens
LPELAPTAPLPYPAPEASGPPAVAPR

SEQ ID NO: 46022 - protein, 11 aa, Homo sapiens
MEETQNVQLNK

SEQ ID NO: 46023 - protein, 17 aa, Homo sapiens
SLAEGNLLYQPQLDTLK

SEQ ID NO: 46024 - protein, 7 aa, Homo sapiens
QLFCDEK

SEQ ID NO: 46025 - protein, 13 aa, Homo sapiens
QLFCDEKQTTLKK

SEQ ID NO: 46026 - protein, 18 aa, Homo sapiens
TAANNLSVSNSASSLQKD

SEQ ID NO: 46027 - protein, 7 aa, Homo sapiens
ENITYLK

SEQ ID NO: 46028 - protein, 19 aa, Homo sapiens
SFQNNDIDTGWLDYLIAEK

SEQ ID NO: 46029 - protein, 14 aa, Homo sapiens
FYNQQNHYDGSTGK

SEQ ID NO: 46030 - protein, 15 aa, Homo sapiens
GDIGETGVPGAEGPR

SEQ ID NO: 46031 - protein, 15 aa, Homo sapiens
IFYNQQNHYDGSTGK

SEQ ID NO: 46032 - protein, 16 aa, Homo sapiens
NGLYADNDNDSTFTGF

SEQ ID NO: 46033 - protein, 23 aa, Homo sapiens
NGLYADNDNDSTFTGFLLYHDTN

SEQ ID NO: 46034 - protein, 19 aa, Homo sapiens
SAFSVGLETYVTIPNMPIR

SEQ ID NO: 46035 - protein, 16 aa, Homo sapiens
SVGLETYVTIPNMPIR

SEQ ID NO: 46036 - protein, 13 aa, Homo sapiens
YNQQNHYDGSTGK

SEQ ID NO: 46037 - protein, 16 aa, Homo sapiens
FKEDFFQSGEIGGHCK

SEQ ID NO: 46038 - protein, 14 aa, Homo sapiens
LPEEHIPFFLHNNR

SEQ ID NO: 46039 - protein, 19 aa, Homo sapiens
ATLAALETMDTGKPFLHAF

SEQ ID NO: 46040 - protein, 28 aa, Homo sapiens
ATLAALETMDTGKPFLHAFFIDLEGCIR

SEQ ID NO: 46041 - protein, 31 aa, Homo sapiens
EAGFPPGVVNIVPGFGPTVGAAISSHPQINK

SEQ ID NO: 46042 - protein, 12 aa, Homo sapiens
EEIFGPVQPILK

SEQ ID NO: 46043 - protein, 9 aa, Homo sapiens
FATCNPSTR

SEQ ID NO: 46044 - protein, 23 aa, Homo sapiens
FATCNPSTREQICEVEEGDKPDV

SEQ ID NO: 46045 - protein, 17 aa, Homo sapiens
GLFIKPTVFSEVTDNMR

SEQ ID NO: 46046 - protein, 23 aa, Homo sapiens
HEPIGVCGAITPWNFPLLMLVWK

SEQ ID NO: 46047 - protein, 10 aa, Homo sapiens
KPPALPRPIR

SEQ ID NO: 46048 - protein, 11 aa, Homo sapiens
KRPVGDPFDVK

SEQ ID NO: 46049 - protein, 31 aa, Homo sapiens
LAPALCCGNTMVLKPAEQTPLTALYLGSLIK

SEQ ID NO: 46050 - protein, 28 aa, Homo sapiens
LASALESGTVWINCYNALYAQAPFGGFK

SEQ ID NO: 46051 - protein, 11 aa, Homo sapiens
LLHQLADLVER

SEQ ID NO: 46052 - protein, 35 aa, Homo sapiens
NPCIVCADADLDLAVECAHQGVFFNQGQCCTAASR

SEQ ID NO: 46053 - protein, 13 aa, Homo sapiens
RPVGDPFDVKTEQ

SEQ ID NO: 46054 - protein, 13 aa, Homo sapiens
TIPTDDNVVCFTR

SEQ ID NO: 46055 - protein, 22 aa, Homo sapiens
TMVLKPAEQTPLTALYLGSLIK

SEQ ID NO: 46056 - protein, 13 aa, Homo sapiens
VFVEEQVYSEFVR

SEQ ID NO: 46057 - protein, 18 aa, Homo sapiens
CQMKEAEHMYQNEQDNVN

SEQ ID NO: 46058 - protein, 13 aa, Homo sapiens
ETSEKFTWAAKGR

SEQ ID NO: 46059 - protein, 10 aa, Homo sapiens
ITIDIHFLER

SEQ ID NO: 46060 - protein, 15 aa, Homo sapiens
PSAFEPAIEMQKSVP

SEQ ID NO: 46061 - protein, 10 aa, Homo sapiens
QKSVPNKALE

SEQ ID NO: 46062 - protein, 15 aa, Homo sapiens
ALGSDHCPITLYLAL

SEQ ID NO: 46063 - protein, 13 aa, Homo sapiens
EEAPDILCLQETK

SEQ ID NO: 46064 - protein, 19 aa, Homo sapiens
GLDWVKEEAPDILCLQETK

SEQ ID NO: 46065 - protein, 10 aa, Homo sapiens
ICSWNVDGLR

SEQ ID NO: 46066 - protein, 19 aa, Homo sapiens
KPLVLCGDLNVAHEEIDLR

SEQ ID NO: 46067 - protein, 18 aa, Homo sapiens
LDYFLLSHSLLPALCDSK

SEQ ID NO: 46068 - protein, 22 aa, Homo sapiens
LPAELQELPGLSHQYWSAPSDK

SEQ ID NO: 46069 - protein, 17 aa, Homo sapiens
QGFGELLQAVPLADSFR

SEQ ID NO: 46070 - protein, 16 aa, Homo sapiens
VLCGDLNVAHEEIDLR

SEQ ID NO: 46071 - protein, 10 aa, Homo sapiens
DLDMFINASK

SEQ ID NO: 46072 - protein, 10 aa, Homo sapiens
IMQSSQSMSK

SEQ ID NO: 46073 - protein, 24 aa, Homo sapiens
KAATCINPLNGSVCERPANHSAKQ

SEQ ID NO: 46074 - protein, 34 aa, Homo sapiens
KAVVNGNIMWVVGGYMFNHSDYNMVLAYDLASRE

SEQ ID NO: 46075 - protein, 11 aa, Homo sapiens
KCINQSICEKC

SEQ ID NO: 46076 - protein, 19 aa, Homo sapiens
KCINQSICEKCENLTTGKH

SEQ ID NO: 46077 - protein, 14 aa, Homo sapiens
KIDSTGNVTNELRV

SEQ ID NO: 46078 - protein, 19 aa, Homo sapiens
KISNSSDTVECECSENWKG

SEQ ID NO: 46079 - protein, 28 aa, Homo sapiens
KMPSQAPTGNFYPQPLLNSSMCLEDSRY

SEQ ID NO: 46080 - protein, 7 aa, Homo sapiens
KVEFVLK

SEQ ID NO: 46081 - protein, 7 aa, Homo sapiens
LADDLYR

SEQ ID NO: 46082 - protein, 16 aa, Homo sapiens
LTGSSGFVTDGPGNYK

SEQ ID NO: 46083 - protein, 10 aa, Homo sapiens
LTLTPWVGLR

SEQ ID NO: 46084 - protein, 13 aa, Homo sapiens
NHNALLASLTTQK

SEQ ID NO: 46085 - protein, 12 aa, Homo sapiens
RDLDMFINASKN

SEQ ID NO: 46086 - protein, 9 aa, Homo sapiens
REWLPLNRS

SEQ ID NO: 46087 - protein, 15 aa, Homo sapiens
RFGHSAVLHNSTMYV

SEQ ID NO: 46088 - protein, 28 aa, Homo sapiens
RGCSCFSDWQGPGCSVPVPANQSFWTRE

SEQ ID NO: 46089 - protein, 11 aa, Homo sapiens
RGICNSSDVRG

SEQ ID NO: 46090 - protein, 21 aa, Homo sapiens
RNHPNITFFVYVSNFTWPIKI

SEQ ID NO: 46091 - protein, 15 aa, Homo sapiens
RNHSCSEGQISIFRY

SEQ ID NO: 46092 - protein, 17 aa, Homo sapiens
RVFHIHNESWVLLTPKA

SEQ ID NO: 46093 - protein, 32 aa, Homo sapiens
RYLHTAVIVSGTMLVFGGNTHNDTSMSHGAKC

SEQ ID NO: 46094 - protein, 20 aa, Homo sapiens
RYNWSFIHCPACQCNGHSKC

SEQ ID NO: 46095 - protein, 13 aa, Homo sapiens
SEAACLAAGPGIR

SEQ ID NO: 46096 - protein, 8 aa, Homo sapiens
SVNNVVVR

SEQ ID NO: 46097 - protein, 12 aa, Homo sapiens
YDVDTQMWTILK

SEQ ID NO: 46098 - protein, 9 aa, Homo sapiens
YGHSLALYK

SEQ ID NO: 46099 - protein, 16 aa, Homo sapiens
AAAAAAVSGSAAAEAK

SEQ ID NO: 46100 - protein, 22 aa, Homo sapiens
AATCINPLNGSVCERPANHSAK

SEQ ID NO: 46101 - protein, 8 aa, Homo sapiens
AFSANKYR

SEQ ID NO: 46102 - protein, 9 aa, Homo sapiens
ALYVHGGYK

SEQ ID NO: 46103 - protein, 17 aa, Homo sapiens
ALYVHGGYKAFSANKYR

SEQ ID NO: 46104 - protein, 15 aa, Homo sapiens
CFSSDFMAYDIACDR

SEQ ID NO: 46105 - protein, 7 aa, Homo sapiens
CIEGSYK

SEQ ID NO: 46106 - protein, 11 aa, Homo sapiens
CIEGSYKGPVK

SEQ ID NO: 46107 - protein, 14 aa, Homo sapiens
CNGHASLCNTNTGK

SEQ ID NO: 46108 - protein, 25 aa, Homo sapiens
CNPGTGQCVCPAGWVGEQCQHCGGR

SEQ ID NO: 46109 - protein, 11 aa, Homo sapiens
CTWLIEGQPNR

SEQ ID NO: 46110 - protein, 23 aa, Homo sapiens
CVWNTGSSQCISWALATDEQEEK

SEQ ID NO: 46111 - protein, 9 aa, Homo sapiens
DNPMYYCNK

SEQ ID NO: 46112 - protein, 11 aa, Homo sapiens
ECDRPCVNGGR

SEQ ID NO: 46113 - protein, 7 aa, Homo sapiens
EEYSNLK

SEQ ID NO: 46114 - protein, 10 aa, Homo sapiens
EEYSNLKLPR

SEQ ID NO: 46115 - protein, 16 aa, Homo sapiens
EQYAVVGHSAHIVTLK

SEQ ID NO: 46116 - protein, 14 aa, Homo sapiens
EYKDSFSNEKFDFR

SEQ ID NO: 46117 - protein, 18 aa, Homo sapiens
FRLTGSSGFVTDGPGNYK

SEQ ID NO: 46118 - protein, 26 aa, Homo sapiens
GCSCFSDWQGPGCSVPVPANQSFWTR

SEQ ID NO: 46119 - protein, 12 aa, Homo sapiens
GDECQLCEVENR

SEQ ID NO: 46120 - protein, 18 aa, Homo sapiens
GEACDIPHCTDNCGFPHR

SEQ ID NO: 46121 - protein, 9 aa, Homo sapiens
GICNSSDVR

SEQ ID NO: 46122 - protein, 15 aa, Homo sapiens
GVKGDECQLCEVENR

SEQ ID NO: 46123 - protein, 18 aa, Homo sapiens
HCETCISGFYGDPTNGGK

SEQ ID NO: 46124 - protein, 12 aa, Homo sapiens
IDSTGNVTNELR

SEQ ID NO: 46125 - protein, 13 aa, Homo sapiens
ISGFYGDPTNGGK

SEQ ID NO: 46126 - protein, 11 aa, Homo sapiens
ISNVQEYDLDK

SEQ ID NO: 46127 - protein, 12 aa, Homo sapiens
ITTAKENYDNAK

SEQ ID NO: 46128 - protein, 7 aa, Homo sapiens
IYMYGGK

SEQ ID NO: 46129 - protein, 8 aa, Homo sapiens
LKSECFSK

SEQ ID NO: 46130 - protein, 18 aa, Homo sapiens
LTGSSGFVTDGPGNYKYK

SEQ ID NO: 46131 - protein, 11 aa, Homo sapiens
LTLTPWVGLRK

SEQ ID NO: 46132 - protein, 26 aa, Homo sapiens
MPSQAPTGNFYPQPLLNSSMCLEDSR

SEQ ID NO: 46133 - protein, 14 aa, Homo sapiens
NGSVCERPANHSAK

SEQ ID NO: 46134 - protein, 13 aa, Homo sapiens
NHSCSEGQISIFR

SEQ ID NO: 46135 - protein, 25 aa, Homo sapiens
NQECIALPENICGIGWHLVGNSCLK

SEQ ID NO: 46136 - protein, 19 aa, Homo sapiens
NTWSILHTQGALVQGGYGH

SEQ ID NO: 46137 - protein, 26 aa, Homo sapiens
NTWSILHTQGALVQGGYGHSSVYDHR

SEQ ID NO: 46138 - protein, 9 aa, Homo sapiens
PDLHHDVNR

SEQ ID NO: 46139 - protein, 15 aa, Homo sapiens
SAGTQAGEEMPVVSK

SEQ ID NO: 46140 - protein, 13 aa, Homo sapiens
SCALDQNCQWEPR

SEQ ID NO: 46141 - protein, 17 aa, Homo sapiens
SFSAGTQAGEEMPVVSK

SEQ ID NO: 46142 - protein, 13 aa, Homo sapiens
TKCTWLIEGQPNR

SEQ ID NO: 46143 - protein, 12 aa, Homo sapiens
VAAFSGLIVPER

SEQ ID NO: 46144 - protein, 6 aa, Homo sapiens
VEFVLK

SEQ ID NO: 46145 - protein, 15 aa, Homo sapiens
VFHIHNESWVLLTPK

SEQ ID NO: 46146 - protein, 9 aa, Homo sapiens
VVMLVIFGH

SEQ ID NO: 46147 - protein, 26 aa, Homo sapiens
VVMLVIFGHCPLYGYISNVQEYDLDK

SEQ ID NO: 46148 - protein, 15 aa, Homo sapiens
WSVLPRPDLHHDVNR

SEQ ID NO: 46149 - protein, 11 aa, Homo sapiens
YGHSLALYKDK

SEQ ID NO: 46150 - protein, 18 aa, Homo sapiens
YGHSLALYKDKIYMYGGK

SEQ ID NO: 46151 - protein, 14 aa, Homo sapiens
YGYISNVQEYDLDK

SEQ ID NO: 46152 - protein, 18 aa, Homo sapiens
YNWSFIHCPACQCNGHSK

SEQ ID NO: 46153 - protein, 7 aa, Homo sapiens
YQGNPLR

SEQ ID NO: 46154 - protein, 16 aa, Homo sapiens
YYTAINFVATPDEQNR

SEQ ID NO: 46155 - protein, 11 aa, Homo sapiens
AGDPILTYFPK

SEQ ID NO: 46156 - protein, 34 aa, Homo sapiens
KVNATNFQALAAEFGGESFTSTFQTQSPPSFYRA

SEQ ID NO: 46157 - protein, 12 aa, Homo sapiens
TVFSFCLPGSVR

SEQ ID NO: 46158 - protein, 9 aa, Homo sapiens
RIVNDTYRT

SEQ ID NO: 46159 - protein, 8 aa, Homo sapiens
IEVSQLLK

SEQ ID NO: 46160 - protein, 21 aa, Homo sapiens
KSDAVSHTGNYTCEVTELTRE

SEQ ID NO: 46161 - protein, 33 aa, Homo sapiens
KSVEFTFCNDTVVIPCFVTNMEAQNTTEVYVKW

SEQ ID NO: 46162 - protein, 13 aa, Homo sapiens
RDIYTFDGALNKS

SEQ ID NO: 46163 - protein, 33 aa, Homo sapiens
AAGELGIAVCNIPSAAVEETADSTICHILNLYR

SEQ ID NO: 46164 - protein, 19 aa, Homo sapiens
DLATVAFCDAQSTQEIHEK

SEQ ID NO: 46165 - protein, 12 aa, Homo sapiens
LVSSENFDDYMK

SEQ ID NO: 46166 - protein, 21 aa, Homo sapiens
NTEISFILGQEFDEVTADDRK

SEQ ID NO: 46167 - protein, 34 aa, Homo sapiens
AQEALDAVSTLEEGHAQYLTSLADASALVAALTR

SEQ ID NO: 46168 - protein, 36 aa, Homo sapiens
IQQDTGIPEEDQELLQEAGLALIPDKPATQCISDGK

SEQ ID NO: 46169 - protein, 25 aa, Homo sapiens
KSEELVAEAHNLCTLLENAIQDTVR

SEQ ID NO: 46170 - protein, 24 aa, Homo sapiens
SEELVAEAHNLCTLLENAIQDTVR

SEQ ID NO: 46171 - protein, 20 aa, Homo sapiens
AVIHPDYDAASHDQDIMLLR

SEQ ID NO: 46172 - protein, 13 aa, Homo sapiens
GLVSWGNIPCGSK

SEQ ID NO: 46173 - protein, 10 aa, Homo sapiens
KPNLQVFLGK

SEQ ID NO: 46174 - protein, 18 aa, Homo sapiens
LARPAKLSELIQPLPLER

SEQ ID NO: 46175 - protein, 12 aa, Homo sapiens
LSELIQPLPLER

SEQ ID NO: 46176 - protein, 16 aa, Homo sapiens
PDYDAASHDQDIMLLR

SEQ ID NO: 46177 - protein, 13 aa, Homo sapiens
QRESSQEQSSVVR

SEQ ID NO: 46178 - protein, 18 aa, Homo sapiens
RDCSANTTSCHILGWGKT

SEQ ID NO: 46179 - protein, 7 aa, Homo sapiens
YTNWIQK

SEQ ID NO: 46180 - protein, 11 aa, Homo sapiens
ADLEMQIESLK

SEQ ID NO: 46181 - protein, 18 aa, Homo sapiens
ADLEMQIESLKEELAYLK

SEQ ID NO: 46182 - protein, 12 aa, Homo sapiens
AGGDGLLVGSEK

SEQ ID NO: 46183 - protein, 15 aa, Homo sapiens
APSTYGGGLSVSSSR

SEQ ID NO: 46184 - protein, 11 aa, Homo sapiens
ASLENSLEETK

SEQ ID NO: 46185 - protein, 13 aa, Homo sapiens
ASLENSLEETKGR

SEQ ID NO: 46186 - protein, 9 aa, Homo sapiens
DAEEWFFTK

SEQ ID NO: 46187 - protein, 7 aa, Homo sapiens
DYSPYFK

SEQ ID NO: 46188 - protein, 13 aa, Homo sapiens
EVATNSELVQSGK

SEQ ID NO: 46189 - protein, 20 aa, Homo sapiens
EVATNSELVQSGKSEISELR

SEQ ID NO: 46190 - protein, 16 aa, Homo sapiens
GGGFAGGDGLLVGSEK

SEQ ID NO: 46191 - protein, 21 aa, Homo sapiens
GQVGGDVNVEMDAAPGVDLSR

SEQ ID NO: 46192 - protein, 15 aa, Homo sapiens
GSCGIGGGIGGGSSR

SEQ ID NO: 46193 - protein, 12 aa, Homo sapiens
IGSVEEQLAQLR

SEQ ID NO: 46194 - protein, 19 aa, Homo sapiens
ILTATVDNANVLLQIDNAR

SEQ ID NO: 46195 - protein, 11 aa, Homo sapiens
ISSVLAGGSCR

SEQ ID NO: 46196 - protein, 10 aa, Homo sapiens
KDAEEWFFTK

SEQ ID NO: 46197 - protein, 7 aa, Homo sapiens
LAADDFR

SEQ ID NO: 46198 - protein, 7 aa, Homo sapiens
LASYLDK

SEQ ID NO: 46199 - protein, 9 aa, Homo sapiens
LASYLDKVR

SEQ ID NO: 46200 - protein, 14 aa, Homo sapiens
LLEGEDAHLSSSQF

SEQ ID NO: 46201 - protein, 19 aa, Homo sapiens
LLEGEDAHLSSSQFSSGSQ

SEQ ID NO: 46202 - protein, 22 aa, Homo sapiens
LLEGEDAHLSSSQFSSGSQSSR

SEQ ID NO: 46203 - protein, 29 aa, Homo sapiens
LLEGEDAHLSSSQFSSGSQSSRDVTSSSR

SEQ ID NO: 46204 - protein, 11 aa, Homo sapiens
MSVEADINGLR

SEQ ID NO: 46205 - protein, 10 aa, Homo sapiens
NHEEEMNALR

SEQ ID NO: 46206 - protein, 19 aa, Homo sapiens
TEELNREVATNSELVQSGK

SEQ ID NO: 46207 - protein, 16 aa, Homo sapiens
TMQNLEIELQSQLSMK

SEQ ID NO: 46208 - protein, 12 aa, Homo sapiens
TRLEQEIATYRR

SEQ ID NO: 46209 - protein, 9 aa, Homo sapiens
VLDELTLAR

SEQ ID NO: 46210 - protein, 9 aa, Homo sapiens
VTMQNLNDR

SEQ ID NO: 46211 - protein, 10 aa, Homo sapiens
VVSTHEQVLR

SEQ ID NO: 46212 - protein, 23 aa, Homo sapiens
YCMQLAQIQEMIGSVEEQLAQLR

SEQ ID NO: 46213 - protein, 17 aa, Homo sapiens
ATGGGLSSVGGGSSTIK

SEQ ID NO: 46214 - protein, 26 aa, Homo sapiens
ATGGGLSSVGGGSSTIKYTTTSSSSR

SEQ ID NO: 46215 - protein, 9 aa, Homo sapiens
MASTSTTIR

SEQ ID NO: 46216 - protein, 10 aa, Homo sapiens
NMQDLVEDLK

SEQ ID NO: 46217 - protein, 17 aa, Homo sapiens
QSLLTPLNLQIDPAIQR

SEQ ID NO: 46218 - protein, 10 aa, Homo sapiens
SGFSSISVSR

SEQ ID NO: 46219 - protein, 11 aa, Homo sapiens
NANTFISPQQR

SEQ ID NO: 46220 - protein, 12 aa, Homo sapiens
RNANTFISPQQR

SEQ ID NO: 46221 - protein, 9 aa, Homo sapiens
SKPVHELNR

SEQ ID NO: 46222 - protein, 13 aa, Homo sapiens
YAMVYGYNAAYNR

SEQ ID NO: 46223 - protein, 18 aa, Homo sapiens
YESHESMESYELNPFINR

SEQ ID NO: 46224 - protein, 19 aa, Homo sapiens
YESHESMESYELNPFINRR

SEQ ID NO: 46225 - protein, 11 aa, Homo sapiens
ADFCIIHYAGK

SEQ ID NO: 46226 - protein, 11 aa, Homo sapiens
AGVLAHLEEER

SEQ ID NO: 46227 - protein, 21 aa, Homo sapiens
DAASLESQLQDTQELLQEETR

SEQ ID NO: 46228 - protein, 13 aa, Homo sapiens
DKADFCIIHYAGK

SEQ ID NO: 46229 - protein, 27 aa, Homo sapiens
DLSEELEALKTELEDTLDTTAAQQELR

SEQ ID NO: 46230 - protein, 15 aa, Homo sapiens
EDQSILCTGESGAGK

SEQ ID NO: 46231 - protein, 23 aa, Homo sapiens
EGIEWNFIDFGLDLQPCIDLIER

SEQ ID NO: 46232 - protein, 16 aa, Homo sapiens
HATALEELSEQLEQAK

SEQ ID NO: 46233 - protein, 10 aa, Homo sapiens
KFDQLLAEEK

SEQ ID NO: 46234 - protein, 24 aa, Homo sapiens
KLDGETTDLQDQIAELQAQIDELK

SEQ ID NO: 46235 - protein, 14 aa, Homo sapiens
KQELEEILHDLESR

SEQ ID NO: 46236 - protein, 23 aa, Homo sapiens
LDGETTDLQDQIAELQAQIDELK

SEQ ID NO: 46237 - protein, 11 aa, Homo sapiens
LDPHLVLDQLR

SEQ ID NO: 46238 - protein, 19 aa, Homo sapiens
LQQLFNHTMFILEQEEYQR

SEQ ID NO: 46239 - protein, 19 aa, Homo sapiens
PANPPGVLALLDEECWFPK

SEQ ID NO: 46240 - protein, 16 aa, Homo sapiens
QVRELEAELEDERKQR

SEQ ID NO: 46241 - protein, 18 aa, Homo sapiens
SLEAEILQLQEELASSER

SEQ ID NO: 46242 - protein, 17 aa, Homo sapiens
TQLEELEDELQATEDAK

SEQ ID NO: 46243 - protein, 20 aa, Homo sapiens
VEDMAELTCLNEASVLHNLK

SEQ ID NO: 46244 - protein, 15 aa, Homo sapiens
DILYIGDHIFGDILK

SEQ ID NO: 46245 - protein, 29 aa, Homo sapiens
IGTYTGPLQHGIVYSGGSSDTICDLLGAK

SEQ ID NO: 46246 - protein, 14 aa, Homo sapiens
IPELAQELHVWTDK

SEQ ID NO: 46247 - protein, 19 aa, Homo sapiens
SSLFEELQSLDIFLAELYK

SEQ ID NO: 46248 - protein, 18 aa, Homo sapiens
TFLVIPELAQELHVWTDK

SEQ ID NO: 46249 - protein, 11 aa, Homo sapiens
AQDIQCGLQSR

SEQ ID NO: 46250 - protein, 31 aa, Homo sapiens
SGVVPCGTPWGQWYQTLEEVFIEVQVPPGTR

SEQ ID NO: 46251 - protein, 31 aa, Homo sapiens
VNLSLIFIIALGSIAGILFVTMIFVAIKCKR

SEQ ID NO: 46252 - protein, 18 aa, Homo sapiens
AKPSLLSRVGALTNTLSR

SEQ ID NO: 46253 - protein, 14 aa, Homo sapiens
VLHLTPAPAVSSTK

SEQ ID NO: 46254 - protein, 32 aa, Homo sapiens
YKPLNDSVRAQYSNWLLAGNLALSPTGNAKKP

SEQ ID NO: 46255 - protein, 11 aa, Homo sapiens
DFMIQGGDFTR

SEQ ID NO: 46256 - protein, 14 aa, Homo sapiens
DKPLKDVIIADCGK

SEQ ID NO: 46257 - protein, 13 aa, Homo sapiens
DTNGSQFFITTVK

SEQ ID NO: 46258 - protein, 9 aa, Homo sapiens
DVIIADCGK

SEQ ID NO: 46259 - protein, 7 aa, Homo sapiens
FPDENFK

SEQ ID NO: 46260 - protein, 6 aa, Homo sapiens
HVVFGK

SEQ ID NO: 46261 - protein, 14 aa, Homo sapiens
HYGPGWVSMANAGK

SEQ ID NO: 46262 - protein, 11 aa, Homo sapiens
IEVEKPFAIAK

SEQ ID NO: 46263 - protein, 8 aa, Homo sapiens
IGDEDVGR

SEQ ID NO: 46264 - protein, 15 aa, Homo sapiens
KDTNGSQFFITTVKT

SEQ ID NO: 46265 - protein, 13 aa, Homo sapiens
SIYGERFPDENFK

SEQ ID NO: 46266 - protein, 7 aa, Homo sapiens
TAWLDGK

SEQ ID NO: 46267 - protein, 13 aa, Homo sapiens
TVDNFVALATGEK

SEQ ID NO: 46268 - protein, 8 aa, Homo sapiens
VIFGLFGK

SEQ ID NO: 46269 - protein, 14 aa, Homo sapiens
VIKDFMIQGGDFTR

SEQ ID NO: 46270 - protein, 9 aa, Homo sapiens
VLEGMEVVR

SEQ ID NO: 46271 - protein, 9 aa, Homo sapiens
AVLCPPPVK

SEQ ID NO: 46272 - protein, 14 aa, Homo sapiens
HHCPNTPIILVGTK

SEQ ID NO: 46273 - protein, 16 aa, Homo sapiens
LRPLSYPQTDVFLICF

SEQ ID NO: 46274 - protein, 14 aa, Homo sapiens
LTPITYPQGLAMAK

SEQ ID NO: 46275 - protein, 8 aa, Homo sapiens
TVFDEAIR

SEQ ID NO: 46276 - protein, 10 aa, Homo sapiens
YLECSALTQR

SEQ ID NO: 46277 - protein, 20 aa, Homo sapiens
RVLELNASDERGIQVVREKV

SEQ ID NO: 46278 - protein, 15 aa, Homo sapiens
AYSDMREANYIGSDK

SEQ ID NO: 46279 - protein, 19 aa, Homo sapiens
AYSDMREANYIGSDKYFHA

SEQ ID NO: 46280 - protein, 20 aa, Homo sapiens
AYSDMREANYIGSDKYFHAR

SEQ ID NO: 46281 - protein, 27 aa, Homo sapiens
AYSDMREANYIGSDKYFHARGNYDAAK

SEQ ID NO: 46282 - protein, 10 aa, Homo sapiens
DMWRAYSDMR

SEQ ID NO: 46283 - protein, 14 aa, Homo sapiens
DPNHFRPAGLPEKY

SEQ ID NO: 46284 - protein, 14 aa, Homo sapiens
EANYIGSDKYFHAR

SEQ ID NO: 46285 - protein, 21 aa, Homo sapiens
EANYIGSDKYFHARGNYDAAK

SEQ ID NO: 46286 - protein, 25 aa, Homo sapiens
ENIQRFFGHGAEDSLADQAANEWGR

SEQ ID NO: 46287 - protein, 14 aa, Homo sapiens
FFGHGAEDSLADQA

SEQ ID NO: 46288 - protein, 20 aa, Homo sapiens
FFGHGAEDSLADQAANEWGR

SEQ ID NO: 46289 - protein, 13 aa, Homo sapiens
FFSFLGEAFDGAR

SEQ ID NO: 46290 - protein, 19 aa, Homo sapiens
FGHGAEDSLADQAANEWGR

SEQ ID NO: 46291 - protein, 10 aa, Homo sapiens
FLGEAFDGAR

SEQ ID NO: 46292 - protein, 9 aa, Homo sapiens
FRPAGLPEK

SEQ ID NO: 46293 - protein, 12 aa, Homo sapiens
FSFLGEAFDGAR

SEQ ID NO: 46294 - protein, 11 aa, Homo sapiens
HFRPAGLPEKY

SEQ ID NO: 46295 - protein, 9 aa, Homo sapiens
LGEAFDGAR

SEQ ID NO: 46296 - protein, 12 aa, Homo sapiens
NYIGSDKYFHAR

SEQ ID NO: 46297 - protein, 13 aa, Homo sapiens
PNHFRPAGLPEKY

SEQ ID NO: 46298 - protein, 15 aa, Homo sapiens
REANYIGSDKYFHAR

SEQ ID NO: 46299 - protein, 9 aa, Homo sapiens
RPAGLPEKY

SEQ ID NO: 46300 - protein, 15 aa, Homo sapiens
RSFFSFLGEAFDGAR

SEQ ID NO: 46301 - protein, 10 aa, Homo sapiens
SFFSFLGEAF

SEQ ID NO: 46302 - protein, 14 aa, Homo sapiens
SFFSFLGEAFDGAR

SEQ ID NO: 46303 - protein, 11 aa, Homo sapiens
SFLGEAFDGAR

SEQ ID NO: 46304 - protein, 16 aa, Homo sapiens
SGKDPNHFRPAGLPEK

SEQ ID NO: 46305 - protein, 17 aa, Homo sapiens
SGKDPNHFRPAGLPEKY

SEQ ID NO: 46306 - protein, 12 aa, Homo sapiens
SLADQAANEWGR

SEQ ID NO: 46307 - protein, 19 aa, Homo sapiens
YSDMREANYIGSDKYFHAR

SEQ ID NO: 46308 - protein, 14 aa, Homo sapiens
DCHHLGIQNNFDYK

SEQ ID NO: 46309 - protein, 16 aa, Homo sapiens
ENEITGALLPCLDESR

SEQ ID NO: 46310 - protein, 16 aa, Homo sapiens
FEHSLGVGYLAGCLVH

SEQ ID NO: 46311 - protein, 21 aa, Homo sapiens
FEHSLGVGYLAGCLVHALGEK

SEQ ID NO: 46312 - protein, 18 aa, Homo sapiens
KKEWNDSTSVQNPTRLRE

SEQ ID NO: 46313 - protein, 11 aa, Homo sapiens
NPIDHVSFYCK

SEQ ID NO: 46314 - protein, 18 aa, Homo sapiens
VINDPIHGHIELHPLLVR

SEQ ID NO: 46315 - protein, 19 aa, Homo sapiens
DHSASFSNSSYLQNQLLKR

SEQ ID NO: 46316 - protein, 30 aa, Homo sapiens
KRSPIFFNYLYSPLEIEALKPNVNVSSLKK

SEQ ID NO: 46317 - protein, 35 aa, Homo sapiens
RACLGLIYTVYVDSLNVSLESLIANLCACLVPAAG

SEQ ID NO: 46318 - protein, 8 aa, Homo sapiens
SYPGLLVV

SEQ ID NO: 46319 - protein, 12 aa, Homo sapiens
TLPAALRALKGK

SEQ ID NO: 46320 - protein, 20 aa, Homo sapiens
AGTATSPAGSSPAVAGGTQR

SEQ ID NO: 46321 - protein, 24 aa, Homo sapiens
CFLAQPVTLLDIYTHWQQTSELGR

SEQ ID NO: 46322 - protein, 12 aa, Homo sapiens
ELLPLIYHHLLR

SEQ ID NO: 46323 - protein, 19 aa, Homo sapiens
SPAGPAATPAQAQAASTPR

SEQ ID NO: 46324 - protein, 27 aa, Homo sapiens
TQPSSGVDSAVGTLPATSPQSTSVQAK

SEQ ID NO: 46325 - protein, 12 aa, Homo sapiens
VGPATPSAQVGK

SEQ ID NO: 46326 - protein, 17 aa, Homo sapiens
TVLEHYALEDDPLAAFK

SEQ ID NO: 46327 - protein, 7 aa, Homo sapiens
VVVVDCK

SEQ ID NO: 46328 - protein, 13 aa, Homo sapiens
KLHNLTTGTPARY

SEQ ID NO: 46329 - protein, 26 aa, Homo sapiens
LQTANESAYAIYDFFQVASSKERYKL

SEQ ID NO: 46330 - protein, 20 aa, Homo sapiens
KNNFNGSLVQASYQHEELRR

SEQ ID NO: 46331 - protein, 27 aa, Homo sapiens
RLLNLSLNSEVVLDQDAIDVIIHVARN

SEQ ID NO: 46332 - protein, 19 aa, Homo sapiens
EQQEPSSGGSVVPTVQEPK

SEQ ID NO: 46333 - protein, 28 aa, Homo sapiens
NVEDMVQFINNILDGTVEAQGGDSILQR

SEQ ID NO: 46334 - protein, 11 aa, Homo sapiens
TKDDIIEFAHR

SEQ ID NO: 46335 - protein, 13 aa, Homo sapiens
SCGINSLHTLPTR

SEQ ID NO: 46336 - protein, 14 aa, Homo sapiens
VQNLLGHYLIHGFR

SEQ ID NO: 46337 - protein, 23 aa, Homo sapiens
EEPWVDPNSPVLLEDPVLCALAK

SEQ ID NO: 46338 - protein, 19 aa, Homo sapiens
HIDSAHLYNNEEQVGLAIR

SEQ ID NO: 46339 - protein, 17 aa, Homo sapiens
ILFDTVDLCATWEAVEK

SEQ ID NO: 46340 - protein, 22 aa, Homo sapiens
LNDGHFMPVLGFGTYAPAEVPK

SEQ ID NO: 46341 - protein, 17 aa, Homo sapiens
LWCNSHRPELVRPALER

SEQ ID NO: 46342 - protein, 19 aa, Homo sapiens
NLQLDYVDLYLIHFPVSVK

SEQ ID NO: 46343 - protein, 27 aa, Homo sapiens
NLQLDYVDLYLIHFPVSVKPGEEVIPK

SEQ ID NO: 46344 - protein, 15 aa, Homo sapiens
PVCNQVECHPYFNQR

SEQ ID NO: 46345 - protein, 9 aa, Homo sapiens
REDIFYTSK

SEQ ID NO: 46346 - protein, 16 aa, Homo sapiens
SKDIVLVAYSALGSHR

SEQ ID NO: 46347 - protein, 8 aa, Homo sapiens
TPALIALR

SEQ ID NO: 46348 - protein, 20 aa, Homo sapiens
WVDPNSPVLLEDPVLCALAK

SEQ ID NO: 46349 - protein, 13 aa, Homo sapiens
YKPVCNQVECHPY

SEQ ID NO: 46350 - protein, 17 aa, Homo sapiens
YKPVCNQVECHPYFNQR

SEQ ID NO: 46351 - protein, 27 aa, Homo sapiens
LAIEAGFHHIDSAHVYNNEEQVGLAIR

SEQ ID NO: 46352 - protein, 17 aa, Homo sapiens
LWSNSHRPELVRPALER

SEQ ID NO: 46353 - protein, 12 aa, Homo sapiens
ALVFVDNHDNQR

SEQ ID NO: 46354 - protein, 13 aa, Homo sapiens
NWGEGWGFMPSDR

SEQ ID NO: 46355 - protein, 16 aa, Homo sapiens
TGSGDIENYNDATQVR

SEQ ID NO: 46356 - protein, 33 aa, Homo sapiens
EGILQYCQEVYPELQITNVVEANQPVTIQNWCK

SEQ ID NO: 46357 - protein, 10 aa, Homo sapiens
HDSGYEVHHQ

SEQ ID NO: 46358 - protein, 16 aa, Homo sapiens
ISYGNDALMPSLTETK

SEQ ID NO: 46359 - protein, 19 aa, Homo sapiens
KEQNYSDDVLANMISEPRI

SEQ ID NO: 46360 - protein, 18 aa, Homo sapiens
LALENYITALQAVPPRPR

SEQ ID NO: 46361 - protein, 23 aa, Homo sapiens
LEVPTDGNAGLLAEPQIAMFCGR

SEQ ID NO: 46362 - protein, 20 aa, Homo sapiens
LNMHMNVQNGKWDSDPSGTK

SEQ ID NO: 46363 - protein, 12 aa, Homo sapiens
LVFFAEDVGSNK

SEQ ID NO: 46364 - protein, 15 aa, Homo sapiens
MDVCETHLHWHTVAK

SEQ ID NO: 46365 - protein, 13 aa, Homo sapiens
MSQVMREWEEAER

SEQ ID NO: 46366 - protein, 30 aa, Homo sapiens
RMNQSLSLLYNVPAVAEEIQDEVDELLQKE

SEQ ID NO: 46367 - protein, 8 aa, Homo sapiens
SQVMTHLR

SEQ ID NO: 46368 - protein, 19 aa, Homo sapiens
STNLHDYGMLLPCGIDKFR

SEQ ID NO: 46369 - protein, 10 aa, Homo sapiens
THPHFVIPYR

SEQ ID NO: 46370 - protein, 12 aa, Homo sapiens
VESLEQEAANER

SEQ ID NO: 46371 - protein, 9 aa, Homo sapiens
WYFDVTEGK

SEQ ID NO: 46372 - protein, 17 aa, Homo sapiens
ECLQHPGGATPVCVYTR

SEQ ID NO: 46373 - protein, 17 aa, Homo sapiens
GTTLQSLGLTGGSATIR

SEQ ID NO: 46374 - protein, 21 aa, Homo sapiens
LQAWPAELPDEFFELTVDDVR

SEQ ID NO: 46375 - protein, 16 aa, Homo sapiens
VTPSTVLLQVLEDTCR

SEQ ID NO: 46376 - protein, 16 aa, Homo sapiens
KYFWNDTIHNFDFLKG

SEQ ID NO: 46377 - protein, 26 aa, Homo sapiens
RLMPLEAGIPDPPNMSAELIQLKAKE

SEQ ID NO: 46378 - protein, 12 aa, Homo sapiens
ADNSSDSPTTLK

SEQ ID NO: 46379 - protein, 18 aa, Homo sapiens
HQPGLLLQQKPPDDPVVK

SEQ ID NO: 46380 - protein, 15 aa, Homo sapiens
TQKGELLPNPSSDRK

SEQ ID NO: 46381 - protein, 11 aa, Homo sapiens
VNIVKGNENPR

SEQ ID NO: 46382 - protein, 15 aa, Homo sapiens
KNMETPSTSNVSGRV

SEQ ID NO: 46383 - protein, 19 aa, Homo sapiens
MTNTSYSEPAQNSKLSLKQ

SEQ ID NO: 46384 - protein, 15 aa, Homo sapiens
RINYTDPFSNQTVKS

SEQ ID NO: 46385 - protein, 14 aa, Homo sapiens
AHQLVLPPCDVVIK

SEQ ID NO: 46386 - protein, 18 aa, Homo sapiens
EKTPLIDLCDGQADQAAK

SEQ ID NO: 46387 - protein, 13 aa, Homo sapiens
HCPSAVVPVELQK

SEQ ID NO: 46388 - protein, 18 aa, Homo sapiens
TCNTNPHLNALSTDSACR

SEQ ID NO: 46389 - protein, 18 aa, Homo sapiens
VAAASGHCGAFSGSDSSR

SEQ ID NO: 46390 - protein, 13 aa, Homo sapiens
FLLLGLRPFIPEK

SEQ ID NO: 46391 - protein, 17 aa, Homo sapiens
KPGIVSPFKRVFLKGEK

SEQ ID NO: 46392 - protein, 12 aa, Homo sapiens
ATISNDGATILK

SEQ ID NO: 46393 - protein, 27 aa, Homo sapiens
EGTDSSQGIPQLVSNISACQVIAEAVR

SEQ ID NO: 46394 - protein, 22 aa, Homo sapiens
INALTAASEAACLIVSVDETIK

SEQ ID NO: 46395 - protein, 10 aa, Homo sapiens
LLDVVHPAAK

SEQ ID NO: 46396 - protein, 14 aa, Homo sapiens
LPIGDVATQYFADR

SEQ ID NO: 46397 - protein, 16 aa, Homo sapiens
MVVDAVMMLDDLLQLK

SEQ ID NO: 46398 - protein, 17 aa, Homo sapiens
NDSVVAGGGAIEMELSK

SEQ ID NO: 46399 - protein, 18 aa, Homo sapiens
PQLVSNISACQVIAEAVR

SEQ ID NO: 46400 - protein, 16 aa, Homo sapiens
QLCDNAGFDATNILNK

SEQ ID NO: 46401 - protein, 17 aa, Homo sapiens
QVKPYVEEGLHPQIIIR

SEQ ID NO: 46402 - protein, 10 aa, Homo sapiens
SLHDAIMIVR

SEQ ID NO: 46403 - protein, 22 aa, Homo sapiens
SQDAEVGDGTTSVTLLAAEFLK

SEQ ID NO: 46404 - protein, 9 aa, Homo sapiens
TATQLAVNK

SEQ ID NO: 46405 - protein, 7 aa, Homo sapiens
TCTFILR

SEQ ID NO: 46406 - protein, 21 aa, Homo sapiens
VHTVEDYQAIVDAEWNILYDK

SEQ ID NO: 46407 - protein, 9 aa, Homo sapiens
YNFFTGCPK

SEQ ID NO: 46408 - protein, 18 aa, Homo sapiens
AAAGVQPHSLDLSHNSLR

SEQ ID NO: 46409 - protein, 17 aa, Homo sapiens
AAGVQPHSLDLSHNSLR

SEQ ID NO: 46410 - protein, 19 aa, Homo sapiens
AFPALTSLDLSDNPGLGER

SEQ ID NO: 46411 - protein, 20 aa, Homo sapiens
APQPDELPEVDNLTLDGNPF

SEQ ID NO: 46412 - protein, 9 aa, Homo sapiens
ATVNPSAPR

SEQ ID NO: 46413 - protein, 22 aa, Homo sapiens
CMWSSALNSLNLSFAGLEQVPK

SEQ ID NO: 46414 - protein, 38 aa, Homo sapiens
CMWSSALNSLNLSFAGLEQVPKGLPAKLRVLDLSCNRL

SEQ ID NO: 46415 - protein, 8 aa, Homo sapiens
ELTLEDLK

SEQ ID NO: 46416 - protein, 10 aa, Homo sapiens
FPAIQNLALR

SEQ ID NO: 46417 - protein, 10 aa, Homo sapiens
GLMAALCPHK

SEQ ID NO: 46418 - protein, 20 aa, Homo sapiens
GLMAALCPHKFPAIQNLALR

SEQ ID NO: 46419 - protein, 21 aa, Homo sapiens
ITGTMPPLPLEATGLALSSLR

SEQ ID NO: 46420 - protein, 10 aa, Homo sapiens
LKELTLEDLK

SEQ ID NO: 46421 - protein, 10 aa, Homo sapiens
LRNVSWATGR

SEQ ID NO: 46422 - protein, 18 aa, Homo sapiens
LTVGAAQVPAQLLVGALR

SEQ ID NO: 46423 - protein, 12 aa, Homo sapiens
NLSFAGLEQVPK

SEQ ID NO: 46424 - protein, 16 aa, Homo sapiens
NSLNLSFAGLEQVPKG

SEQ ID NO: 46425 - protein, 16 aa, Homo sapiens
PPLPLEATGLALSSLR

SEQ ID NO: 46426 - protein, 26 aa, Homo sapiens
PTGVCAALAAAGVQPHSLDLSHNSLR

SEQ ID NO: 46427 - protein, 24 aa, Homo sapiens
RCMWSSALNSLNLSFAGLEQVPKG

SEQ ID NO: 46428 - protein, 12 aa, Homo sapiens
RLRNVSWATGRS

SEQ ID NO: 46429 - protein, 19 aa, Homo sapiens
RLTVGAAQVPAQLLVGALR

SEQ ID NO: 46430 - protein, 10 aa, Homo sapiens
SLDLSHNSLR

SEQ ID NO: 46431 - protein, 18 aa, Homo sapiens
STLSVGVSGTLVLLQGAR

SEQ ID NO: 46432 - protein, 11 aa, Homo sapiens
SWLAELQQWLK

SEQ ID NO: 46433 - protein, 15 aa, Homo sapiens
SWLAELQQWLKPGLK

SEQ ID NO: 46434 - protein, 12 aa, Homo sapiens
VLSIAQAHSPAF

SEQ ID NO: 46435 - protein, 18 aa, Homo sapiens
VLSIAQAHSPAFSCEQVR

SEQ ID NO: 46436 - protein, 24 aa, Homo sapiens
AVPHPDSQPDTIDHDLLLLQLSEK

SEQ ID NO: 46437 - protein, 21 aa, Homo sapiens
DVAPGTLCDVAGWGIVNHAGR

SEQ ID NO: 46438 - protein, 22 aa, Homo sapiens
GDSGGPLVCGGVLEGVVTSGSR

SEQ ID NO: 46439 - protein, 13 aa, Homo sapiens
GGVLEGVVTSGSR

SEQ ID NO: 46440 - protein, 6 aa, Homo sapiens
LYDVLR

SEQ ID NO: 46441 - protein, 16 aa, Homo sapiens
PDTIDHDLLLLQLSEK

SEQ ID NO: 46442 - protein, 22 aa, Homo sapiens
PHPDSQPDTIDHDLLLLQLSEK

SEQ ID NO: 46443 - protein, 15 aa, Homo sapiens
RPDSLQHVLLPVLDR

SEQ ID NO: 46444 - protein, 10 aa, Homo sapiens
THHDGAITER

SEQ ID NO: 46445 - protein, 13 aa, Homo sapiens
VASYAAWIDSVLA

SEQ ID NO: 46446 - protein, 24 aa, Homo sapiens
VDRDVAPGTLCDVAGWGIVNHAGR

SEQ ID NO: 46447 - protein, 17 aa, Homo sapiens
VQVLLGAHSLSQPEPSK

SEQ ID NO: 46448 - protein, 18 aa, Homo sapiens
VQVLLGAHSLSQPEPSKR

SEQ ID NO: 46449 - protein, 28 aa, Homo sapiens
TLTPGGHAEHDGKPFCHKPCYATLFGPK

SEQ ID NO: 46450 - protein, 28 aa, Homo sapiens
TLTPGGHAEHDGQPYCHKPCYGILFGPK

SEQ ID NO: 46451 - protein, 14 aa, Homo sapiens
DVKPHNVMIDHEHR

SEQ ID NO: 46452 - protein, 15 aa, Homo sapiens
EPFFHGHDNYDQLVR

SEQ ID NO: 46453 - protein, 20 aa, Homo sapiens
FVHSENQHLVSPEALDFLDK

SEQ ID NO: 46454 - protein, 16 aa, Homo sapiens
KEPFFHGHDNYDQLVR

SEQ ID NO: 46455 - protein, 19 aa, Homo sapiens
LIDWGLAEFYHPGQEYNVR

SEQ ID NO: 46456 - protein, 12 aa, Homo sapiens
FHCPHCDTVIAR

SEQ ID NO: 46457 - protein, 16 aa, Homo sapiens
THSGEKPYECYICHAR

SEQ ID NO: 46458 - protein, 9 aa, Homo sapiens
YCDAVFHER

SEQ ID NO: 46459 - protein, 32 aa, Homo sapiens
DFNPNWMSAVEILDDDNFLGAENAFNLFVCQK

SEQ ID NO: 46460 - protein, 21 aa, Homo sapiens
DPNTYFIVGTAMVYPEEAEPK

SEQ ID NO: 46461 - protein, 10 aa, Homo sapiens
IAVMELFRPK

SEQ ID NO: 46462 - protein, 16 aa, Homo sapiens
ICYQEVSQCFGVLSSR

SEQ ID NO: 46463 - protein, 18 aa, Homo sapiens
IGRPSETGIIGIIDPECR

SEQ ID NO: 46464 - protein, 24 aa, Homo sapiens
KTEPATGFIDGDLIESFLDISRPK

SEQ ID NO: 46465 - protein, 15 aa, Homo sapiens
LEIYVVTAEGLRPVK

SEQ ID NO: 46466 - protein, 10 aa, Homo sapiens
LLASINSTVR

SEQ ID NO: 46467 - protein, 23 aa, Homo sapiens
SLSTTNVFACSDRPTVIYSSNHK

SEQ ID NO: 46468 - protein, 19 aa, Homo sapiens
SVLLLAYKPMEGNFEEIAR

SEQ ID NO: 46469 - protein, 23 aa, Homo sapiens
TEPATGFIDGDLIESFLDISRPK

SEQ ID NO: 46470 - protein, 11 aa, Homo sapiens
VTLGTQPTVLR

SEQ ID NO: 46471 - protein, 31 aa, Homo sapiens
QAILESPVSSCPPELANHPDAQHKPGTILTK

SEQ ID NO: 46472 - protein, 16 aa, Homo sapiens
RPAVVYIGSAGKPHER

SEQ ID NO: 46473 - protein, 30 aa, Homo sapiens
KIKRNFSSGTIPGTPGPNGEDGVEQTAIKV

SEQ ID NO: 46474 - protein, 16 aa, Homo sapiens
IFSSEDIIAQMPEEGR

SEQ ID NO: 46475 - protein, 10 aa, Homo sapiens
SVLTAAGNLK

SEQ ID NO: 46476 - protein, 21 aa, Homo sapiens
ETTYYDVLGVKPNATQEELKK

SEQ ID NO: 46477 - protein, 25 aa, Homo sapiens
ITFHGEGDQEPGLEPGDIIIVLDQK

SEQ ID NO: 46478 - protein, 19 aa, Homo sapiens
NVVHQLSVTLEDLYNGATR

SEQ ID NO: 46479 - protein, 13 aa, Homo sapiens
TIVITSHPGQIVK

SEQ ID NO: 46480 - protein, 24 aa, Homo sapiens
FACNGTVIEHPEYGEVIQLQGDQR

SEQ ID NO: 46481 - protein, 16 aa, Homo sapiens
GDDLLPAGTEDYIHIR

SEQ ID NO: 46482 - protein, 13 aa, Homo sapiens
NICQFLVEIGLAK

SEQ ID NO: 46483 - protein, 21 aa, Homo sapiens
DIETFYNTSIEEMPLNVADLI

SEQ ID NO: 46484 - protein, 35 aa, Homo sapiens
DNGPDGMEPEGVIESNWNEIVDSFDDMNLSESLLR

SEQ ID NO: 46485 - protein, 9 aa, Homo sapiens
DQIYDIFQK

SEQ ID NO: 46486 - protein, 13 aa, Homo sapiens
GVAINMVTEEDKR

SEQ ID NO: 46487 - protein, 14 aa, Homo sapiens
KGVAINMVTEEDKR

SEQ ID NO: 46488 - protein, 23 aa, Homo sapiens
LNSNTQVVLLSATMPSDVLEVTK

SEQ ID NO: 46489 - protein, 15 aa, Homo sapiens
LQMEAPHIIVGTPGR

SEQ ID NO: 46490 - protein, 17 aa, Homo sapiens
TATFAISILQQIELDLK

SEQ ID NO: 46491 - protein, 23 aa, Homo sapiens
KTFKNESENTCQDVDECQQNPRL

SEQ ID NO: 46492 - protein, 14 aa, Homo sapiens
RNLTVVNYSSINRF

SEQ ID NO: 46493 - protein, 17 aa, Homo sapiens
RWCPQDSSCVNATACRC

SEQ ID NO: 46494 - protein, 30 aa, Homo sapiens
KTFKNESENTCQDVDECSSGQHQCDSSTVC

SEQ ID NO: 46495 - protein, 33 aa, Homo sapiens
KTFKNESENTCQDMTFSTWTPPPGVHSQTLSRF

SEQ ID NO: 46496 - protein, 22 aa, Homo sapiens
RYAAVNITTNQAAPSEVPTLRL

SEQ ID NO: 46497 - protein, 27 aa, Homo sapiens
KIKDQVNGTSEDSADGSTVGTAVSSSD

SEQ ID NO: 46498 - protein, 27 aa, Homo sapiens
KQPTPIANTSSQQAVFTSARQLPSART

SEQ ID NO: 46499 - protein, 31 aa, Homo sapiens
AADVLVYLADDTVVPLAVENLPSLSAHELHR

SEQ ID NO: 46500 - protein, 18 aa, Homo sapiens
KPVSVAISLEGVHVIDSR

SEQ ID NO: 46501 - protein, 11 aa, Homo sapiens
LDSFLPAHLCK

SEQ ID NO: 46502 - protein, 20 aa, Homo sapiens
QVQEVSSDGGCEAALGTHYR

SEQ ID NO: 46503 - protein, 43 aa, Homo sapiens
KNSLSGIAMNVPASRGSNLNSSGANRTSLSGGTGSGTQGATKP

SEQ ID NO: 46504 - protein, 11 aa, Homo sapiens
DGLIVPIFQER

SEQ ID NO: 46505 - protein, 11 aa, Homo sapiens
DLVGELGTALR

SEQ ID NO: 46506 - protein, 19 aa, Homo sapiens
DNYPPGFSYADFGPQFTAR

SEQ ID NO: 46507 - protein, 17 aa, Homo sapiens
DVGPHRDLVGELGTALR

SEQ ID NO: 46508 - protein, 17 aa, Homo sapiens
FFHPEEWADLFQAAGAK

SEQ ID NO: 46509 - protein, 6 aa, Homo sapiens
FSWGYR

SEQ ID NO: 46510 - protein, 29 aa, Homo sapiens
GSAVYAIFLHWPENGVLNLESPITTSTTK

SEQ ID NO: 46511 - protein, 19 aa, Homo sapiens
HHEGFTNWPSPVSWNWNSK

SEQ ID NO: 46512 - protein, 11 aa, Homo sapiens
ITMLGIQGDLK

SEQ ID NO: 46513 - protein, 8 aa, Homo sapiens
TQHFVSAK

SEQ ID NO: 46514 - protein, 7 aa, Homo sapiens
YVVLTTK

SEQ ID NO: 46515 - protein, 16 aa, Homo sapiens
DSHQLFIGNLPHEVDK

SEQ ID NO: 46516 - protein, 18 aa, Homo sapiens
HPDSHQLFIGNLPHEVDK

SEQ ID NO: 46517 - protein, 22 aa, Homo sapiens
HPDSHQLFIGNLPHEVDKSELK

SEQ ID NO: 46518 - protein, 28 aa, Homo sapiens
HVDAHATLNDGVVVQVMGLLSNNNQALR

SEQ ID NO: 46519 - protein, 17 aa, Homo sapiens
LPNFGFVVFDDSEPVQK

SEQ ID NO: 46520 - protein, 23 aa, Homo sapiens
NSSYVHGGLDSNGKPADAVYGQK

SEQ ID NO: 46521 - protein, 15 aa, Homo sapiens
QYYTLLNQAPDMLHR

SEQ ID NO: 46522 - protein, 23 aa, Homo sapiens
VPASQPRPESKPESQIPPQRPQR

SEQ ID NO: 46523 - protein, 16 aa, Homo sapiens
AMEDPGVRDTMLQALR

SEQ ID NO: 46524 - protein, 20 aa, Homo sapiens
FSSVQLLGDLLFHISGVTGK

SEQ ID NO: 46525 - protein, 19 aa, Homo sapiens
FVHFIDAPSLALIMPIVQR

SEQ ID NO: 46526 - protein, 20 aa, Homo sapiens
GDTLLQALDLLPLLIQTVEK

SEQ ID NO: 46527 - protein, 36 aa, Homo sapiens
GDVTDTEQLAQEMLIISHHPSLVAVQSGLWPALLAR

SEQ ID NO: 46528 - protein, 16 aa, Homo sapiens
KLDAGNQLALIEELHK

SEQ ID NO: 46529 - protein, 22 aa, Homo sapiens
LFNDSSPVVLEESWDALNAITK

SEQ ID NO: 46530 - protein, 21 aa, Homo sapiens
LQELDGELEAALGLLDIILAK

SEQ ID NO: 46531 - protein, 16 aa, Homo sapiens
LVLPSLLAALEEESWR

SEQ ID NO: 46532 - protein, 29 aa, Homo sapiens
LWSMMGLDLQPDLCSLLIDDVIYHEAAVR

SEQ ID NO: 46533 - protein, 13 aa, Homo sapiens
LYRPPPVLDALGR

SEQ ID NO: 46534 - protein, 18 aa, Homo sapiens
NIVSLLLSMLGHDEDNTR

SEQ ID NO: 46535 - protein, 14 aa, Homo sapiens
NLLHSLQSSGIGSK

SEQ ID NO: 46536 - protein, 20 aa, Homo sapiens
NPEILAIAPVLLDALTDPSR

SEQ ID NO: 46537 - protein, 21 aa, Homo sapiens
NPSGLTQYIPVLVDSFLPLLK

SEQ ID NO: 46538 - protein, 23 aa, Homo sapiens
TFEQLHSTIGHQALEDILPFLLK

SEQ ID NO: 46539 - protein, 23 aa, Homo sapiens
KSRMAIWAATDHNVDNTTEIFRE

SEQ ID NO: 46540 - protein, 29 aa, Homo sapiens
HIDIDPNNAHILDGNAADLQAECDAFENK

SEQ ID NO: 46541 - protein, 16 aa, Homo sapiens
NHPESYHSYMWNNFFK

SEQ ID NO: 46542 - protein, 17 aa, Homo sapiens
YFTLGLPTGSTPLGCYK

SEQ ID NO: 46543 - protein, 19 aa, Homo sapiens
GLVVLGFPCNQFGHQENAK

SEQ ID NO: 46544 - protein, 22 aa, Homo sapiens
RFQTIDIEPDIEALLSQGPSCA

SEQ ID NO: 46545 - protein, 22 aa, Homo sapiens
RILAINSSSLKGKPLSEAIHLL

SEQ ID NO: 46546 - protein, 26 aa, Homo sapiens
EQSDFCPWYIGLPFIPYLDNLPNFNR

SEQ ID NO: 46547 - protein, 21 aa, Homo sapiens
GIEEEEILPGFILCDPNNLCH

SEQ ID NO: 46548 - protein, 24 aa, Homo sapiens
GIEEEEILPGFILCDPNNLCHSGR

SEQ ID NO: 46549 - protein, 11 aa, Homo sapiens
HFTILDAPGHK

SEQ ID NO: 46550 - protein, 25 aa, Homo sapiens
HNVEVLGILSDDVETDTVAPGENLK

SEQ ID NO: 46551 - protein, 17 aa, Homo sapiens
KDIHFMPCSGLTGANLK

SEQ ID NO: 46552 - protein, 12 aa, Homo sapiens
KHFTILDAPGHK

SEQ ID NO: 46553 - protein, 15 aa, Homo sapiens
FLTAVNLEHPEMLEK

SEQ ID NO: 46554 - protein, 21 aa, Homo sapiens
GLPITVAHVDGQTHMLFGSDR

SEQ ID NO: 46555 - protein, 11 aa, Homo sapiens
HHLQIPIHFPK

SEQ ID NO: 46556 - protein, 16 aa, Homo sapiens
NEDITEPQSILAAAEK

SEQ ID NO: 46557 - protein, 25 aa, Homo sapiens
YGAFGLPITVAHVDGQTHMLFGSDR

SEQ ID NO: 46558 - protein, 12 aa, Homo sapiens
AEVLELAGNASK

SEQ ID NO: 46559 - protein, 9 aa, Homo sapiens
AGLQFPVGR

SEQ ID NO: 46560 - protein, 11 aa, Homo sapiens
ATIAGGGVIPH

SEQ ID NO: 46561 - protein, 14 aa, Homo sapiens
ATIAGGGVIPHIHK

SEQ ID NO: 46562 - protein, 10 aa, Homo sapiens
GDEELDSLIK

SEQ ID NO: 46563 - protein, 7 aa, Homo sapiens
HLQLAIR

SEQ ID NO: 46564 - protein, 14 aa, Homo sapiens
LTAEVLELAGNASK

SEQ ID NO: 46565 - protein, 13 aa, Homo sapiens
TAEVLELAGNASK

SEQ ID NO: 46566 - protein, 29 aa, Homo sapiens
VGATAAVYSAAILEYLTAEVLELAGNASK

SEQ ID NO: 46567 - protein, 21 aa, Homo sapiens
GKPLEDQTQLLTLVCQLYQGK

SEQ ID NO: 46568 - protein, 20 aa, Homo sapiens
NAPLVNVTLYYEALCGGCRA

SEQ ID NO: 46569 - protein, 19 aa, Homo sapiens
PLEDQTQLLTLVCQLYQGK

SEQ ID NO: 46570 - protein, 33 aa, Homo sapiens
RELFPTWLLVMEILNVTLVPYGNAQEQNVSGRW

SEQ ID NO: 46571 - protein, 15 aa, Homo sapiens
KGNMSGNFTYIIDKL

SEQ ID NO: 46572 - protein, 29 aa, Homo sapiens
KTMNNSAENHTANSSMAYPSLVAMASQRQ

SEQ ID NO: 46573 - protein, 16 aa, Homo sapiens
IELHGKPIEVEHSVPK

SEQ ID NO: 46574 - protein, 13 aa, Homo sapiens
ITGHFYACQVAQR

SEQ ID NO: 46575 - protein, 20 aa, Homo sapiens
LYIGNLSENAAPSDLESIFK

SEQ ID NO: 46576 - protein, 16 aa, Homo sapiens
SITILSTPEGTSAACK

SEQ ID NO: 46577 - protein, 16 aa, Homo sapiens
TGYAFVDCPDESWALK

SEQ ID NO: 46578 - protein, 18 aa, Homo sapiens
RLQLEAVNITDLSENRKQ

SEQ ID NO: 46579 - protein, 24 aa, Homo sapiens
KQVALQTFGNQTTIIPAGGAGYKV

SEQ ID NO: 46580 - protein, 19 aa, Homo sapiens
KKLCGENDRLNHTYSQLLK

SEQ ID NO: 46581 - protein, 29 aa, Homo sapiens
KRRKELGAMAFSTTAINFSTVNSSAGFRS

SEQ ID NO: 46582 - protein, 26 aa, Homo sapiens
MNQNAQLLIQQSSLENENESVIKERE

SEQ ID NO: 46583 - protein, 28 aa, Homo sapiens
RDFLQLAGAQPQAGLSQANFTLGPVSRS

SEQ ID NO: 46584 - protein, 11 aa, Homo sapiens
FNSTEYQVVTR

SEQ ID NO: 46585 - protein, 19 aa, Homo sapiens
GIIAVANDTNSCELSPCRI

SEQ ID NO: 46586 - protein, 14 aa, Homo sapiens
IVFPHGITLDLVSR

SEQ ID NO: 46587 - protein, 14 aa, Homo sapiens
KLNLDGSNYTLLKQ

SEQ ID NO: 46588 - protein, 18 aa, Homo sapiens
KLTSCATNASICGDEARC

SEQ ID NO: 46589 - protein, 41 aa, Homo sapiens
KSDALVPVSGTSLAVGIDFHAENDTIYWVDMGLSTISRAKR

SEQ ID NO: 46590 - protein, 17 aa, Homo sapiens
NGDTCVTLLDLELYNPK

SEQ ID NO: 46591 - protein, 27 aa, Homo sapiens
RELQGNCSRLGCQHHCVPTLDGPTCYC

SEQ ID NO: 46592 - protein, 13 aa, Homo sapiens
RFNSTEYQVVTRV

SEQ ID NO: 46593 - protein, 15 aa, Homo sapiens
RGSKDNATDSVPLRT

SEQ ID NO: 46594 - protein, 13 aa, Homo sapiens
RIETILLNGTDRK

SEQ ID NO: 46595 - protein, 25 aa, Homo sapiens
RINNGGCQDLCLLTHQGHVNCSCRG

SEQ ID NO: 46596 - protein, 15 aa, Homo sapiens
RKLNLDGSNYTLLKQ

SEQ ID NO: 46597 - protein, 15 aa, Homo sapiens
RMHLNGSNVQVLHRT

SEQ ID NO: 46598 - protein, 31 aa, Homo sapiens
RQTTAMDFSYANETVCWVHVGDSAAQTQLKC

SEQ ID NO: 46599 - protein, 16 aa, Homo sapiens
RTCVSNCTASQFVCKN

SEQ ID NO: 46600 - protein, 14 aa, Homo sapiens
SCEGVTHVCDPSVK

SEQ ID NO: 46601 - protein, 26 aa, Homo sapiens
SHACENDQYGKPGGCSDICLLANSHK

SEQ ID NO: 46602 - protein, 10 aa, Homo sapiens
FMEWTQIITK

SEQ ID NO: 46603 - protein, 7 aa, Homo sapiens
KVPIFSK

SEQ ID NO: 46604 - protein, 22 aa, Homo sapiens
NNELFTTVLDMLSVLINGTLAA

SEQ ID NO: 46605 - protein, 18 aa, Homo sapiens
TLLEPEKKAPEPPKTDKP

SEQ ID NO: 46606 - protein, 11 aa, Homo sapiens
VDPFMEWTQII

SEQ ID NO: 46607 - protein, 23 aa, Homo sapiens
VRQLQQQLSNTQPQPSTNIFGRY

SEQ ID NO: 46608 - protein, 18 aa, Homo sapiens
HHGIPFYVAAPSSSCDLR

SEQ ID NO: 46609 - protein, 38 aa, Homo sapiens
IAAPGIGVWNPAFDVTPHDLITGGIITELGVFAPEELR

SEQ ID NO: 46610 - protein, 17 aa, Homo sapiens
LEHAFCTETRPYNQGAR

SEQ ID NO: 46611 - protein, 28 aa, Homo sapiens
LTAFELVYEQIPATLITDSMVAAAMAHR

SEQ ID NO: 46612 - protein, 25 aa, Homo sapiens
VTVLTHCNTGALATAGYGTALGVIR

SEQ ID NO: 46613 - protein, 15 aa, Homo sapiens
LGLGADVAQVTGALR

SEQ ID NO: 46614 - protein, 9 aa, Homo sapiens
QLAEEYLYR

SEQ ID NO: 46615 - protein, 12 aa, Homo sapiens
QSTLVLFPGDLR

SEQ ID NO: 46616 - protein, 11 aa, Homo sapiens
SLGPALLLLQK

SEQ ID NO: 46617 - protein, 7 aa, Homo sapiens
WQPLVLV

SEQ ID NO: 46618 - protein, 22 aa, Homo sapiens
KHFGEFFNLNQTVQSTIEDIKV

SEQ ID NO: 46619 - protein, 23 aa, Homo sapiens
MFNQDIEKLVEGEEVVRENETRL

SEQ ID NO: 46620 - protein, 11 aa, Homo sapiens
EALEHLCTYEK

SEQ ID NO: 46621 - protein, 28 aa, Homo sapiens
IGQPSIALEYINTAIESTPTLIELFLVK

SEQ ID NO: 46622 - protein, 16 aa, Homo sapiens
LAVEETKGELLLQLCR

SEQ ID NO: 46623 - protein, 10 aa, Homo sapiens
LFNTAVCESK

SEQ ID NO: 46624 - protein, 21 aa, Homo sapiens
NLQTCMEVLEALYDGSLGDCK

SEQ ID NO: 46625 - protein, 11 aa, Homo sapiens
RLPLNFLSGEK

SEQ ID NO: 46626 - protein, 15 aa, Homo sapiens
VIACDGGGGALGHPK

SEQ ID NO: 46627 - protein, 14 aa, Homo sapiens
VTHTGQVYDDKDYR

SEQ ID NO: 46628 - protein, 14 aa, Homo sapiens
HCEDGICTVTAGPK

SEQ ID NO: 46629 - protein, 26 aa, Homo sapiens
KLMPNFSDSFGGGSGAGAGGGGMFGS

SEQ ID NO: 46630 - protein, 19 aa, Homo sapiens
KSDLETSEPKPFLYYPEIK

SEQ ID NO: 46631 - protein, 18 aa, Homo sapiens
YVCEGPSHGGLPGASSEK

SEQ ID NO: 46632 - protein, 25 aa, Homo sapiens
RDGYEPCVNEGMCVTYHNGTGYCKC

SEQ ID NO: 46633 - protein, 23 aa, Homo sapiens
AVVHGILMGVPVPFPIPEPDGCK

SEQ ID NO: 46634 - protein, 10 aa, Homo sapiens
DCGSVDGVIK

SEQ ID NO: 46635 - protein, 9 aa, Homo sapiens
DKTYSYLNK

SEQ ID NO: 46636 - protein, 13 aa, Homo sapiens
DKTYSYLNKLPVK

SEQ ID NO: 46637 - protein, 20 aa, Homo sapiens
DKTYSYLNKLPVKSEYPSIK

SEQ ID NO: 46638 - protein, 16 aa, Homo sapiens
EVNVSPCPTQPCQLSK

SEQ ID NO: 46639 - protein, 19 aa, Homo sapiens
KGQSYSVNVTFTSNIQSKS

SEQ ID NO: 46640 - protein, 11 aa, Homo sapiens
LPVKSEYPSIK

SEQ ID NO: 46641 - protein, 16 aa, Homo sapiens
NQSLFCWEIPVQIVSH

SEQ ID NO: 46642 - protein, 7 aa, Homo sapiens
SEYPSIK

SEQ ID NO: 46643 - protein, 9 aa, Homo sapiens
SGINCPIQK

SEQ ID NO: 46644 - protein, 11 aa, Homo sapiens
TYSYLNKLPVK

SEQ ID NO: 46645 - protein, 18 aa, Homo sapiens
TYSYLNKLPVKSEYPSIK

SEQ ID NO: 46646 - protein, 18 aa, Homo sapiens
KNIFVNGTTGEGLSLSVS

SEQ ID NO: 46647 - protein, 19 aa, Homo sapiens
DTYFLSSEECITAGDFQNK

SEQ ID NO: 46648 - protein, 17 aa, Homo sapiens
PLPVEYLIIDITTTFPK

SEQ ID NO: 46649 - protein, 16 aa, Homo sapiens
SGCEGHLPWPNGICTK

SEQ ID NO: 46650 - protein, 13 aa, Homo sapiens
HANAKPFEVPFLK

SEQ ID NO: 46651 - protein, 16 aa, Homo sapiens
PKPGDGEFVEVISLPK

SEQ ID NO: 46652 - protein, 11 aa, Homo sapiens
TLHYECIVLVK

SEQ ID NO: 46653 - protein, 15 aa, Homo sapiens
AGSTALYWACHGGHK

SEQ ID NO: 46654 - protein, 25 aa, Homo sapiens
TGLIPSNYVAEQAESIDNPLHEAAK

SEQ ID NO: 46655 - protein, 20 aa, Homo sapiens
RSQANGAGALSYVSPNTSKC

SEQ ID NO: 46656 - protein, 12 aa, Homo sapiens
RLLPGNATISKA

SEQ ID NO: 46657 - protein, 13 aa, Homo sapiens
AGVNFSEFTGVWK

SEQ ID NO: 46658 - protein, 12 aa, Homo sapiens
DNSGMIDKNELK

SEQ ID NO: 46659 - protein, 11 aa, Homo sapiens
LSDQFHDILIR

SEQ ID NO: 46660 - protein, 8 aa, Homo sapiens
SIISMFDR

SEQ ID NO: 46661 - protein, 11 aa, Homo sapiens
SIISMFDRENK

SEQ ID NO: 46662 - protein, 10 aa, Homo sapiens
YITDWQNVFR

SEQ ID NO: 46663 - protein, 18 aa, Homo sapiens
DAGLHCLELGHTGEAGPH

SEQ ID NO: 46664 - protein, 14 aa, Homo sapiens
ELSDPAGAIIYTSR

SEQ ID NO: 46665 - protein, 11 aa, Homo sapiens
FCDNSSAIQGK

SEQ ID NO: 46666 - protein, 11 aa, Homo sapiens
FGEPVLAGFAR

SEQ ID NO: 46667 - protein, 12 aa, Homo sapiens
FLRPEDPTRPSR

SEQ ID NO: 46668 - protein, 14 aa, Homo sapiens
GHLLYVALSPGQHR

SEQ ID NO: 46669 - protein, 38 aa, Homo sapiens
GLAPLHWADDDGNPTEQYPLNPNGSPGGVAGICSCDGR

SEQ ID NO: 46670 - protein, 20 aa, Homo sapiens
GNPICSLHDQGAGGNGNVLK

SEQ ID NO: 46671 - protein, 19 aa, Homo sapiens
KFCDNSSAIQGKEVRFLRP

SEQ ID NO: 46672 - protein, 22 aa, Homo sapiens
KPPMLQPLALPPGLSVHQALER

SEQ ID NO: 46673 - protein, 28 aa, Homo sapiens
LGGTALAQCFSQLGEHPPDLDLPENLVR

SEQ ID NO: 46674 - protein, 16 aa, Homo sapiens
LNFSTPTSTNIVSVCR

SEQ ID NO: 46675 - protein, 30 aa, Homo sapiens
LPELQGVETELCYNVNWTAEALPSAEETKK

SEQ ID NO: 46676 - protein, 22 aa, Homo sapiens
LSFAHPPSAEVEAIALATLHDR

SEQ ID NO: 46677 - protein, 14 aa, Homo sapiens
ADGTCQDAAIVGYK

SEQ ID NO: 46678 - protein, 9 aa, Homo sapiens
CYEMASHLR

SEQ ID NO: 46679 - protein, 14 aa, Homo sapiens
DSLLQDGEFSMDLR

SEQ ID NO: 46680 - protein, 12 aa, Homo sapiens
DSPSVWAAVPGK

SEQ ID NO: 46681 - protein, 16 aa, Homo sapiens
KSTGGAPTFNVTVTKT

SEQ ID NO: 46682 - protein, 10 aa, Homo sapiens
PSVWAAVPGK

SEQ ID NO: 46683 - protein, 14 aa, Homo sapiens
SSFYVNGLTLGGQK

SEQ ID NO: 46684 - protein, 14 aa, Homo sapiens
STGGAPTFNVTVTK

SEQ ID NO: 46685 - protein, 11 aa, Homo sapiens
TDKTLVLLMGK

SEQ ID NO: 46686 - protein, 16 aa, Homo sapiens
TFVNITPAEVGVLVGK

SEQ ID NO: 46687 - protein, 18 aa, Homo sapiens
TFVNITPAEVGVLVGKDR

SEQ ID NO: 46688 - protein, 8 aa, Homo sapiens
TLVLLMGK

SEQ ID NO: 46689 - protein, 12 aa, Homo sapiens
EVAEYQRNIVSR

SEQ ID NO: 46690 - protein, 26 aa, Homo sapiens
LEEDSVVHSVENDSQNMMESLSPKKY

SEQ ID NO: 46691 - protein, 9 aa, Homo sapiens
LIEKEVKIR

SEQ ID NO: 46692 - protein, 18 aa, Homo sapiens
NHQQMSEGHRQKSEFYNR

SEQ ID NO: 46693 - protein, 17 aa, Homo sapiens
SPSPLGTSVRSSPSLAK

SEQ ID NO: 46694 - protein, 6 aa, Homo sapiens
YLPVRK

SEQ ID NO: 46695 - protein, 19 aa, Homo sapiens
CGIALDAWMFPLGDEVYSR

SEQ ID NO: 46696 - protein, 16 aa, Homo sapiens
GSVHQNFADFTFATGK

SEQ ID NO: 46697 - protein, 22 aa, Homo sapiens
IAVIGHSFGGATVIQTLSEDQR

SEQ ID NO: 46698 - protein, 21 aa, Homo sapiens
IPQPLFFINSEYFQYPANIIK

SEQ ID NO: 46699 - protein, 11 aa, Homo sapiens
TLKQEEETHIR

SEQ ID NO: 46700 - protein, 14 aa, Homo sapiens
YPLVVFSHGLGAFR

SEQ ID NO: 46701 - protein, 27 aa, Homo sapiens
GKPAVAALGDLTDLPTYEHIQTALSSK

SEQ ID NO: 46702 - protein, 11 aa, Homo sapiens
KLPHELCTLIR

SEQ ID NO: 46703 - protein, 10 aa, Homo sapiens
LPHELCTLIR

SEQ ID NO: 46704 - protein, 30 aa, Homo sapiens
MAVQFELEDLNLRPDPEPLLTEMIHEAAYR

SEQ ID NO: 46705 - protein, 18 aa, Homo sapiens
MVLAGVGVEHEHLVDCAR

SEQ ID NO: 46706 - protein, 11 aa, Homo sapiens
YLSGIAHFLEK

SEQ ID NO: 46707 - protein, 17 aa, Homo sapiens
RCLLIDYNPDSQELDFR

SEQ ID NO: 46708 - protein, 11 aa, Homo sapiens
TKDKSQGAQAR

SEQ ID NO: 46709 - protein, 11 aa, Homo sapiens
AEGYEVAHGGR

SEQ ID NO: 46710 - protein, 25 aa, Homo sapiens
ASYIHLQGSDLRPQFHQFTAVPHPN

SEQ ID NO: 46711 - protein, 12 aa, Homo sapiens
GVSCQFGPDVTK

SEQ ID NO: 46712 - protein, 13 aa, Homo sapiens
TECYGYALGDATR

SEQ ID NO: 46713 - protein, 24 aa, Homo sapiens
CPSPPMINLISVGGQHQGVFGLPR

SEQ ID NO: 46714 - protein, 15 aa, Homo sapiens
ETIPLQETSLYTQDR

SEQ ID NO: 46715 - protein, 8 aa, Homo sapiens
GINESYKK

SEQ ID NO: 46716 - protein, 13 aa, Homo sapiens
IPGIYVLSLEIGK

SEQ ID NO: 46717 - protein, 21 aa, Homo sapiens
KFLNDSIVDPVDSEWFGFYRS

SEQ ID NO: 46718 - protein, 10 aa, Homo sapiens
KTLNAGAYSK

SEQ ID NO: 46719 - protein, 18 aa, Homo sapiens
LQQGYNAMGFSQGGQFLR

SEQ ID NO: 46720 - protein, 12 aa, Homo sapiens
LVQAEYWHDPIK

SEQ ID NO: 46721 - protein, 17 aa, Homo sapiens
LVQAEYWHDPIKEDVYR

SEQ ID NO: 46722 - protein, 15 aa, Homo sapiens
RNHSIFLADINQERG

SEQ ID NO: 46723 - protein, 9 aa, Homo sapiens
TLNAGAYSK

SEQ ID NO: 46724 - protein, 10 aa, Homo sapiens
DGIVLGADTR

SEQ ID NO: 46725 - protein, 11 aa, Homo sapiens
FRPDMEEEEAK

SEQ ID NO: 46726 - protein, 13 aa, Homo sapiens
KKPCGQSEINTLK

SEQ ID NO: 46727 - protein, 12 aa, Homo sapiens
KPCGQSEINTLK

SEQ ID NO: 46728 - protein, 18 aa, Homo sapiens
QQVDNVAQCHIQLAQSLR

SEQ ID NO: 46729 - protein, 11 aa, Homo sapiens
VREEWQSEHIK

SEQ ID NO: 46730 - protein, 14 aa, Homo sapiens
IDSTPVKPAGGGCC

SEQ ID NO: 46731 - protein, 15 aa, Homo sapiens
MGPGAASGGERPNLK

SEQ ID NO: 46732 - protein, 14 aa, Homo sapiens
HHCPSTPIILVGTK

SEQ ID NO: 46733 - protein, 30 aa, Homo sapiens
QVIQQNPALLPALLQQLGQENPQLLQQISR

SEQ ID NO: 46734 - protein, 27 aa, Homo sapiens
SPSEESAPTTSPESVSGSVPSSGSSGR

SEQ ID NO: 46735 - protein, 22 aa, Homo sapiens
AKENDENCGPTTTVFVGNISEK

SEQ ID NO: 46736 - protein, 20 aa, Homo sapiens
ENDENCGPTTTVFVGNISEK

SEQ ID NO: 46737 - protein, 25 aa, Homo sapiens
IPTAKPELFAYPLDWSIVDSILMER

SEQ ID NO: 46738 - protein, 15 aa, Homo sapiens
LLAEGHPDPDAELQR

SEQ ID NO: 46739 - protein, 17 aa, Homo sapiens
LQAFGFCEYKEPESTLR

SEQ ID NO: 46740 - protein, 18 aa, Homo sapiens
GFGFITFTNPEHASVAMR

SEQ ID NO: 46741 - protein, 32 aa, Homo sapiens
LFVGGLNFNTDEQALEDHFSSFGPISEVVVVK

SEQ ID NO: 46742 - protein, 14 aa, Homo sapiens
YDSRPGGYGYGYGR

SEQ ID NO: 46743 - protein, 34 aa, Homo sapiens
KRRTTNRTIPSVDDFQNYLRVAFQEVNSGCTGKT

SEQ ID NO: 46744 - protein, 17 aa, Homo sapiens
RNCSHWAVGVASWEMSR

SEQ ID NO: 46745 - protein, 14 aa, Homo sapiens
ACPRPEGLNFQDLK

SEQ ID NO: 46746 - protein, 23 aa, Homo sapiens
AQHIVPCTISQLLSATLVDEVFR

SEQ ID NO: 46747 - protein, 16 aa, Homo sapiens
TISQLLSATLVDEVFR

SEQ ID NO: 46748 - protein, 20 aa, Homo sapiens
AEMIIEQNTDGVNFYNILTK

SEQ ID NO: 46749 - protein, 15 aa, Homo sapiens
AGHMVPSDQGDMALK

SEQ ID NO: 46750 - protein, 12 aa, Homo sapiens
DALSQLMNGPIR

SEQ ID NO: 46751 - protein, 14 aa, Homo sapiens
DLAMVASDMMVLLK

SEQ ID NO: 46752 - protein, 8 aa, Homo sapiens
EATELWGK

SEQ ID NO: 46753 - protein, 9 aa, Homo sapiens
EVWDYVTVR

SEQ ID NO: 46754 - protein, 7 aa, Homo sapiens
GLAEVSK

SEQ ID NO: 46755 - protein, 23 aa, Homo sapiens
LFVDNPVGTGFSYVNGSGAYAKD

SEQ ID NO: 46756 - protein, 11 aa, Homo sapiens
MAAGIGLELYK

SEQ ID NO: 46757 - protein, 9 aa, Homo sapiens
SLETSAFVK

SEQ ID NO: 46758 - protein, 11 aa, Homo sapiens
VAEQVLNAVNK

SEQ ID NO: 46759 - protein, 13 aa, Homo sapiens
IVLLAGWALFLFL

SEQ ID NO: 46760 - protein, 13 aa, Homo sapiens
LSQMAVQGLQQFK

SEQ ID NO: 46761 - protein, 29 aa, Homo sapiens
SQVLDDEDSNNITVGSLVTVLVKLTRQTM

SEQ ID NO: 46762 - protein, 26 aa, Homo sapiens
KFRMVYNLTYNTMATHEDVDTTMLRR

SEQ ID NO: 46763 - protein, 22 aa, Homo sapiens
RLDNITQVMSLHTQYLESFLRS

SEQ ID NO: 46764 - protein, 30 aa, Homo sapiens
RDAQPSKTCQVFLSCWAPNISEITYSWRRE

SEQ ID NO: 46765 - protein, 34 aa, Homo sapiens
KLLTSHGMGIQVPLNATEFNYLCPAIINQIDARS

SEQ ID NO: 46766 - protein, 12 aa, Homo sapiens
RKTNESVSEPRK

SEQ ID NO: 46767 - protein, 15 aa, Homo sapiens
RYGENNSLSVEGFRK

SEQ ID NO: 46768 - protein, 14 aa, Homo sapiens
AIWNVINWENVTER

SEQ ID NO: 46769 - protein, 25 aa, Homo sapiens
FNGGGHINHSIFWTNLSPNGGGEPK

SEQ ID NO: 46770 - protein, 14 aa, Homo sapiens
GDVTAQIALQPALK

SEQ ID NO: 46771 - protein, 33 aa, Homo sapiens
GHLQIAACPNQDPLQGTTGLIPLLGIDVWEHAY

SEQ ID NO: 46772 - protein, 15 aa, Homo sapiens
HHAAYVNNLNVTEEK

SEQ ID NO: 46773 - protein, 28 aa, Homo sapiens
HSLPDLPYDYGALEPHINAQIMQLHHSK

SEQ ID NO: 46774 - protein, 21 aa, Homo sapiens
KFNGGGHINHSIFWTNLSPNG

SEQ ID NO: 46775 - protein, 29 aa, Homo sapiens
KHSLPDLPYDYGALEPHINAQIMQLHHSK

SEQ ID NO: 46776 - protein, 27 aa, Homo sapiens
KEQQPNDLLSVQFIDYGNVSVVHTNKI

SEQ ID NO: 46777 - protein, 30 aa, Homo sapiens
AAVAASGLNTMLEGNGQYTLLAPTNEAFEK

SEQ ID NO: 46778 - protein, 15 aa, Homo sapiens
ADHHATNGVVHLIDK

SEQ ID NO: 46779 - protein, 22 aa, Homo sapiens
DILATNGVIHYIDELLIPDSAK

SEQ ID NO: 46780 - protein, 15 aa, Homo sapiens
EGVYTVFAPTNEAFR

SEQ ID NO: 46781 - protein, 29 aa, Homo sapiens
GCPAALPLSNLYETLGVVGSTTTQLYTDR

SEQ ID NO: 46782 - protein, 13 aa, Homo sapiens
GDELADSALEIFK

SEQ ID NO: 46783 - protein, 20 aa, Homo sapiens
GDELADSALEIFKQASAFSR

SEQ ID NO: 46784 - protein, 15 aa, Homo sapiens
GPAKSPYQLVLQHSR

SEQ ID NO: 46785 - protein, 13 aa, Homo sapiens
GRQHGPNVCAVQK

SEQ ID NO: 46786 - protein, 13 aa, Homo sapiens
LLGDAKELANILK

SEQ ID NO: 46787 - protein, 12 aa, Homo sapiens
LTLLAPLNSVFK

SEQ ID NO: 46788 - protein, 23 aa, Homo sapiens
LTLLAPLNSVFKDGTPPIDAHTR

SEQ ID NO: 46789 - protein, 11 aa, Homo sapiens
NHIIKDQLASK

SEQ ID NO: 46790 - protein, 13 aa, Homo sapiens
QAGLGNHLSGSER

SEQ ID NO: 46791 - protein, 12 aa, Homo sapiens
SLQGDKLEVSLK

SEQ ID NO: 46792 - protein, 11 aa, Homo sapiens
SPYQLVLQHSR

SEQ ID NO: 46793 - protein, 14 aa, Homo sapiens
STVISYECCPGYEK

SEQ ID NO: 46794 - protein, 10 aa, Homo sapiens
SVRLAPVYQK

SEQ ID NO: 46795 - protein, 23 aa, Homo sapiens
VISTITNNIQQIIEIEDTFETLR

SEQ ID NO: 46796 - protein, 18 aa, Homo sapiens
YHIGDEILVSGGIGALVR

SEQ ID NO: 46797 - protein, 14 aa, Homo sapiens
YLYHGQTLETLGGK

SEQ ID NO: 46798 - protein, 13 aa, Homo sapiens
AGTLDLSLTVQGK

SEQ ID NO: 46799 - protein, 10 aa, Homo sapiens
AQGYSGLSVK

SEQ ID NO: 46800 - protein, 9 aa, Homo sapiens
AQLYIDCEK

SEQ ID NO: 46801 - protein, 16 aa, Homo sapiens
CENTDPGYNCLPCPPR

SEQ ID NO: 46802 - protein, 13 aa, Homo sapiens
CNYLGHYSDPMYR

SEQ ID NO: 46803 - protein, 10 aa, Homo sapiens
CTSYPDGSWK

SEQ ID NO: 46804 - protein, 14 aa, Homo sapiens
DCVGDVTENQICNK

SEQ ID NO: 46805 - protein, 16 aa, Homo sapiens
DDDYAGFVFGYQSSSR

SEQ ID NO: 46806 - protein, 14 aa, Homo sapiens
DHSGQVFSVVSNGK

SEQ ID NO: 46807 - protein, 7 aa, Homo sapiens
DLASIAR

SEQ ID NO: 46808 - protein, 21 aa, Homo sapiens
DLQAICGISCDELSSMVLELR

SEQ ID NO: 46809 - protein, 16 aa, Homo sapiens
DNCPNLPNSGQEDYDK

SEQ ID NO: 46810 - protein, 12 aa, Homo sapiens
DNCQYVYNVDQR

SEQ ID NO: 46811 - protein, 29 aa, Homo sapiens
DTDMDGVGDQCDNCPLEHNPDQLDSDSDR

SEQ ID NO: 46812 - protein, 9 aa, Homo sapiens
FQDLVDAVR

SEQ ID NO: 46813 - protein, 9 aa, Homo sapiens
FQMIPLDPK

SEQ ID NO: 46814 - protein, 18 aa, Homo sapiens
FTGSQPFGQGVEHATANK

SEQ ID NO: 46815 - protein, 24 aa, Homo sapiens
FTGSQPFGQGVEHATANKQVCKPR

SEQ ID NO: 46816 - protein, 12 aa, Homo sapiens
FVFGTTPEDILR

SEQ ID NO: 46817 - protein, 27 aa, Homo sapiens
GEDTDLDGWPNENLVCVANATYHCKKD

SEQ ID NO: 46818 - protein, 9 aa, Homo sapiens
GFLLLASLR

SEQ ID NO: 46819 - protein, 15 aa, Homo sapiens
GGVNDNFQGVLQNVR

SEQ ID NO: 46820 - protein, 10 aa, Homo sapiens
GPDPSSPAFR

SEQ ID NO: 46821 - protein, 8 aa, Homo sapiens
GTLLALER

SEQ ID NO: 46822 - protein, 12 aa, Homo sapiens
GTSQNDPNWVVR

SEQ ID NO: 46823 - protein, 17 aa, Homo sapiens
HYNPAQYDYDRDDVGDR

SEQ ID NO: 46824 - protein, 18 aa, Homo sapiens
IAKGGVNDNFQGVLQNVR

SEQ ID NO: 46825 - protein, 14 aa, Homo sapiens
IEDANLIPPVPDDK

SEQ ID NO: 46826 - protein, 23 aa, Homo sapiens
IEDANLIPPVPDDKFQDLVDAVR

SEQ ID NO: 46827 - protein, 11 aa, Homo sapiens
IMADSGPIYDK

SEQ ID NO: 46828 - protein, 21 aa, Homo sapiens
IPESGGDNSVFDIFELTGAAR

SEQ ID NO: 46829 - protein, 15 aa, Homo sapiens
KDHSGQVFSVVSNGK

SEQ ID NO: 46830 - protein, 27 aa, Homo sapiens
KGCSSSTSVLLTLDNNVVNGSSPAIRT

SEQ ID NO: 46831 - protein, 12 aa, Homo sapiens
KIMADSGPIYDK

SEQ ID NO: 46832 - protein, 18 aa, Homo sapiens
KIMADSGPIYDKTYAGGR

SEQ ID NO: 46833 - protein, 23 aa, Homo sapiens
KVSCPIMPCSNATVPDGECCPRC

SEQ ID NO: 46834 - protein, 12 aa, Homo sapiens
KVTEENKELANE

SEQ ID NO: 46835 - protein, 14 aa, Homo sapiens
KVTEENKELANELR

SEQ ID NO: 46836 - protein, 15 aa, Homo sapiens
KVVNSTTGPGEHLRN

SEQ ID NO: 46837 - protein, 12 aa, Homo sapiens
LCNNPTPQFGGK

SEQ ID NO: 46838 - protein, 17 aa, Homo sapiens
LGLFVFSQEMVFFSDLK

SEQ ID NO: 46839 - protein, 16 aa, Homo sapiens
MENAELDVPIQSVFTR

SEQ ID NO: 46840 - protein, 14 aa, Homo sapiens
NALWHTGNTPGQVR

SEQ ID NO: 46841 - protein, 23 aa, Homo sapiens
NNEEWTVDSCTECHCQNSVTICK

SEQ ID NO: 46842 - protein, 25 aa, Homo sapiens
NNEEWTVDSCTECHCQNSVTICKKV

SEQ ID NO: 46843 - protein, 23 aa, Homo sapiens
NRIPESGGDNSVFDIFELTGAAR

SEQ ID NO: 46844 - protein, 24 aa, Homo sapiens
NRIPESGGDNSVFDIFELTGAARK

SEQ ID NO: 46845 - protein, 17 aa, Homo sapiens
QHVVSVEEALLATGQWK

SEQ ID NO: 46846 - protein, 13 aa, Homo sapiens
QVTQSYWDTNPTR

SEQ ID NO: 46847 - protein, 13 aa, Homo sapiens
RPPLCYHNGVQYR

SEQ ID NO: 46848 - protein, 10 aa, Homo sapiens
SITLFVQEDR

SEQ ID NO: 46849 - protein, 11 aa, Homo sapiens
SQEMVFFSDLK

SEQ ID NO: 46850 - protein, 22 aa, Homo sapiens
SSTSVLLTLDNNVVNGSSPAIR

SEQ ID NO: 46851 - protein, 11 aa, Homo sapiens
TIVTTLQDSIR

SEQ ID NO: 46852 - protein, 16 aa, Homo sapiens
TLDNNVVNGSSPAIRT

SEQ ID NO: 46853 - protein, 13 aa, Homo sapiens
VTEENKELANELR

SEQ ID NO: 46854 - protein, 23 aa, Homo sapiens
RFTFTSHTPGDHQICLHSNSTRM

SEQ ID NO: 46855 - protein, 10 aa, Homo sapiens
FQEEIKENTK

SEQ ID NO: 46856 - protein, 12 aa, Homo sapiens
SGHSFLSNLHLR

SEQ ID NO: 46857 - protein, 12 aa, Homo sapiens
TSEETISTVQEK

SEQ ID NO: 46858 - protein, 9 aa, Homo sapiens
VAAHITGTR

SEQ ID NO: 46859 - protein, 8 aa, Homo sapiens
EEHLCTQR

SEQ ID NO: 46860 - protein, 8 aa, Homo sapiens
HIAEEADR

SEQ ID NO: 46861 - protein, 15 aa, Homo sapiens
HIAEEADRKYEEVAR

SEQ ID NO: 46862 - protein, 14 aa, Homo sapiens
IQVLQQQADDAEER

SEQ ID NO: 46863 - protein, 15 aa, Homo sapiens
KIQVLQQQADDAEER

SEQ ID NO: 46864 - protein, 13 aa, Homo sapiens
LEEAEKAADESER

SEQ ID NO: 46865 - protein, 10 aa, Homo sapiens
LVIIEGDLER

SEQ ID NO: 46866 - protein, 21 aa, Homo sapiens
LVIIEGDLERTEERAELAESR

SEQ ID NO: 46867 - protein, 9 aa, Homo sapiens
RAREQAEAE

SEQ ID NO: 46868 - protein, 31 aa, Homo sapiens
EVTCPICLELLTEPLSLDCGHSFCQACITAK

SEQ ID NO: 46869 - protein, 11 aa, Homo sapiens
GESSCPVCQTR

SEQ ID NO: 46870 - protein, 23 aa, Homo sapiens
LEEGEVNVLDNLAAATDQLVQQR

SEQ ID NO: 46871 - protein, 19 aa, Homo sapiens
VICWVCELSQEHQGHQTFR

SEQ ID NO: 46872 - protein, 28 aa, Homo sapiens
DGFESVFPLSHLQYFYPEELDQLLCGSK

SEQ ID NO: 46873 - protein, 14 aa, Homo sapiens
DIPVTIHNLEEYLR

SEQ ID NO: 46874 - protein, 21 aa, Homo sapiens
SPQELYELTSLICELMPCLPK

SEQ ID NO: 46875 - protein, 14 aa, Homo sapiens
QNITEEIPMEVFKE

SEQ ID NO: 46876 - protein, 26 aa, Homo sapiens
GVAGALRPLVQATVPATPEQPVLDLK

SEQ ID NO: 46877 - protein, 21 aa, Homo sapiens
NAVTQFVSSMSASADVLALAK

SEQ ID NO: 46878 - protein, 17 aa, Homo sapiens
RPLVASVGLNVPASVCY

SEQ ID NO: 46879 - protein, 21 aa, Homo sapiens
DLGNVPNGSALTDGSQLPSRD

SEQ ID NO: 46880 - protein, 23 aa, Homo sapiens
RNELLGTASVNLSNVLKNNGGKM

SEQ ID NO: 46881 - protein, 11 aa, Homo sapiens
YGFLLPESQIR

SEQ ID NO: 46882 - protein, 10 aa, Homo sapiens
GNEQFINAAK

SEQ ID NO: 46883 - protein, 17 aa, Homo sapiens
LGEHNIEVLEGNEQFIN

SEQ ID NO: 46884 - protein, 20 aa, Homo sapiens
LGEHNIEVLEGNEQFINAAK

SEQ ID NO: 46885 - protein, 10 aa, Homo sapiens
TLNNDIMLIK

SEQ ID NO: 46886 - protein, 10 aa, Homo sapiens
VLEGNEQFIN

SEQ ID NO: 46887 - protein, 13 aa, Homo sapiens
VLEGNEQFINAAK

SEQ ID NO: 46888 - protein, 16 aa, Homo sapiens
VSTISLPTAPPATGTK

SEQ ID NO: 46889 - protein, 31 aa, Homo sapiens
LFFGSQASRCSAQKNTEFAVDLYQEVSLSHK

SEQ ID NO: 46890 - protein, 9 aa, Homo sapiens
LITAQQILK

SEQ ID NO: 46891 - protein, 20 aa, Homo sapiens
ELESVCVVEAGPGTCTFDHR

SEQ ID NO: 46892 - protein, 27 aa, Homo sapiens
SRPNASGGAACSGPGPEPAVFCEPVVK

SEQ ID NO: 46893 - protein, 20 aa, Homo sapiens
QTVQRSMANLSVLFGQVVRG

SEQ ID NO: 46894 - protein, 19 aa, Homo sapiens
ANALHATNNLQIIPDFSLK

SEQ ID NO: 46895 - protein, 37 aa, Homo sapiens
EAASLTSLADSVHLQTPLHMAIAYNHPDVVSVILEQK

SEQ ID NO: 46896 - protein, 22 aa, Homo sapiens
GNPPLWLALANNLEDIASTLVR

SEQ ID NO: 46897 - protein, 22 aa, Homo sapiens
HGCDATCWGPGPGGCLQTLLHR

SEQ ID NO: 46898 - protein, 29 aa, Homo sapiens
HGLANLTAELLQQGANPNLQTEEALPLPK

SEQ ID NO: 46899 - protein, 11 aa, Homo sapiens
WGETPLHTACR

SEQ ID NO: 46900 - protein, 13 aa, Homo sapiens
ALDVSASDDEIAR

SEQ ID NO: 46901 - protein, 23 aa, Homo sapiens
GSTGFGQDSILSLPGNVGHQDVK

SEQ ID NO: 46902 - protein, 28 aa, Homo sapiens
HGPVYEDDCFGCLSWSHSETHLLYVAEK

SEQ ID NO: 46903 - protein, 23 aa, Homo sapiens
LLTIDQDLMVAQFSTPSLPPTLK

SEQ ID NO: 46904 - protein, 8 aa, Homo sapiens
QFLEVWEK

SEQ ID NO: 46905 - protein, 25 aa, Homo sapiens
QLGENFSGIYCSLLPLGCWSADSQR

SEQ ID NO: 46906 - protein, 22 aa, Homo sapiens
QPALSAACLGPEVTTQYGGQYR

SEQ ID NO: 46907 - protein, 12 aa, Homo sapiens
TPLLLMLGQEDR

SEQ ID NO: 46908 - protein, 9 aa, Homo sapiens
TVHTEWTQR

SEQ ID NO: 46909 - protein, 11 aa, Homo sapiens
VTSVVVDVVPR

SEQ ID NO: 46910 - protein, 18 aa, Homo sapiens
ASSEGGTAAGAGLDSLHK

SEQ ID NO: 46911 - protein, 31 aa, Homo sapiens
ASSEGGTAAGAGLDSLHKNSVSQISVLSGGK

SEQ ID NO: 46912 - protein, 17 aa, Homo sapiens
EHNGQVTGIDWAPESNR

SEQ ID NO: 46913 - protein, 13 aa, Homo sapiens
NSVSQISVLSGGK

SEQ ID NO: 46914 - protein, 17 aa, Homo sapiens
TQIAICPNNHEVHIYEK

SEQ ID NO: 46915 - protein, 17 aa, Homo sapiens
VAWVSHDSTVCLADADK

SEQ ID NO: 46916 - protein, 18 aa, Homo sapiens
VAWVSHDSTVCLADADKK

SEQ ID NO: 46917 - protein, 17 aa, Homo sapiens
VISICYFEQENDWWVCK

SEQ ID NO: 46918 - protein, 20 aa, Homo sapiens
FMLVLASNLPEQFDCAINSR

SEQ ID NO: 46919 - protein, 15 aa, Homo sapiens
LHFDNCVLKPATEGK

SEQ ID NO: 46920 - protein, 14 aa, Homo sapiens
AASVVQPQPLVVVK

SEQ ID NO: 46921 - protein, 19 aa, Homo sapiens
YKPVDVEALGLHDYCDIIK

SEQ ID NO: 46922 - protein, 26 aa, Homo sapiens
AYLMEPLCISSNESSEGCCPPSGTRQ

SEQ ID NO: 46923 - protein, 25 aa, Homo sapiens
MFQNAVMYNSSDHDVYHMAVEMQRD

SEQ ID NO: 46924 - protein, 13 aa, Homo sapiens
ELVQQYHQFQCSR

SEQ ID NO: 46925 - protein, 36 aa, Homo sapiens
IEHALGGSSALHIPAFPGGGCLIDYVPQVCHLLTNK

SEQ ID NO: 46926 - protein, 8 aa, Homo sapiens
KDFFLVQK

SEQ ID NO: 46927 - protein, 11 aa, Homo sapiens
AARLPVAPLRK

SEQ ID NO: 46928 - protein, 22 aa, Homo sapiens
AGGALINEYWVLTAAHVVEGNR

SEQ ID NO: 46929 - protein, 6 aa, Homo sapiens
CEYQIR

SEQ ID NO: 46930 - protein, 14 aa, Homo sapiens
CGHGFPGPLNIETK

SEQ ID NO: 46931 - protein, 16 aa, Homo sapiens
CQPVDCGIPESIENGK

SEQ ID NO: 46932 - protein, 30 aa, Homo sapiens
CQPVDCGIPESIENGKVEDPESTLFGSVIR

SEQ ID NO: 46933 - protein, 9 aa, Homo sapiens
CVPVCGVPR

SEQ ID NO: 46934 - protein, 15 aa, Homo sapiens
CVPVCGVPREPFEEK

SEQ ID NO: 46935 - protein, 17 aa, Homo sapiens
CVPVCGVPREPFEEKQR

SEQ ID NO: 46936 - protein, 17 aa, Homo sapiens
DVVQITCLDGFEVVEGR

SEQ ID NO: 46937 - protein, 25 aa, Homo sapiens
EDFDVEAADSAGNCLDSLVFVAGDR

SEQ ID NO: 46938 - protein, 12 aa, Homo sapiens
EDTPNSVWEPAK

SEQ ID NO: 46939 - protein, 27 aa, Homo sapiens
ENGGGGEYHCAGNGSWVNEVLGPELPK

SEQ ID NO: 46940 - protein, 23 aa, Homo sapiens
EPTMYGEILSPNYPQAYPSEVEK

SEQ ID NO: 46941 - protein, 15 aa, Homo sapiens
EPTMYVGSTSVQTSR

SEQ ID NO: 46942 - protein, 27 aa, Homo sapiens
EVKVEKPTADAEAYVFTPNMICAGGEK

SEQ ID NO: 46943 - protein, 27 aa, Homo sapiens
FDNPWAGGALINEYWVLTAAHVVEGNR

SEQ ID NO: 46944 - protein, 12 aa, Homo sapiens
FYAAGLVSWGPQ

SEQ ID NO: 46945 - protein, 17 aa, Homo sapiens
FYAAGLVSWGPQCGTYG

SEQ ID NO: 46946 - protein, 21 aa, Homo sapiens
FYAAGLVSWGPQCGTYGLYTR

SEQ ID NO: 46947 - protein, 15 aa, Homo sapiens
GDSGGAFAVQDPNDK

SEQ ID NO: 46948 - protein, 17 aa, Homo sapiens
GDSGGAFAVQDPNDKTK

SEQ ID NO: 46949 - protein, 9 aa, Homo sapiens
GFQVVVTLR

SEQ ID NO: 46950 - protein, 23 aa, Homo sapiens
GMDSCKGDSGGAFAVQDPNDKTK

SEQ ID NO: 46951 - protein, 20 aa, Homo sapiens
HCAGNGSWVNEVLGPELPKC

SEQ ID NO: 46952 - protein, 18 aa, Homo sapiens
IGEIASPNYPKPYPENSR

SEQ ID NO: 46953 - protein, 10 aa, Homo sapiens
IIGGSDADIK

SEQ ID NO: 46954 - protein, 17 aa, Homo sapiens
INEYWVLTAAHVVEGNR

SEQ ID NO: 46955 - protein, 34 aa, Homo sapiens
KNCGVNCSGDVFTALIGEIASPNYPKPYPENSRC

SEQ ID NO: 46956 - protein, 12 aa, Homo sapiens
KTMQENSTPRED

SEQ ID NO: 46957 - protein, 32 aa, Homo sapiens
LKCQPVDCGIPESIENGKVEDPESTLFGSVIR

SEQ ID NO: 46958 - protein, 8 aa, Homo sapiens
LLEVPEGR

SEQ ID NO: 46959 - protein, 6 aa, Homo sapiens
LQVIFK

SEQ ID NO: 46960 - protein, 32 aa, Homo sapiens
MGPTVSPICLPGTSSDYNLMDGDLGLISGWGR

SEQ ID NO: 46961 - protein, 14 aa, Homo sapiens
MLTPEHVFIHPGWK

SEQ ID NO: 46962 - protein, 12 aa, Homo sapiens
MYVGSTSVQTSR

SEQ ID NO: 46963 - protein, 32 aa, Homo sapiens
NCGVNCSGDVFTALIGEIASPNYPKPYPENSR

SEQ ID NO: 46964 - protein, 34 aa, Homo sapiens
NFPWQVFFDNPWAGGALINEYWVLTAAHVVEGNR

SEQ ID NO: 46965 - protein, 26 aa, Homo sapiens
NGGGGEYHCAGNGSWVNEVLGPELPK

SEQ ID NO: 46966 - protein, 8 aa, Homo sapiens
NYVDWIMK

SEQ ID NO: 46967 - protein, 22 aa, Homo sapiens
PESIENGKVEDPESTLFGSVIR

SEQ ID NO: 46968 - protein, 11 aa, Homo sapiens
PESTLFGSVIR

SEQ ID NO: 46969 - protein, 22 aa, Homo sapiens
PGTSSDYNLMDGDLGLISGWGR

SEQ ID NO: 46970 - protein, 15 aa, Homo sapiens
PHSPIVEEFQVPYNK

SEQ ID NO: 46971 - protein, 19 aa, Homo sapiens
QFGPYCGHGFPGPLNIETK

SEQ ID NO: 46972 - protein, 26 aa, Homo sapiens
REDFDVEAADSAGNCLDSLVFVAGDR

SEQ ID NO: 46973 - protein, 39 aa, Homo sapiens
RYTCEEPYYYMENGGGGEYHCAGNGSWVNEVLGPELPKC

SEQ ID NO: 46974 - protein, 16 aa, Homo sapiens
SKMLTPEHVFIHPGWK

SEQ ID NO: 46975 - protein, 16 aa, Homo sapiens
SNALDIIFQTDLTGQK

SEQ ID NO: 46976 - protein, 13 aa, Homo sapiens
SPIVEEFQVPYNK

SEQ ID NO: 46977 - protein, 13 aa, Homo sapiens
SSNNPHSPIVEEF

SEQ ID NO: 46978 - protein, 17 aa, Homo sapiens
SSNNPHSPIVEEFQVPY

SEQ ID NO: 46979 - protein, 19 aa, Homo sapiens
SSNNPHSPIVEEFQVPYNK

SEQ ID NO: 46980 - protein, 13 aa, Homo sapiens
SVQIISGDTEEGR

SEQ ID NO: 46981 - protein, 15 aa, Homo sapiens
SWDIEVPEGYGIHLY

SEQ ID NO: 46982 - protein, 10 aa, Homo sapiens
TAAHVVEGNR

SEQ ID NO: 46983 - protein, 21 aa, Homo sapiens
TALIGEIASPNYPKPYPENSR

SEQ ID NO: 46984 - protein, 9 aa, Homo sapiens
TMQENSTPR

SEQ ID NO: 46985 - protein, 11 aa, Homo sapiens
TMQENSTPRED

SEQ ID NO: 46986 - protein, 11 aa, Homo sapiens
TNFDNDIALVR

SEQ ID NO: 46987 - protein, 12 aa, Homo sapiens
TPEHVFIHPGWK

SEQ ID NO: 46988 - protein, 9 aa, Homo sapiens
VEDPESTLF

SEQ ID NO: 46989 - protein, 14 aa, Homo sapiens
VEDPESTLFGSVIR

SEQ ID NO: 46990 - protein, 16 aa, Homo sapiens
VEKPTADAEAYVFTPN

SEQ ID NO: 46991 - protein, 24 aa, Homo sapiens
VEKPTADAEAYVFTPNMICAGGEK

SEQ ID NO: 46992 - protein, 47 aa, Homo sapiens
VEKPTADAEAYVFTPNMICAGGEKGMDSCKGDSGGAFAVQDPNDKTK

SEQ ID NO: 46993 - protein, 15 aa, Homo sapiens
VGATSFYSTCQSNGK

SEQ ID NO: 46994 - protein, 20 aa, Homo sapiens
VGATSFYSTCQSNGKWSNSK

SEQ ID NO: 46995 - protein, 10 aa, Homo sapiens
VGSTSVQTSR

SEQ ID NO: 46996 - protein, 10 aa, Homo sapiens
VKNYVDWIMK

SEQ ID NO: 46997 - protein, 21 aa, Homo sapiens
VKNYVDWIMKTMQENSTPRED

SEQ ID NO: 46998 - protein, 12 aa, Homo sapiens
VLTAAHVVEGNR

SEQ ID NO: 46999 - protein, 10 aa, Homo sapiens
YHGDPMPCPK

SEQ ID NO: 47000 - protein, 11 aa, Homo sapiens
YPQAYPSEVEK

SEQ ID NO: 47001 - protein, 37 aa, Homo sapiens
YTCEEPYYYMENGGGGEYHCAGNGSWVNEVLGPELPK

SEQ ID NO: 47002 - protein, 13 aa, Homo sapiens
AAAPAPVSEAVCR

SEQ ID NO: 47003 - protein, 29 aa, Homo sapiens
EGITGPPADSSKPIGPDDAIDALSSDFTC

SEQ ID NO: 47004 - protein, 29 aa, Homo sapiens
EQLPPMSEDFLLDALSEDFSGPQNASSLK

SEQ ID NO: 47005 - protein, 17 aa, Homo sapiens
HLLDDNGQDKPVKPPTK

SEQ ID NO: 47006 - protein, 31 aa, Homo sapiens
KPADDQDPIDALSGDLDSCPSTTETSQNTAK

SEQ ID NO: 47007 - protein, 21 aa, Homo sapiens
LKPATDKDGKPLLPEPEEKPK

SEQ ID NO: 47008 - protein, 23 aa, Homo sapiens
LKPATDKDGKPLLPEPEEKPKPR

SEQ ID NO: 47009 - protein, 15 aa, Homo sapiens
SESELIDELSEDFDR

SEQ ID NO: 47010 - protein, 18 aa, Homo sapiens
SLTPAVPVESKPDKPSGK

SEQ ID NO: 47011 - protein, 27 aa, Homo sapiens
TKPQDMISAGGESVAGITAISGKPGDK

SEQ ID NO: 47012 - protein, 21 aa, Homo sapiens
IGGEPYTLGLFDTAGQEDYDR

SEQ ID NO: 47013 - protein, 16 aa, Homo sapiens
LRPLSYPQTDVFLVCF

SEQ ID NO: 47014 - protein, 28 aa, Homo sapiens
LRPLSYPQTDVFLVCFSVVSPSSFENVK

SEQ ID NO: 47015 - protein, 17 aa, Homo sapiens
NVFDEAILAALEPPEPK

SEQ ID NO: 47016 - protein, 9 aa, Homo sapiens
PEITHHCPK

SEQ ID NO: 47017 - protein, 13 aa, Homo sapiens
TPFLLVGTQIDLR

SEQ ID NO: 47018 - protein, 11 aa, Homo sapiens
WVPEITHHCPK

SEQ ID NO: 47019 - protein, 18 aa, Homo sapiens
AIHCPRPHDFENGEYWPR

SEQ ID NO: 47020 - protein, 18 aa, Homo sapiens
ALEYVCPSGFYPYPVQTR

SEQ ID NO: 47021 - protein, 9 aa, Homo sapiens
ALFVSEEEK

SEQ ID NO: 47022 - protein, 10 aa, Homo sapiens
ALFVSEEEKK

SEQ ID NO: 47023 - protein, 13 aa, Homo sapiens
ALFVSEEEKKLTR

SEQ ID NO: 47024 - protein, 14 aa, Homo sapiens
ALFVSEEEKKLTRK

SEQ ID NO: 47025 - protein, 19 aa, Homo sapiens
ALFVSEEEKKLTRKEVYIK

SEQ ID NO: 47026 - protein, 24 aa, Homo sapiens
ALFVSEEEKKLTRKEVYIKNGDKK

SEQ ID NO: 47027 - protein, 22 aa, Homo sapiens
ALQAVYSMMSWPDDVPPEGWNR

SEQ ID NO: 47028 - protein, 24 aa, Homo sapiens
ALQAVYSMMSWPDDVPPEGWNRTR

SEQ ID NO: 47029 - protein, 24 aa, Homo sapiens
ALRLPPTTTCQQQKEELLPAQDIK

SEQ ID NO: 47030 - protein, 17 aa, Homo sapiens
APGYDKVKDISEVVTPR

SEQ ID NO: 47031 - protein, 8 aa, Homo sapiens
CLVNLIEK

SEQ ID NO: 47032 - protein, 14 aa, Homo sapiens
CSLEGVEIKGGSFR

SEQ ID NO: 47033 - protein, 10 aa, Homo sapiens
DAQYAPGYDK

SEQ ID NO: 47034 - protein, 12 aa, Homo sapiens
DAQYAPGYDKVK

SEQ ID NO: 47035 - protein, 21 aa, Homo sapiens
DAQYAPGYDKVKDISEVVTPR

SEQ ID NO: 47036 - protein, 10 aa, Homo sapiens
DFENGEYWPR

SEQ ID NO: 47037 - protein, 31 aa, Homo sapiens
DFENGEYWPRSPYYNVSDEISFHCYDGYTLR

SEQ ID NO: 47038 - protein, 14 aa, Homo sapiens
DFHINLFQVLPWLK

SEQ ID NO: 47039 - protein, 16 aa, Homo sapiens
DFHINLFQVLPWLKEK

SEQ ID NO: 47040 - protein, 15 aa, Homo sapiens
DGSDSIGASNFTGAK

SEQ ID NO: 47041 - protein, 9 aa, Homo sapiens
DISEVVTPR

SEQ ID NO: 47042 - protein, 12 aa, Homo sapiens
DLEIEVVLFHPN

SEQ ID NO: 47043 - protein, 14 aa, Homo sapiens
DLEIEVVLFHPNYN

SEQ ID NO: 47044 - protein, 18 aa, Homo sapiens
DLEIEVVLFHPNYNINGK

SEQ ID NO: 47045 - protein, 19 aa, Homo sapiens
DLEIEVVLFHPNYNINGKK

SEQ ID NO: 47046 - protein, 7 aa, Homo sapiens
DLLYIGK

SEQ ID NO: 47047 - protein, 19 aa, Homo sapiens
DMENLEDVFYQMIDESQSL

SEQ ID NO: 47048 - protein, 29 aa, Homo sapiens
DMENLEDVFYQMIDESQSLSLCGMVWEHR

SEQ ID NO: 47049 - protein, 8 aa, Homo sapiens
DNEQHVFK

SEQ ID NO: 47050 - protein, 10 aa, Homo sapiens
DSGGPLIVHK

SEQ ID NO: 47051 - protein, 34 aa, Homo sapiens
DTPQEVAEAFLSSLTETIEGVDAEDGHGPGEQQK

SEQ ID NO: 47052 - protein, 13 aa, Homo sapiens
EAGIPEFYDYDVA

SEQ ID NO: 47053 - protein, 14 aa, Homo sapiens
EAGIPEFYDYDVAL

SEQ ID NO: 47054 - protein, 16 aa, Homo sapiens
EAGIPEFYDYDVALIK

SEQ ID NO: 47055 - protein, 18 aa, Homo sapiens
EAGIPEFYDYDVALIKLK

SEQ ID NO: 47056 - protein, 16 aa, Homo sapiens
EDYLDVYVFGVGPLVN

SEQ ID NO: 47057 - protein, 19 aa, Homo sapiens
EDYLDVYVFGVGPLVNQVN

SEQ ID NO: 47058 - protein, 21 aa, Homo sapiens
EDYLDVYVFGVGPLVNQVNIN

SEQ ID NO: 47059 - protein, 23 aa, Homo sapiens
EDYLDVYVFGVGPLVNQVNINAL

SEQ ID NO: 47060 - protein, 26 aa, Homo sapiens
EDYLDVYVFGVGPLVNQVNINALASK

SEQ ID NO: 47061 - protein, 10 aa, Homo sapiens
EELLPAQDIK

SEQ ID NO: 47062 - protein, 16 aa, Homo sapiens
EIEVVLFHPNYNINGK

SEQ ID NO: 47063 - protein, 11 aa, Homo sapiens
EKLQDEDLGFL

SEQ ID NO: 47064 - protein, 14 aa, Homo sapiens
EVVLFHPNYNINGK

SEQ ID NO: 47065 - protein, 10 aa, Homo sapiens
EVYIKNGDKK

SEQ ID NO: 47066 - protein, 15 aa, Homo sapiens
EVYIKNGDKKGSCER

SEQ ID NO: 47067 - protein, 25 aa, Homo sapiens
EVYIKNGDKKGSCERDAQYAPGYDK

SEQ ID NO: 47068 - protein, 16 aa, Homo sapiens
FIQVGVISWGVVDVCK

SEQ ID NO: 47069 - protein, 17 aa, Homo sapiens
FLCTGGVSPYADPNTCR

SEQ ID NO: 47070 - protein, 10 aa, Homo sapiens
FYDYDVALIK

SEQ ID NO: 47071 - protein, 11 aa, Homo sapiens
GDSGGPLIVHK

SEQ ID NO: 47072 - protein, 12 aa, Homo sapiens
GDSGGPLIVHKR

SEQ ID NO: 47073 - protein, 10 aa, Homo sapiens
GFYPYPVQTR

SEQ ID NO: 47074 - protein, 12 aa, Homo sapiens
GGDPITVIDEIR

SEQ ID NO: 47075 - protein, 8 aa, Homo sapiens
GGPLIVHK

SEQ ID NO: 47076 - protein, 27 aa, Homo sapiens
GHESCMGAVVSEYFVLTAAHCFTVDDK

SEQ ID NO: 47077 - protein, 32 aa, Homo sapiens
GHESCMGAVVSEYFVLTAAHCFTVDDKEHSIK

SEQ ID NO: 47078 - protein, 26 aa, Homo sapiens
GSCERDAQYAPGYDKVKDISEVVTPR

SEQ ID NO: 47079 - protein, 14 aa, Homo sapiens
GSDSIGASNFTGAK

SEQ ID NO: 47080 - protein, 12 aa, Homo sapiens
GTDYHKQPWQAK

SEQ ID NO: 47081 - protein, 17 aa, Homo sapiens
GVGPLVNQVNINALASK

SEQ ID NO: 47082 - protein, 25 aa, Homo sapiens
HVIILMTDGLHNMGGDPITVIDEIR

SEQ ID NO: 47083 - protein, 32 aa, Homo sapiens
HVIILMTDGLHNMGGDPITVIDEIRDLLYIGK

SEQ ID NO: 47084 - protein, 15 aa, Homo sapiens
IEVVLFHPNYNINGK

SEQ ID NO: 47085 - protein, 8 aa, Homo sapiens
ISVIRPSK

SEQ ID NO: 47086 - protein, 12 aa, Homo sapiens
IVLDPSGSMNIY

SEQ ID NO: 47087 - protein, 30 aa, Homo sapiens
IVLDPSGSMNIYLVLDGSDSIGASNFTGAK

SEQ ID NO: 47088 - protein, 31 aa, Homo sapiens
IVLDPSGSMNIYLVLDGSDSIGASNFTGAKK

SEQ ID NO: 47089 - protein, 23 aa, Homo sapiens
KALQAVYSMMSWPDDVPPEGWNR

SEQ ID NO: 47090 - protein, 24 aa, Homo sapiens
KALQAVYSMMSWPDDVPPEGWNRT

SEQ ID NO: 47091 - protein, 9 aa, Homo sapiens
KCLVNLIEK

SEQ ID NO: 47092 - protein, 9 aa, Homo sapiens
KDNEQHVFK

SEQ ID NO: 47093 - protein, 17 aa, Homo sapiens
KEAGIPEFYDYDVALIK

SEQ ID NO: 47094 - protein, 6 aa, Homo sapiens
KEVYIK

SEQ ID NO: 47095 - protein, 10 aa, Homo sapiens
KEVYIKNGDK

SEQ ID NO: 47096 - protein, 13 aa, Homo sapiens
KGTDYHKQPWQAK

SEQ ID NO: 47097 - protein, 11 aa, Homo sapiens
KIVLDPSGSMN

SEQ ID NO: 47098 - protein, 13 aa, Homo sapiens
KIVLDPSGSMNIY

SEQ ID NO: 47099 - protein, 31 aa, Homo sapiens
KIVLDPSGSMNIYLVLDGSDSIGASNFTGAK

SEQ ID NO: 47100 - protein, 32 aa, Homo sapiens
KIVLDPSGSMNIYLVLDGSDSIGASNFTGAKK

SEQ ID NO: 47101 - protein, 25 aa, Homo sapiens
KKALQAVYSMMSWPDDVPPEGWNRT

SEQ ID NO: 47102 - protein, 30 aa, Homo sapiens
KNPREDYLDVYVFGVGPLVNQVNINALASK

SEQ ID NO: 47103 - protein, 7 aa, Homo sapiens
KVGSQYR

SEQ ID NO: 47104 - protein, 18 aa, Homo sapiens
KVGSQYRLEDSVTYHCSR

SEQ ID NO: 47105 - protein, 19 aa, Homo sapiens
KVGSQYRLEDSVTYHCSRG

SEQ ID NO: 47106 - protein, 16 aa, Homo sapiens
LDGSDSIGASNFTGAK

SEQ ID NO: 47107 - protein, 8 aa, Homo sapiens
LEDSVTYH

SEQ ID NO: 47108 - protein, 9 aa, Homo sapiens
LEDSVTYHC

SEQ ID NO: 47109 - protein, 11 aa, Homo sapiens
LEDSVTYHCSR

SEQ ID NO: 47110 - protein, 12 aa, Homo sapiens
LEDSVTYHCSRG

SEQ ID NO: 47111 - protein, 10 aa, Homo sapiens
LLQEGQALEY

SEQ ID NO: 47112 - protein, 22 aa, Homo sapiens
LLQEGQALEYVCPSGFYPYPVQ

SEQ ID NO: 47113 - protein, 24 aa, Homo sapiens
LLQEGQALEYVCPSGFYPYPVQTR

SEQ ID NO: 47114 - protein, 10 aa, Homo sapiens
LNEINYEDHK

SEQ ID NO: 47115 - protein, 11 aa, Homo sapiens
LPPTTTCQQQK

SEQ ID NO: 47116 - protein, 21 aa, Homo sapiens
LPPTTTCQQQKEELLPAQDIK

SEQ ID NO: 47117 - protein, 9 aa, Homo sapiens
LQDEDLGFL

SEQ ID NO: 47118 - protein, 24 aa, Homo sapiens
LSSLTETIEGVDAEDGHGPGEQQK

SEQ ID NO: 47119 - protein, 9 aa, Homo sapiens
LTRKEVYIK

SEQ ID NO: 47120 - protein, 18 aa, Homo sapiens
LVLDGSDSIGASNFTGAK

SEQ ID NO: 47121 - protein, 13 aa, Homo sapiens
MGGDPITVIDEIR

SEQ ID NO: 47122 - protein, 20 aa, Homo sapiens
MTDGLHNMGGDPITVIDEIR

SEQ ID NO: 47123 - protein, 36 aa, Homo sapiens
MYDTPQEVAEAFLSSLTETIEGVDAEDGHGPGEQQK

SEQ ID NO: 47124 - protein, 31 aa, Homo sapiens
NGDKKGSCERDAQYAPGYDKVKDISEVVTPR

SEQ ID NO: 47125 - protein, 14 aa, Homo sapiens
NMGGDPITVIDEIR

SEQ ID NO: 47126 - protein, 29 aa, Homo sapiens
NPREDYLDVYVFGVGPLVNQVNINALASK

SEQ ID NO: 47127 - protein, 17 aa, Homo sapiens
NVSDEISFHCYDGYTLR

SEQ ID NO: 47128 - protein, 12 aa, Homo sapiens
PEFYDYDVALIK

SEQ ID NO: 47129 - protein, 16 aa, Homo sapiens
PGYDKVKDISEVVTPR

SEQ ID NO: 47130 - protein, 12 aa, Homo sapiens
PHDFENGEYWPR

SEQ ID NO: 47131 - protein, 12 aa, Homo sapiens
PICLPCTEGTTR

SEQ ID NO: 47132 - protein, 9 aa, Homo sapiens
PITVIDEIR

SEQ ID NO: 47133 - protein, 16 aa, Homo sapiens
PITVIDEIRDLLYIGK

SEQ ID NO: 47134 - protein, 32 aa, Homo sapiens
PQEVAEAFLSSLTETIEGVDAEDGHGPGEQQK

SEQ ID NO: 47135 - protein, 13 aa, Homo sapiens
PQGSCSLEGVEIK

SEQ ID NO: 47136 - protein, 14 aa, Homo sapiens
PRPHDFENGEYWPR

SEQ ID NO: 47137 - protein, 12 aa, Homo sapiens
PSGFYPYPVQTR

SEQ ID NO: 47138 - protein, 26 aa, Homo sapiens
PSGSMNIYLVLDGSDSIGASNFTGAK

SEQ ID NO: 47139 - protein, 27 aa, Homo sapiens
PSGSMNIYLVLDGSDSIGASNFTGAKK

SEQ ID NO: 47140 - protein, 9 aa, Homo sapiens
QKQVPAHAR

SEQ ID NO: 47141 - protein, 11 aa, Homo sapiens
QLNEINYEDHK

SEQ ID NO: 47142 - protein, 7 aa, Homo sapiens
QVPAHAR

SEQ ID NO: 47143 - protein, 19 aa, Homo sapiens
RDLEIEVVLFHPNYNINGK

SEQ ID NO: 47144 - protein, 20 aa, Homo sapiens
RDLEIEVVLFHPNYNINGKK

SEQ ID NO: 47145 - protein, 27 aa, Homo sapiens
REDYLDVYVFGVGPLVNQVNINALASK

SEQ ID NO: 47146 - protein, 14 aa, Homo sapiens
RGSANRTCQVNGRW

SEQ ID NO: 47147 - protein, 14 aa, Homo sapiens
RPQGSCSLEGVEIK

SEQ ID NO: 47148 - protein, 19 aa, Homo sapiens
RPQGSCSLEGVEIKGGSFR

SEQ ID NO: 47149 - protein, 22 aa, Homo sapiens
RSPYYNVSDEISFHCYDGYTLR

SEQ ID NO: 47150 - protein, 23 aa, Homo sapiens
RSPYYNVSDEISFHCYDGYTLRG

SEQ ID NO: 47151 - protein, 15 aa, Homo sapiens
SDEISFHCYDGYTLR

SEQ ID NO: 47152 - protein, 9 aa, Homo sapiens
SGGPLIVHK

SEQ ID NO: 47153 - protein, 17 aa, Homo sapiens
SLARPQGSCSLEGVEIK

SEQ ID NO: 47154 - protein, 22 aa, Homo sapiens
SLTETIEGVDAEDGHGPGEQQK

SEQ ID NO: 47155 - protein, 13 aa, Homo sapiens
SPYYNVSDEISFH

SEQ ID NO: 47156 - protein, 16 aa, Homo sapiens
SPYYNVSDEISFHCYD

SEQ ID NO: 47157 - protein, 18 aa, Homo sapiens
SPYYNVSDEISFHCYDGY

SEQ ID NO: 47158 - protein, 21 aa, Homo sapiens
SPYYNVSDEISFHCYDGYTLR

SEQ ID NO: 47159 - protein, 23 aa, Homo sapiens
SSLTETIEGVDAEDGHGPGEQQK

SEQ ID NO: 47160 - protein, 9 aa, Homo sapiens
STGSWSTLK

SEQ ID NO: 47161 - protein, 14 aa, Homo sapiens
STGSWSTLKTQDQK

SEQ ID NO: 47162 - protein, 17 aa, Homo sapiens
STGSWSTLKTQDQKTVR

SEQ ID NO: 47163 - protein, 22 aa, Homo sapiens
STGSWSTLKTQDQKTVRKAECR

SEQ ID NO: 47164 - protein, 7 aa, Homo sapiens
SYGVKPR

SEQ ID NO: 47165 - protein, 11 aa, Homo sapiens
TAAHCFTVDDK

SEQ ID NO: 47166 - protein, 20 aa, Homo sapiens
TCRSTGSWSTLKTQDQKTVR

SEQ ID NO: 47167 - protein, 19 aa, Homo sapiens
TDGLHNMGGDPITVIDEIR

SEQ ID NO: 47168 - protein, 33 aa, Homo sapiens
TPQEVAEAFLSSLTETIEGVDAEDGHGPGEQQK

SEQ ID NO: 47169 - protein, 20 aa, Homo sapiens
TPWSLARPQGSCSLEGVEIK

SEQ ID NO: 47170 - protein, 25 aa, Homo sapiens
TPWSLARPQGSCSLEGVEIKGGSFR

SEQ ID NO: 47171 - protein, 26 aa, Homo sapiens
TTPWSLARPQGSCSLEGVEIKGGSFR

SEQ ID NO: 47172 - protein, 7 aa, Homo sapiens
TYATYPK

SEQ ID NO: 47173 - protein, 9 aa, Homo sapiens
VASYGVKPR

SEQ ID NO: 47174 - protein, 19 aa, Homo sapiens
VFGVGPLVNQVNINALASK

SEQ ID NO: 47175 - protein, 6 aa, Homo sapiens
VGSQYR

SEQ ID NO: 47176 - protein, 17 aa, Homo sapiens
VGSQYRLEDSVTYHCSR

SEQ ID NO: 47177 - protein, 18 aa, Homo sapiens
VGSQYRLEDSVTYHCSRG

SEQ ID NO: 47178 - protein, 22 aa, Homo sapiens
VGSQYRLEDSVTYHCSRGLTLR

SEQ ID NO: 47179 - protein, 11 aa, Homo sapiens
VKDISEVVTPR

SEQ ID NO: 47180 - protein, 17 aa, Homo sapiens
VKDMENLEDVFYQMIDE

SEQ ID NO: 47181 - protein, 19 aa, Homo sapiens
VKDMENLEDVFYQMIDESQ

SEQ ID NO: 47182 - protein, 21 aa, Homo sapiens
VKDMENLEDVFYQMIDESQSL

SEQ ID NO: 47183 - protein, 12 aa, Homo sapiens
VLFHPNYNINGK

SEQ ID NO: 47184 - protein, 13 aa, Homo sapiens
VLTAAHCFTVDDK

SEQ ID NO: 47185 - protein, 12 aa, Homo sapiens
VNQVNINALASK

SEQ ID NO: 47186 - protein, 16 aa, Homo sapiens
VSDEISFHCYDGYTLR

SEQ ID NO: 47187 - protein, 14 aa, Homo sapiens
VSEADSSNADWVTK

SEQ ID NO: 47188 - protein, 25 aa, Homo sapiens
VSEADSSNADWVTKQLNEINYEDHK

SEQ ID NO: 47189 - protein, 7 aa, Homo sapiens
VSVGGEK

SEQ ID NO: 47190 - protein, 8 aa, Homo sapiens
VSVGGEKR

SEQ ID NO: 47191 - protein, 13 aa, Homo sapiens
VVLFHPNYNINGK

SEQ ID NO: 47192 - protein, 14 aa, Homo sapiens
WSGQTAICDNGAGY

SEQ ID NO: 47193 - protein, 25 aa, Homo sapiens
WSGQTAICDNGAGYCSNPGIPIGTR

SEQ ID NO: 47194 - protein, 26 aa, Homo sapiens
WSGQTAICDNGAGYCSNPGIPIGTRK

SEQ ID NO: 47195 - protein, 18 aa, Homo sapiens
WSLARPQGSCSLEGVEIK

SEQ ID NO: 47196 - protein, 18 aa, Homo sapiens
YAPGYDKVKDISEVVTPR

SEQ ID NO: 47197 - protein, 35 aa, Homo sapiens
YDTPQEVAEAFLSSLTETIEGVDAEDGHGPGEQQK

SEQ ID NO: 47198 - protein, 11 aa, Homo sapiens
YGLVTYATYPK

SEQ ID NO: 47199 - protein, 15 aa, Homo sapiens
YGLVTYATYPKIWVK

SEQ ID NO: 47200 - protein, 18 aa, Homo sapiens
YGQTIRPICLPCTEGTTR

SEQ ID NO: 47201 - protein, 18 aa, Homo sapiens
YNVSDEISFHCYDGYTLR

SEQ ID NO: 47202 - protein, 15 aa, Homo sapiens
YVCPSGFYPYPVQTR

SEQ ID NO: 47203 - protein, 19 aa, Homo sapiens
YYNVSDEISFHCYDGYTLR

SEQ ID NO: 47204 - protein, 21 aa, Homo sapiens
KDGQAQTLQNHSGLSAPVPRG

SEQ ID NO: 47205 - protein, 32 aa, Homo sapiens
KLILSQNHSDEEEEEEENEEENLAMAVGMGER

SEQ ID NO: 47206 - protein, 19 aa, Homo sapiens
KVLNHSPMSDASVNFDYKS

SEQ ID NO: 47207 - protein, 20 aa, Homo sapiens
REHGAQAGEGALKDSNNDTN

SEQ ID NO: 47208 - protein, 15 aa, Homo sapiens
FWNHEFVHCAPEIEK

SEQ ID NO: 47209 - protein, 11 aa, Homo sapiens
GQQELLYVVPF

SEQ ID NO: 47210 - protein, 21 aa, Homo sapiens
IYNHPPHPTMSVDEVLEMLQR

SEQ ID NO: 47211 - protein, 20 aa, Homo sapiens
KDVPPSINTTNIDTLLVATD

SEQ ID NO: 47212 - protein, 22 aa, Homo sapiens
MLLNGTPFAFVIDLAALASRRE

SEQ ID NO: 47213 - protein, 16 aa, Homo sapiens
RILTNFTGVMPPQFKK

SEQ ID NO: 47214 - protein, 19 aa, Homo sapiens
SVAHVTEADLFHTIETLMR

SEQ ID NO: 47215 - protein, 12 aa, Homo sapiens
YCDPVVLTYQAE

SEQ ID NO: 47216 - protein, 21 aa, Homo sapiens
DLSSAEAILALFPENFHQNLK

SEQ ID NO: 47217 - protein, 25 aa, Homo sapiens
LLDVTCSSLSVTQEEAEELLQALHR

SEQ ID NO: 47218 - protein, 19 aa, Homo sapiens
DAGPLLISLKDGYVPPKSR

SEQ ID NO: 47219 - protein, 10 aa, Homo sapiens
DGGLICTSCR

SEQ ID NO: 47220 - protein, 7 aa, Homo sapiens
FYKLHER

SEQ ID NO: 47221 - protein, 34 aa, Homo sapiens
HLEEPLSLQELDTSSGVLLPFFDPDTNIVYLCGK

SEQ ID NO: 47222 - protein, 19 aa, Homo sapiens
KGTVVAEKDRPHEGTRPVR

SEQ ID NO: 47223 - protein, 11 aa, Homo sapiens
KLQATVQELQK

SEQ ID NO: 47224 - protein, 23 aa, Homo sapiens
RAAPEASGTPSSDAVSRLEEEMR

SEQ ID NO: 47225 - protein, 35 aa, Homo sapiens
DDDFLGGAECSLGQIVSSQVLTLPLMLKPGKPAGR

SEQ ID NO: 47226 - protein, 20 aa, Homo sapiens
EALAQTVLAEVPTQLVSYFR

SEQ ID NO: 47227 - protein, 16 aa, Homo sapiens
LYGPTNFAPIINHVAR

SEQ ID NO: 47228 - protein, 21 aa, Homo sapiens
SDPLCVLLQDVGGGSWAELGR

SEQ ID NO: 47229 - protein, 36 aa, Homo sapiens
TPELRDDDFLGGAECSLGQIVSSQVLTLPLMLKPGK

SEQ ID NO: 47230 - protein, 31 aa, Homo sapiens
KNSSTAEINETTTSSTDFLARAYGFEMAKEF

SEQ ID NO: 47231 - protein, 15 aa, Homo sapiens
RFENQTGFPPPDSRF

SEQ ID NO: 47232 - protein, 29 aa, Homo sapiens
RGQFESVAPSQNFSDSSESDTHPFVIAKT

SEQ ID NO: 47233 - protein, 13 aa, Homo sapiens
GIMGEDTYPYQGK

SEQ ID NO: 47234 - protein, 8 aa, Homo sapiens
GNFVSPVK

SEQ ID NO: 47235 - protein, 22 aa, Homo sapiens
GSCWTFSTTGALESAIAIATGK

SEQ ID NO: 47236 - protein, 12 aa, Homo sapiens
GTGPYPPSVDWR

SEQ ID NO: 47237 - protein, 19 aa, Homo sapiens
KDVANITIYDEEAMVEAVA

SEQ ID NO: 47238 - protein, 11 aa, Homo sapiens
KTYSTEEYHHR

SEQ ID NO: 47239 - protein, 9 aa, Homo sapiens
LQTFASNWR

SEQ ID NO: 47240 - protein, 15 aa, Homo sapiens
MALNQFSDMSFAEIK

SEQ ID NO: 47241 - protein, 16 aa, Homo sapiens
NMCGLAACASYPIPLV

SEQ ID NO: 47242 - protein, 17 aa, Homo sapiens
NSWGPQWGMNGYFLIER

SEQ ID NO: 47243 - protein, 11 aa, Homo sapiens
TGIYSSTSCHK

SEQ ID NO: 47244 - protein, 17 aa, Homo sapiens
TPDKVNHAVLAVGYGEK

SEQ ID NO: 47245 - protein, 13 aa, Homo sapiens
VNHAVLAVGYGEK

SEQ ID NO: 47246 - protein, 10 aa, Homo sapiens
EVVTEHLINK

SEQ ID NO: 47247 - protein, 10 aa, Homo sapiens
FLLESFNNDR

SEQ ID NO: 47248 - protein, 13 aa, Homo sapiens
GLTEQEVETILDK

SEQ ID NO: 47249 - protein, 15 aa, Homo sapiens
RDMSISNTTMDEFRQ

SEQ ID NO: 47250 - protein, 12 aa, Homo sapiens
SPEYLSLFIDDK

SEQ ID NO: 47251 - protein, 15 aa, Homo sapiens
VLTTGYWPTQSATPK

SEQ ID NO: 47252 - protein, 25 aa, Homo sapiens
LIHALATNSSSELFRLAAHPLNNRM

SEQ ID NO: 47253 - protein, 29 aa, Homo sapiens
RIPVAFPSGDASSLSKNIMMYACINATKD

SEQ ID NO: 47254 - protein, 25 aa, Homo sapiens
RMDDVPSHSKALSDGNGSSGIEWSN

SEQ ID NO: 47255 - protein, 16 aa, Homo sapiens
DFPLVDGHNDLPLVLR

SEQ ID NO: 47256 - protein, 13 aa, Homo sapiens
FIGIGGDYDGAGK

SEQ ID NO: 47257 - protein, 18 aa, Homo sapiens
GVHSFYNNISGLTDFGEK

SEQ ID NO: 47258 - protein, 12 aa, Homo sapiens
GWSEEELQGVLR

SEQ ID NO: 47259 - protein, 21 aa, Homo sapiens
KGLQDVNLRNFSYGQTSLDRL

SEQ ID NO: 47260 - protein, 20 aa, Homo sapiens
KGVHSFYNNISGLTDFGEKV

SEQ ID NO: 47261 - protein, 29 aa, Homo sapiens
KNGGVVMVSLSMGVIQCNPSANVSTVADH

SEQ ID NO: 47262 - protein, 10 aa, Homo sapiens
LTLEQIDLIR

SEQ ID NO: 47263 - protein, 25 aa, Homo sapiens
EGVFPGLIPILNSYLENMEVDVDTR

SEQ ID NO: 47264 - protein, 22 aa, Homo sapiens
LGCPGFTLPEVKPNPVEGGASK

SEQ ID NO: 47265 - protein, 36 aa, Homo sapiens
MVSFVSNYSHTANILPDIENEDFIKDCVRIHNKFRS

SEQ ID NO: 47266 - protein, 15 aa, Homo sapiens
AHGKKVLTSLGDAIK

SEQ ID NO: 47267 - protein, 18 aa, Homo sapiens
FDSFGNLSSASAIMGNPK

SEQ ID NO: 47268 - protein, 19 aa, Homo sapiens
FFDSFGNLSSASAIMGNPK

SEQ ID NO: 47269 - protein, 21 aa, Homo sapiens
FFDSFGNLSSASAIMGNPKVK

SEQ ID NO: 47270 - protein, 17 aa, Homo sapiens
GHFTEEDKATITSLWGK

SEQ ID NO: 47271 - protein, 11 aa, Homo sapiens
KVLTSLGDAIK

SEQ ID NO: 47272 - protein, 12 aa, Homo sapiens
MVTGVASALSSR

SEQ ID NO: 47273 - protein, 14 aa, Homo sapiens
MVTGVASALSSRYH

SEQ ID NO: 47274 - protein, 10 aa, Homo sapiens
VLTSLGDAIK

SEQ ID NO: 47275 - protein, 13 aa, Homo sapiens
VNVEDAGGETLGR

SEQ ID NO: 47276 - protein, 9 aa, Homo sapiens
MATMIPPVK

SEQ ID NO: 47277 - protein, 28 aa, Homo sapiens
MCQELETGIVDLLIPSPNATAEVGYNRD

SEQ ID NO: 47278 - protein, 27 aa, Homo sapiens
RQSLTSPDSQSARPANRTALSDPSSRL

SEQ ID NO: 47279 - protein, 23 aa, Homo sapiens
RVTALEGYQIGQVACGLNHTLAV

SEQ ID NO: 47280 - protein, 22 aa, Homo sapiens
SRSESDLSQPESDEEGYALSGR

SEQ ID NO: 47281 - protein, 21 aa, Homo sapiens
KALNEHHVNATLDLIEGSMTV

SEQ ID NO: 47282 - protein, 10 aa, Homo sapiens
RSNVTLTLRN

SEQ ID NO: 47283 - protein, 27 aa, Homo sapiens
RQPGQQRPGPGAGAPAGRPEGGGPWAR

SEQ ID NO: 47284 - protein, 20 aa, Homo sapiens
THEVVGSSLLFVHDHTGLAK

SEQ ID NO: 47285 - protein, 19 aa, Homo sapiens
THQNSSSLQTHPEGACPSK

SEQ ID NO: 47286 - protein, 17 aa, Homo sapiens
GPKPEPPGSGSPAPPRR

SEQ ID NO: 47287 - protein, 16 aa, Homo sapiens
QEPGGSHGSETEDTGR

SEQ ID NO: 47288 - protein, 14 aa, Homo sapiens
KLSSQGNVSGKRKN

SEQ ID NO: 47289 - protein, 25 aa, Homo sapiens
RQNASSSSQQNNGPMDVISPHSYKS

SEQ ID NO: 47290 - protein, 23 aa, Homo sapiens
ASSFKGYIENCSTPNTYICMQRT

SEQ ID NO: 47291 - protein, 20 aa, Homo sapiens
PQPQAGLSQANFTLGPVSRS

SEQ ID NO: 47292 - protein, 7 aa, Homo sapiens
ALDLLDK

SEQ ID NO: 47293 - protein, 16 aa, Homo sapiens
DLKPSNLLLNTTCDLK

SEQ ID NO: 47294 - protein, 28 aa, Homo sapiens
HYLDQLNHILGILGSPSQEDLNCIINLK

SEQ ID NO: 47295 - protein, 18 aa, Homo sapiens
TQHLSNDHICYFLYQILR

SEQ ID NO: 47296 - protein, 19 aa, Homo sapiens
VADPDHDHTGFLTEYVATR

SEQ ID NO: 47297 - protein, 13 aa, Homo sapiens
FLGNAPCGHYTFK

SEQ ID NO: 47298 - protein, 15 aa, Homo sapiens
LLGALCLQRPPVVSK

SEQ ID NO: 47299 - protein, 35 aa, Homo sapiens
LLGALCLQRPPVVSKPLTPLQEEMASLLQQIEIER

SEQ ID NO: 47300 - protein, 20 aa, Homo sapiens
PLTPLQEEMASLLQQIEIER

SEQ ID NO: 47301 - protein, 16 aa, Homo sapiens
EKEHYCLADLASLMDK

SEQ ID NO: 47302 - protein, 29 aa, Homo sapiens
LSTCEAEDIATYEQNLQQWHLDLVQLIQR

SEQ ID NO: 47303 - protein, 10 aa, Homo sapiens
ALELDSNLYR

SEQ ID NO: 47304 - protein, 10 aa, Homo sapiens
ALEQQVEEMK

SEQ ID NO: 47305 - protein, 16 aa, Homo sapiens
ANLQIDQINTDLNLER

SEQ ID NO: 47306 - protein, 9 aa, Homo sapiens
ASITALEAK

SEQ ID NO: 47307 - protein, 11 aa, Homo sapiens
ASREEILAQAK

SEQ ID NO: 47308 - protein, 13 aa, Homo sapiens
DELADEIANSSGK

SEQ ID NO: 47309 - protein, 21 aa, Homo sapiens
DFSALESQLQDTQELLQEENR

SEQ ID NO: 47310 - protein, 11 aa, Homo sapiens
DLEAHIDSANK

SEQ ID NO: 47311 - protein, 27 aa, Homo sapiens
DLGEELEALKTELEDTLDSTAAQQELR

SEQ ID NO: 47312 - protein, 17 aa, Homo sapiens
DPLNDNIATLLHQSSDK

SEQ ID NO: 47313 - protein, 33 aa, Homo sapiens
EDQSILCTGESGAGKTENTKKVIQYLAYVASSH

SEQ ID NO: 47314 - protein, 17 aa, Homo sapiens
ELESQISELQEDLESER

SEQ ID NO: 47315 - protein, 12 aa, Homo sapiens
EQADFAIEALAK

SEQ ID NO: 47316 - protein, 15 aa, Homo sapiens
FLSNGHVTIPGQQDK

SEQ ID NO: 47317 - protein, 16 aa, Homo sapiens
HEMPPHIYAITDTAYR

SEQ ID NO: 47318 - protein, 16 aa, Homo sapiens
HSQAVEELAEQLEQTK

SEQ ID NO: 47319 - protein, 17 aa, Homo sapiens
HSQAVEELAEQLEQTKR

SEQ ID NO: 47320 - protein, 14 aa, Homo sapiens
IAEFTTNLTEEEEK

SEQ ID NO: 47321 - protein, 13 aa, Homo sapiens
IAQLEEQLDNETK

SEQ ID NO: 47322 - protein, 15 aa, Homo sapiens
IAQLEEQLDNETKER

SEQ ID NO: 47323 - protein, 20 aa, Homo sapiens
IIGLDQVAGMSETALPGAFK

SEQ ID NO: 47324 - protein, 19 aa, Homo sapiens
IRELESQISELQEDLESER

SEQ ID NO: 47325 - protein, 13 aa, Homo sapiens
KKVEAQLQELQVK

SEQ ID NO: 47326 - protein, 15 aa, Homo sapiens
KLEEEQIILEDQNCK

SEQ ID NO: 47327 - protein, 24 aa, Homo sapiens
KLEGDSTDLSDQIAELQAQIAELK

SEQ ID NO: 47328 - protein, 14 aa, Homo sapiens
KQELEEICHDLEAR

SEQ ID NO: 47329 - protein, 12 aa, Homo sapiens
KVEAQLQELQVK

SEQ ID NO: 47330 - protein, 14 aa, Homo sapiens
KVIQYLAYVASSHK

SEQ ID NO: 47331 - protein, 23 aa, Homo sapiens
LEGDSTDLSDQIAELQAQIAELK

SEQ ID NO: 47332 - protein, 12 aa, Homo sapiens
LKDVLLQVDDER

SEQ ID NO: 47333 - protein, 13 aa, Homo sapiens
LKDVLLQVDDERR

SEQ ID NO: 47334 - protein, 21 aa, Homo sapiens
LQLQEQLQAETELCAEAEELR

SEQ ID NO: 47335 - protein, 16 aa, Homo sapiens
LQQELDDLLVDLDHQR

SEQ ID NO: 47336 - protein, 18 aa, Homo sapiens
LQVELDNVTGLLSQSDSK

SEQ ID NO: 47337 - protein, 26 aa, Homo sapiens
LTKDFSALESQLQDTQELLQEENRQK

SEQ ID NO: 47338 - protein, 15 aa, Homo sapiens
NFINNPLAQADWAAK

SEQ ID NO: 47339 - protein, 13 aa, Homo sapiens
NKHEAMITDLEER

SEQ ID NO: 47340 - protein, 19 aa, Homo sapiens
NMDPLNDNIATLLHQSSDK

SEQ ID NO: 47341 - protein, 19 aa, Homo sapiens
PAGPPGILALLDEECWFPK

SEQ ID NO: 47342 - protein, 13 aa, Homo sapiens
QIATLHAQVADMK

SEQ ID NO: 47343 - protein, 16 aa, Homo sapiens
QLLQANPILEAFGNAK

SEQ ID NO: 47344 - protein, 28 aa, Homo sapiens
RDLGEELEALKTELEDTLDSTAAQQELR

SEQ ID NO: 47345 - protein, 10 aa, Homo sapiens
RGDLPFVVPR

SEQ ID NO: 47346 - protein, 25 aa, Homo sapiens
RKLEGDSTDLSDQIAELQAQIAELK

SEQ ID NO: 47347 - protein, 25 aa, Homo sapiens
SGFEPASLKEEVGEEAIVELVENGK

SEQ ID NO: 47348 - protein, 26 aa, Homo sapiens
SGFEPASLKEEVGEEAIVELVENGKK

SEQ ID NO: 47349 - protein, 26 aa, Homo sapiens
SKKDQGELERQLLQANPILEAFGNAK

SEQ ID NO: 47350 - protein, 18 aa, Homo sapiens
SMEAEMIQLQEELAAAER

SEQ ID NO: 47351 - protein, 7 aa, Homo sapiens
SVHELEK

SEQ ID NO: 47352 - protein, 10 aa, Homo sapiens
TDLLLEPYNK

SEQ ID NO: 47353 - protein, 17 aa, Homo sapiens
TELEDTLDSTAAQQELR

SEQ ID NO: 47354 - protein, 17 aa, Homo sapiens
TLEEEAKTHEAQIQEMR

SEQ ID NO: 47355 - protein, 13 aa, Homo sapiens
VIQYLAYVASSHK

SEQ ID NO: 47356 - protein, 14 aa, Homo sapiens
VISGVLQLGNIVFK

SEQ ID NO: 47357 - protein, 9 aa, Homo sapiens
VKPLLQVSR

SEQ ID NO: 47358 - protein, 10 aa, Homo sapiens
VMQEQGTHPK

SEQ ID NO: 47359 - protein, 14 aa, Homo sapiens
VSHLLGINVTDFTR

SEQ ID NO: 47360 - protein, 29 aa, Homo sapiens
RDGEQTEPSRMGSKSPGNTSQPPAFFSKL

SEQ ID NO: 47361 - protein, 10 aa, Homo sapiens
ALIVLAHSER

SEQ ID NO: 47362 - protein, 16 aa, Homo sapiens
DPANFQYPAESVLAYK

SEQ ID NO: 47363 - protein, 13 aa, Homo sapiens
EGHLSPDIVAEQK

SEQ ID NO: 47364 - protein, 11 aa, Homo sapiens
FGLSVGHHLGK

SEQ ID NO: 47365 - protein, 20 aa, Homo sapiens
GWEVVESDLYAMNFNPIISR

SEQ ID NO: 47366 - protein, 21 aa, Homo sapiens
KGWEVVESDLYAMNFNPIISR

SEQ ID NO: 47367 - protein, 23 aa, Homo sapiens
LEAADLVIFQFPLQWFGVPAILK

SEQ ID NO: 47368 - protein, 29 aa, Homo sapiens
LENIWDETPLYFAPSSLFDLNFQAGFLMK

SEQ ID NO: 47369 - protein, 18 aa, Homo sapiens
LKDPANFQYPAESVLAYK

SEQ ID NO: 47370 - protein, 28 aa, Homo sapiens
ANGVSKGNRGTESMDTTYSPIGGKVSDK

SEQ ID NO: 47371 - protein, 19 aa, Homo sapiens
DSTHVIPPEVSFDSRRACV

SEQ ID NO: 47372 - protein, 10 aa, Homo sapiens
FSEEGLVNAR

SEQ ID NO: 47373 - protein, 7 aa, Homo sapiens
LGEIQYK

SEQ ID NO: 47374 - protein, 18 aa, Homo sapiens
NIYTPPDSSTSFIQDYSR

SEQ ID NO: 47375 - protein, 8 aa, Homo sapiens
QQLLSTGR

SEQ ID NO: 47376 - protein, 15 aa, Homo sapiens
STFSRPAFTFNKPYR

SEQ ID NO: 47377 - protein, 8 aa, Homo sapiens
VELDTSNR

SEQ ID NO: 47378 - protein, 13 aa, Homo sapiens
HWEEILQQSLWER

SEQ ID NO: 47379 - protein, 28 aa, Homo sapiens
SLIDMYSEVLDVLSDYDASYNTQDHLPR

SEQ ID NO: 47380 - protein, 10 aa, Homo sapiens
TALNHCNLCR

SEQ ID NO: 47381 - protein, 14 aa, Homo sapiens
VTLSEGPHHVALFK

SEQ ID NO: 47382 - protein, 19 aa, Homo sapiens
MQVPNSTGPDNATLQMLRN

SEQ ID NO: 47383 - protein, 11 aa, Homo sapiens
KVTQLDLDGPK

SEQ ID NO: 47384 - protein, 16 aa, Homo sapiens
QYTSPEEIDAQLQAEK

SEQ ID NO: 47385 - protein, 8 aa, Homo sapiens
EHVDVIAK

SEQ ID NO: 47386 - protein, 7 aa, Homo sapiens
ESSKSAR

SEQ ID NO: 47387 - protein, 11 aa, Homo sapiens
IPLLLTSLSFK

SEQ ID NO: 47388 - protein, 8 aa, Homo sapiens
KLMMTLKK

SEQ ID NO: 47389 - protein, 20 aa, Homo sapiens
LSCQNLGAVLDDVPVQGFFK

SEQ ID NO: 47390 - protein, 28 aa, Homo sapiens
LSDCGLGDLAITSLLLLNQCLEELQGVR

SEQ ID NO: 47391 - protein, 15 aa, Homo sapiens
NVFNPEAFKPGNTHK

SEQ ID NO: 47392 - protein, 37 aa, Homo sapiens
SIKPTHVVVTLEDGIIGCIHASHILDDVPEGTSPTTK

SEQ ID NO: 47393 - protein, 20 aa, Homo sapiens
VKDYGCIVKFYNNVQGLVPK

SEQ ID NO: 47394 - protein, 35 aa, Homo sapiens
VLSAEALKPGMLLTGTVSSLEDHGYLVDIGVDGTR

SEQ ID NO: 47395 - protein, 10 aa, Homo sapiens
VVVLNCEPSK

SEQ ID NO: 47396 - protein, 18 aa, Homo sapiens
VVVLNCEPSKERMLLSFK

SEQ ID NO: 47397 - protein, 30 aa, Homo sapiens
ILQHFHSESKPICAVGHGVAALCCATNEDR

SEQ ID NO: 47398 - protein, 24 aa, Homo sapiens
YHALLIPSCPGALTDLASSGSLAR

SEQ ID NO: 47399 - protein, 8 aa, Homo sapiens
AHGFTFTR

SEQ ID NO: 47400 - protein, 34 aa, Homo sapiens
EIEDAAQFATADPEPPLEELGYHIYSSDPPFEVR

SEQ ID NO: 47401 - protein, 31 aa, Homo sapiens
GFCHLCDGQEACCVGLEAGINPTDHLITAYR

SEQ ID NO: 47402 - protein, 35 aa, Homo sapiens
KEIEDAAQFATADPEPPLEELGYHIYSSDPPFEVR

SEQ ID NO: 47403 - protein, 20 aa, Homo sapiens
MVNSNLASVEELKEIDVEVR

SEQ ID NO: 47404 - protein, 24 aa, Homo sapiens
NFYGGNGIVGAQVPLGAGIALACK

SEQ ID NO: 47405 - protein, 9 aa, Homo sapiens
RGDFIPGLR

SEQ ID NO: 47406 - protein, 15 aa, Homo sapiens
AGPHCPTAQLIATLK

SEQ ID NO: 47407 - protein, 9 aa, Homo sapiens
HITSLEVIK

SEQ ID NO: 47408 - protein, 11 aa, Homo sapiens
ICLDLQAPLYK

SEQ ID NO: 47409 - protein, 12 aa, Homo sapiens
KICLDLQAPLYK

SEQ ID NO: 47410 - protein, 16 aa, Homo sapiens
RIIKEALPDGVNISKE

SEQ ID NO: 47411 - protein, 13 aa, Homo sapiens
EESLDSDLYAELR

SEQ ID NO: 47412 - protein, 15 aa, Homo sapiens
GKEESLDSDLYAELR

SEQ ID NO: 47413 - protein, 14 aa, Homo sapiens
GTHCNQVEVIATLK

SEQ ID NO: 47414 - protein, 9 aa, Homo sapiens
ICLDPDAPR

SEQ ID NO: 47415 - protein, 16 aa, Homo sapiens
IKKIVQKKLAGDESAD

SEQ ID NO: 47416 - protein, 13 aa, Homo sapiens
IVQKKLAGDESAD

SEQ ID NO: 47417 - protein, 10 aa, Homo sapiens
KICLDPDAPR

SEQ ID NO: 47418 - protein, 10 aa, Homo sapiens
NIQSLEVIGK

SEQ ID NO: 47419 - protein, 19 aa, Homo sapiens
NLAKGKEESLDSDLYAELR

SEQ ID NO: 47420 - protein, 8 aa, Homo sapiens
TTSGIHPK

SEQ ID NO: 47421 - protein, 23 aa, Homo sapiens
KLNVNENVECGNNTCTNNEVHNL

SEQ ID NO: 47422 - protein, 18 aa, Homo sapiens
KNASVSISHNSCTAPDKT

SEQ ID NO: 47423 - protein, 17 aa, Homo sapiens
KNIETFTCDTQNITYRF

SEQ ID NO: 47424 - protein, 25 aa, Homo sapiens
KSAPPSQVWNMTVSMTSDNSMHVKC

SEQ ID NO: 47425 - protein, 14 aa, Homo sapiens
KYANITVDYLYNKE

SEQ ID NO: 47426 - protein, 37 aa, Homo sapiens
RNGSAAMCHFTTKSAPPSQVWNMTVSMTSDNSMHVKC

SEQ ID NO: 47427 - protein, 19 aa, Homo sapiens
RTSNTTITANTSDAYLNAS

SEQ ID NO: 47428 - protein, 20 aa, Homo sapiens
RYHLEVEAGNTLVRNESHKN

SEQ ID NO: 47429 - protein, 15 aa, Homo sapiens
YTNWSVEQLPAEPKE

SEQ ID NO: 47430 - protein, 28 aa, Homo sapiens
KLNPTPGSNAISDAYLNASETTTLSPSG

SEQ ID NO: 47431 - protein, 15 aa, Homo sapiens
AFIHWVSQPLMCEVR

SEQ ID NO: 47432 - protein, 15 aa, Homo sapiens
DRPMEESLLLFEAMR

SEQ ID NO: 47433 - protein, 20 aa, Homo sapiens
DVVENGETADQTLSLMEQLR

SEQ ID NO: 47434 - protein, 16 aa, Homo sapiens
EAATQAQQTLGSTIDK

SEQ ID NO: 47435 - protein, 23 aa, Homo sapiens
ECGVGVIVTPEQIEEAVEAAINR

SEQ ID NO: 47436 - protein, 21 aa, Homo sapiens
FFTAICDMVAWLGYTPYKVTY

SEQ ID NO: 47437 - protein, 15 aa, Homo sapiens
GFHQVPFAPIVFIER

SEQ ID NO: 47438 - protein, 9 aa, Homo sapiens
GLAYVCHQR

SEQ ID NO: 47439 - protein, 9 aa, Homo sapiens
HRPQLLVER

SEQ ID NO: 47440 - protein, 13 aa, Homo sapiens
HTGYVIELQHVVK

SEQ ID NO: 47441 - protein, 15 aa, Homo sapiens
IHTEPQLSAALEYVR

SEQ ID NO: 47442 - protein, 14 aa, Homo sapiens
LGYFSVDPDSHQGK

SEQ ID NO: 47443 - protein, 14 aa, Homo sapiens
NEVDMQVLHLLGPK

SEQ ID NO: 47444 - protein, 37 aa, Homo sapiens
NPEDPTEVPGGFLSDLNLASLHVVDAALVDCSVALAK

SEQ ID NO: 47445 - protein, 17 aa, Homo sapiens
TRFPPEPNGILHIGHAK

SEQ ID NO: 47446 - protein, 27 aa, Homo sapiens
WCIYPTYDYTHCLCDSIEHITHSLCTK

SEQ ID NO: 47447 - protein, 13 aa, Homo sapiens
YHFNMGLLMGEAR

SEQ ID NO: 47448 - protein, 36 aa, Homo sapiens
KNGQSLGDLDGIPIAVKDNFSTSGIETTCASNMLKG

SEQ ID NO: 47449 - protein, 11 aa, Homo sapiens
FLLVGDSDVGK

SEQ ID NO: 47450 - protein, 14 aa, Homo sapiens
GAQGILLVYDITNR

SEQ ID NO: 47451 - protein, 12 aa, Homo sapiens
KFLLVGDSDVGK

SEQ ID NO: 47452 - protein, 23 aa, Homo sapiens
KMNDSNSAGAGGPVKITENRSKK

SEQ ID NO: 47453 - protein, 14 aa, Homo sapiens
SSANVEEAFFTLAR

SEQ ID NO: 47454 - protein, 8 aa, Homo sapiens
LAHEVGWK

SEQ ID NO: 47455 - protein, 11 aa, Homo sapiens
YQAVTATLEEK

SEQ ID NO: 47456 - protein, 8 aa, Homo sapiens
ECADLWPR

SEQ ID NO: 47457 - protein, 20 aa, Homo sapiens
ISLGLPVGAVINCADNTGAK

SEQ ID NO: 47458 - protein, 15 aa, Homo sapiens
LPAAGVGDMVMATVK

SEQ ID NO: 47459 - protein, 15 aa, Homo sapiens
PVGAVINCADNTGAK

SEQ ID NO: 47460 - protein, 8 aa, Homo sapiens
VHPAVVIR

SEQ ID NO: 47461 - protein, 7 aa, Homo sapiens
IHGVGFK

SEQ ID NO: 47462 - protein, 14 aa, Homo sapiens
LYTLVTYVPVTTFK

SEQ ID NO: 47463 - protein, 10 aa, Homo sapiens
ELEVLLMCNK

SEQ ID NO: 47464 - protein, 8 aa, Homo sapiens
HMLPSGFR

SEQ ID NO: 47465 - protein, 13 aa, Homo sapiens
SYCAEIAHNVSSK

SEQ ID NO: 47466 - protein, 9 aa, Homo sapiens
LSYNTASNK

SEQ ID NO: 47467 - protein, 9 aa, Homo sapiens
SACGVCPGR

SEQ ID NO: 47468 - protein, 14 aa, Homo sapiens
DVQIGDIVTVGECR

SEQ ID NO: 47469 - protein, 16 aa, Homo sapiens
DVQIGDIVTVGECRPL

SEQ ID NO: 47470 - protein, 17 aa, Homo sapiens
DVQIGDIVTVGECRPLS

SEQ ID NO: 47471 - protein, 18 aa, Homo sapiens
DVQIGDIVTVGECRPLSK

SEQ ID NO: 47472 - protein, 7 aa, Homo sapiens
NIGLGFK

SEQ ID NO: 47473 - protein, 11 aa, Homo sapiens
NMSVHLSPCFR

SEQ ID NO: 47474 - protein, 8 aa, Homo sapiens
RDYLHYIR

SEQ ID NO: 47475 - protein, 21 aa, Homo sapiens
ADRDESSPYAAMLAAQDVAQR

SEQ ID NO: 47476 - protein, 18 aa, Homo sapiens
DESSPYAAMLAAQDVAQR

SEQ ID NO: 47477 - protein, 22 aa, Homo sapiens
EEQVISLGPQVAEGENVFGVCH

SEQ ID NO: 47478 - protein, 24 aa, Homo sapiens
EEQVISLGPQVAEGENVFGVCHIF

SEQ ID NO: 47479 - protein, 10 aa, Homo sapiens
ELGITALHIK

SEQ ID NO: 47480 - protein, 13 aa, Homo sapiens
IEDVTPIPSDSTR

SEQ ID NO: 47481 - protein, 23 aa, Homo sapiens
KEEQVISLGPQVAEGENVFGVCH

SEQ ID NO: 47482 - protein, 25 aa, Homo sapiens
KEEQVISLGPQVAEGENVFGVCHIF

SEQ ID NO: 47483 - protein, 12 aa, Homo sapiens
KQMVIDVLHPGK

SEQ ID NO: 47484 - protein, 11 aa, Homo sapiens
QMVIDVLHPGK

SEQ ID NO: 47485 - protein, 15 aa, Homo sapiens
TTGFGMIYDSLDYAK

SEQ ID NO: 47486 - protein, 12 aa, Homo sapiens
TTPDVIFVFGFR

SEQ ID NO: 47487 - protein, 12 aa, Homo sapiens
DIPGLTDTTVPR

SEQ ID NO: 47488 - protein, 17 aa, Homo sapiens
GCIVDANLSVLNLVIVK

SEQ ID NO: 47489 - protein, 12 aa, Homo sapiens
LNISFPATGCQK

SEQ ID NO: 47490 - protein, 10 aa, Homo sapiens
PGLTDTTVPR

SEQ ID NO: 47491 - protein, 8 aa, Homo sapiens
QGVLTHGR

SEQ ID NO: 47492 - protein, 7 aa, Homo sapiens
HIDFSLR

SEQ ID NO: 47493 - protein, 12 aa, Homo sapiens
KQVVNIPSFIVR

SEQ ID NO: 47494 - protein, 8 aa, Homo sapiens
LIGEYGLR

SEQ ID NO: 47495 - protein, 10 aa, Homo sapiens
SPYGGGRPGR

SEQ ID NO: 47496 - protein, 23 aa, Homo sapiens
DLCDGQLEGAEIGSTEITFTPEK

SEQ ID NO: 47497 - protein, 30 aa, Homo sapiens
GNGIIIIAETSTGCLFAGSSLGKRGVNADK

SEQ ID NO: 47498 - protein, 23 aa, Homo sapiens
RASLNHSTAFNPQPQSQMQDTRQ

SEQ ID NO: 47499 - protein, 15 aa, Homo sapiens
LRPLFEACGEVVQIR

SEQ ID NO: 47500 - protein, 21 aa, Homo sapiens
LRPLFEACGEVVQIRPIFSNR

SEQ ID NO: 47501 - protein, 29 aa, Homo sapiens
MSEIFPLTEELWLEWLHDEISMAQDGLDR

SEQ ID NO: 47502 - protein, 10 aa, Homo sapiens
SALQALEMDR

SEQ ID NO: 47503 - protein, 14 aa, Homo sapiens
DLVPDLSNFYAQYK

SEQ ID NO: 47504 - protein, 28 aa, Homo sapiens
EKLDGLYECILCACCSTSCPSYWWNGDK

SEQ ID NO: 47505 - protein, 16 aa, Homo sapiens
AKPDEFSALCDLLGTR

SEQ ID NO: 47506 - protein, 16 aa, Homo sapiens
AQDGSHPLSLQDLIEK

SEQ ID NO: 47507 - protein, 25 aa, Homo sapiens
EALAAVLTYAKPDEFSALCDLLGTR

SEQ ID NO: 47508 - protein, 17 aa, Homo sapiens
EQTLSPTITSGLHNIAR

SEQ ID NO: 47509 - protein, 20 aa, Homo sapiens
GILAIAWSMADPELLLSCGK

SEQ ID NO: 47510 - protein, 11 aa, Homo sapiens
KPIPDEHLILK

SEQ ID NO: 47511 - protein, 25 aa, Homo sapiens
LENEGDSLLQTQACLCYICAGNVEK

SEQ ID NO: 47512 - protein, 36 aa, Homo sapiens
LSSSFGNLDPFGTGQPLPPLQIPQQTAQHSIVLPLK

SEQ ID NO: 47513 - protein, 34 aa, Homo sapiens
MHCSGLAWHPDVATQMVLASEDDRLPVIQMWDLR

SEQ ID NO: 47514 - protein, 14 aa, Homo sapiens
QVQHILASASPSGR

SEQ ID NO: 47515 - protein, 12 aa, Homo sapiens
RPVGASFSFGGK

SEQ ID NO: 47516 - protein, 10 aa, Homo sapiens
SCATFSSSHR

SEQ ID NO: 47517 - protein, 19 aa, Homo sapiens
SDQLQQAVQSQGFINYCQK

SEQ ID NO: 47518 - protein, 14 aa, Homo sapiens
TQPPEDISCIAWNR

SEQ ID NO: 47519 - protein, 13 aa, Homo sapiens
KDVNYTQIVVDRT

SEQ ID NO: 47520 - protein, 18 aa, Homo sapiens
KNLLIFNLSEGDSGVYQC

SEQ ID NO: 47521 - protein, 15 aa, Homo sapiens
RAANYTSSLNLPDKT

SEQ ID NO: 47522 - protein, 16 aa, Homo sapiens
REAVFAVNALNISEKQ

SEQ ID NO: 47523 - protein, 26 aa, Homo sapiens
REVHLVQFHEPDIYNYSALLLSEDKD

SEQ ID NO: 47524 - protein, 15 aa, Homo sapiens
YNLSTAEEVFSHGKY

SEQ ID NO: 47525 - protein, 18 aa, Homo sapiens
APVDFGYVGIDSILEQMR

SEQ ID NO: 47526 - protein, 14 aa, Homo sapiens
AVVGSDHEYQVNGK

SEQ ID NO: 47527 - protein, 12 aa, Homo sapiens
DITSSIHFEAYR

SEQ ID NO: 47528 - protein, 15 aa, Homo sapiens
LEPKPQPPVAEATPR

SEQ ID NO: 47529 - protein, 24 aa, Homo sapiens
LTVIDTPGFGDHINNENCWQPIMK

SEQ ID NO: 47530 - protein, 28 aa, Homo sapiens
PAEAPTAPSPAQTLENSEPAPVSQLQSR

SEQ ID NO: 47531 - protein, 15 aa, Homo sapiens
RTEITIVKPQESAHR

SEQ ID NO: 47532 - protein, 14 aa, Homo sapiens
TEITIVKPQESAHR

SEQ ID NO: 47533 - protein, 13 aa, Homo sapiens
VHCCLYFIPATGH

SEQ ID NO: 47534 - protein, 24 aa, Homo sapiens
VHCCLYFIPATGHSLRPLDIEFMK

SEQ ID NO: 47535 - protein, 15 aa, Homo sapiens
VPEVPTAPATDAAPK

SEQ ID NO: 47536 - protein, 10 aa, Homo sapiens
VVNIVPVIAK

SEQ ID NO: 47537 - protein, 18 aa, Homo sapiens
WGTIEVENTTHCEFAYLR

SEQ ID NO: 47538 - protein, 17 aa, Homo sapiens
AQIHEQNPSVEVVYYNK

SEQ ID NO: 47539 - protein, 13 aa, Homo sapiens
SSIHISNLEPELR

SEQ ID NO: 47540 - protein, 26 aa, Homo sapiens
RNSKNCTEPALHEFPNDIFTNEDRRQ

SEQ ID NO: 47541 - protein, 11 aa, Homo sapiens
AFEGQAHGADR

SEQ ID NO: 47542 - protein, 20 aa, Homo sapiens
LWGTQDVSQDIQEMKDESAR

SEQ ID NO: 47543 - protein, 9 aa, Homo sapiens
QVTVLELFR

SEQ ID NO: 47544 - protein, 19 aa, Homo sapiens
YNSMPVPGPNGTILMETHK

SEQ ID NO: 47545 - protein, 29 aa, Homo sapiens
DIQNTQCLLNVEHLSAGCPHVTLQFADSK

SEQ ID NO: 47546 - protein, 19 aa, Homo sapiens
DTNGENIAESLVAEGLATR

SEQ ID NO: 47547 - protein, 31 aa, Homo sapiens
DVQIILESCHNQNILGTILHPNGNITELLLK

SEQ ID NO: 47548 - protein, 12 aa, Homo sapiens
DYVAPTANLDQK

SEQ ID NO: 47549 - protein, 16 aa, Homo sapiens
ETCLITFLLAGIECPR

SEQ ID NO: 47550 - protein, 11 aa, Homo sapiens
IHVFYIDYGNR

SEQ ID NO: 47551 - protein, 14 aa, Homo sapiens
LRPLYDIPYMFEAR

SEQ ID NO: 47552 - protein, 16 aa, Homo sapiens
NDIASHPPVEGSYAPR

SEQ ID NO: 47553 - protein, 21 aa, Homo sapiens
NLPGLVQEGEPFSEEATLFTK

SEQ ID NO: 47554 - protein, 31 aa, Homo sapiens
SASYKPVFVTEITDDLHFYVQDVETGTQLEK

SEQ ID NO: 47555 - protein, 13 aa, Homo sapiens
SSHYDELLAAEAR

SEQ ID NO: 47556 - protein, 11 aa, Homo sapiens
TIHLSSIRPPR

SEQ ID NO: 47557 - protein, 23 aa, Homo sapiens
VLPAQATEYAFAFIQVPQDDDAR

SEQ ID NO: 47558 - protein, 24 aa, Homo sapiens
VNVTVDYIRPASPATETVPAFSER

SEQ ID NO: 47559 - protein, 21 aa, Homo sapiens
ADDLGKGGNEESTKTGNAGSR

SEQ ID NO: 47560 - protein, 20 aa, Homo sapiens
AVCVLKGDGPVQGIINFEQK

SEQ ID NO: 47561 - protein, 24 aa, Homo sapiens
DGVADVSIEDSVISLSGDHCIIGR

SEQ ID NO: 47562 - protein, 14 aa, Homo sapiens
GCTSAGPHFNPLSR

SEQ ID NO: 47563 - protein, 14 aa, Homo sapiens
GDGPVQGIINFEQK

SEQ ID NO: 47564 - protein, 27 aa, Homo sapiens
GLTEGLHGFHVHEFGDNTAGCTSAGPH

SEQ ID NO: 47565 - protein, 31 aa, Homo sapiens
GLTEGLHGFHVHEFGDNTAGCTSAGPHFNPL

SEQ ID NO: 47566 - protein, 33 aa, Homo sapiens
GLTEGLHGFHVHEFGDNTAGCTSAGPHFNPLSR

SEQ ID NO: 47567 - protein, 34 aa, Homo sapiens
GLTEGLHGFHVHEFGDNTAGCTSAGPHFNPLSRK

SEQ ID NO: 47568 - protein, 10 aa, Homo sapiens
GPVKVWGSIK

SEQ ID NO: 47569 - protein, 12 aa, Homo sapiens
HVGDLGNVTADK

SEQ ID NO: 47570 - protein, 36 aa, Homo sapiens
HVGDLGNVTADKDGVADVSIEDSVISLSGDHCIIGR

SEQ ID NO: 47571 - protein, 10 aa, Homo sapiens
KHGGPKDEER

SEQ ID NO: 47572 - protein, 10 aa, Homo sapiens
LACGVIGIAQ

SEQ ID NO: 47573 - protein, 7 aa, Homo sapiens
TLVVHEK

SEQ ID NO: 47574 - protein, 16 aa, Homo sapiens
TLVVHEKADDLGKGGN

SEQ ID NO: 47575 - protein, 21 aa, Homo sapiens
TLVVHEKADDLGKGGNEESTK

SEQ ID NO: 47576 - protein, 28 aa, Homo sapiens
TLVVHEKADDLGKGGNEESTKTGNAGSR

SEQ ID NO: 47577 - protein, 38 aa, Homo sapiens
TLVVHEKADDLGKGGNEESTKTGNAGSRLACGVIGIAQ

SEQ ID NO: 47578 - protein, 21 aa, Homo sapiens
DLDPNEVWEIVGELGDGAFGK

SEQ ID NO: 47579 - protein, 24 aa, Homo sapiens
NPETRPSAAQLLEHPFVSSITSNK

SEQ ID NO: 47580 - protein, 25 aa, Homo sapiens
SEEELEDYIVEIEILATCDHPYIVK

SEQ ID NO: 47581 - protein, 16 aa, Homo sapiens
KLRIFYQFLYNNNTRQ

SEQ ID NO: 47582 - protein, 12 aa, Homo sapiens
KQVPLIPDLNQT

SEQ ID NO: 47583 - protein, 23 aa, Homo sapiens
RKDENESSAPADGEGGSELQPKN

SEQ ID NO: 47584 - protein, 8 aa, Homo sapiens
IEVMSLGR

SEQ ID NO: 47585 - protein, 12 aa, Homo sapiens
IGDTVTCVCQFK

SEQ ID NO: 47586 - protein, 30 aa, Homo sapiens
DKAKKEHERSNASPAIFPEYQLWEDHWIRC

SEQ ID NO: 47587 - protein, 20 aa, Homo sapiens
DSDMDPNSSGEGVNSVSSSI

SEQ ID NO: 47588 - protein, 16 aa, Homo sapiens
HKIVNSSMELAQTAKE

SEQ ID NO: 47589 - protein, 16 aa, Homo sapiens
IYPYLVMNDACLTESR

SEQ ID NO: 47590 - protein, 7 aa, Homo sapiens
NYSIAQK

SEQ ID NO: 47591 - protein, 22 aa, Homo sapiens
TLELCVDNLQPDFLYDHIQPVR

SEQ ID NO: 47592 - protein, 11 aa, Homo sapiens
VLWLLSFDDDK

SEQ ID NO: 47593 - protein, 33 aa, Homo sapiens
HESESCDCLQGFQIVHSLGGGTGSGMGTLLMNK

SEQ ID NO: 47594 - protein, 23 aa, Homo sapiens
LGALFQPDSFVHGNSGAGNNWAK

SEQ ID NO: 47595 - protein, 25 aa, Homo sapiens
LTTPTYGDLNHLVSLTMSGITTSLR

SEQ ID NO: 47596 - protein, 10 aa, Homo sapiens
APDFVFYAPR

SEQ ID NO: 47597 - protein, 26 aa, Homo sapiens
EGILSDEIYCPPETAVLLGSYAVQAK

SEQ ID NO: 47598 - protein, 8 aa, Homo sapiens
FVIKPIDK

SEQ ID NO: 47599 - protein, 9 aa, Homo sapiens
FVIKPIDKK

SEQ ID NO: 47600 - protein, 17 aa, Homo sapiens
FYPEDVAEELIQDITQK

SEQ ID NO: 47601 - protein, 9 aa, Homo sapiens
IGFPWSEIR

SEQ ID NO: 47602 - protein, 9 aa, Homo sapiens
IQVWHAEHR

SEQ ID NO: 47603 - protein, 11 aa, Homo sapiens
KAPDFVFYAPR

SEQ ID NO: 47604 - protein, 11 aa, Homo sapiens
KPDTIEVQQMK

SEQ ID NO: 47605 - protein, 7 aa, Homo sapiens
LFFLQVK

SEQ ID NO: 47606 - protein, 28 aa, Homo sapiens
MPKPINVRVTTMDAELEFAIQPNTTGKQ

SEQ ID NO: 47607 - protein, 16 aa, Homo sapiens
PPETAVLLGSYAVQAK

SEQ ID NO: 47608 - protein, 12 aa, Homo sapiens
RKPDTIEVQQMK

SEQ ID NO: 47609 - protein, 15 aa, Homo sapiens
SQEQLAAELAEYTAK

SEQ ID NO: 47610 - protein, 12 aa, Homo sapiens
THNDIIHNENMR

SEQ ID NO: 47611 - protein, 16 aa, Homo sapiens
DGQVHLFEHILNGYCK

SEQ ID NO: 47612 - protein, 16 aa, Homo sapiens
GDNSSVSSLCISPDGK

SEQ ID NO: 47613 - protein, 16 aa, Homo sapiens
KPLTSNCTIQIATPGK

SEQ ID NO: 47614 - protein, 17 aa, Homo sapiens
STPKPIPILAAGFCSDK

SEQ ID NO: 47615 - protein, 20 aa, Homo sapiens
VNCIQWHQDSGCLYSCSDDK

SEQ ID NO: 47616 - protein, 13 aa, Homo sapiens
GHTSFVNSCYPAR

SEQ ID NO: 47617 - protein, 28 aa, Homo sapiens
LPGHAGSINEVAFHPDEPIIISASSDKR

SEQ ID NO: 47618 - protein, 18 aa, Homo sapiens
ACYLSINPQKDETLETEK

SEQ ID NO: 47619 - protein, 28 aa, Homo sapiens
APELLFRPDLIGEESEGIHEVLVFAIQK

SEQ ID NO: 47620 - protein, 17 aa, Homo sapiens
AQYYLPDGSTIEIGPSR

SEQ ID NO: 47621 - protein, 23 aa, Homo sapiens
MESYDVIANQPVVIDNGSGVIKA

SEQ ID NO: 47622 - protein, 16 aa, Homo sapiens
TLFSNIVLSGGSTLFK

SEQ ID NO: 47623 - protein, 19 aa, Homo sapiens
ACNVLQSSHLEDYPFDAEY

SEQ ID NO: 47624 - protein, 20 aa, Homo sapiens
ATFLDAWEAMEELVDEGLVK

SEQ ID NO: 47625 - protein, 21 aa, Homo sapiens
HIDCAYVYQNEHEVGEAIQEK

SEQ ID NO: 47626 - protein, 18 aa, Homo sapiens
YKPVTNQVECHPYLTQEK

SEQ ID NO: 47627 - protein, 8 aa, Homo sapiens
AAQEEYVK

SEQ ID NO: 47628 - protein, 9 aa, Homo sapiens
AAQEEYVKR

SEQ ID NO: 47629 - protein, 12 aa, Homo sapiens
ADDGRPFPQVIK

SEQ ID NO: 47630 - protein, 11 aa, Homo sapiens
ALANSLACQGK

SEQ ID NO: 47631 - protein, 8 aa, Homo sapiens
ALQASALK

SEQ ID NO: 47632 - protein, 17 aa, Homo sapiens
ALSDHHIYLEGTLLKPN

SEQ ID NO: 47633 - protein, 23 aa, Homo sapiens
ALSDHHIYLEGTLLKPNMVTPGH

SEQ ID NO: 47634 - protein, 28 aa, Homo sapiens
ALSDHHIYLEGTLLKPNMVTPGHACTQK

SEQ ID NO: 47635 - protein, 11 aa, Homo sapiens
CPLLKPWALTF

SEQ ID NO: 47636 - protein, 15 aa, Homo sapiens
CPLLKPWALTFSYGR

SEQ ID NO: 47637 - protein, 9 aa, Homo sapiens
DGADFAKWR

SEQ ID NO: 47638 - protein, 8 aa, Homo sapiens
ELSDIAHR

SEQ ID NO: 47639 - protein, 15 aa, Homo sapiens
FSHEEIAMATVTALR

SEQ ID NO: 47640 - protein, 10 aa, Homo sapiens
GGVVGIKVDK

SEQ ID NO: 47641 - protein, 14 aa, Homo sapiens
GILAADESTGSIAK

SEQ ID NO: 47642 - protein, 15 aa, Homo sapiens
GILAADESTGSIAKR

SEQ ID NO: 47643 - protein, 23 aa, Homo sapiens
GVVPLAGTNGETTTQGLDGLSER

SEQ ID NO: 47644 - protein, 20 aa, Homo sapiens
IGEHTPSALAIMENANVLAR

SEQ ID NO: 47645 - protein, 20 aa, Homo sapiens
IVAPGKGILAADESTGSIAK

SEQ ID NO: 47646 - protein, 21 aa, Homo sapiens
IVAPGKGILAADESTGSIAKR

SEQ ID NO: 47647 - protein, 9 aa, Homo sapiens
KELSDIAHR

SEQ ID NO: 47648 - protein, 13 aa, Homo sapiens
LQSIGTENTEENR

SEQ ID NO: 47649 - protein, 14 aa, Homo sapiens
LQSIGTENTEENRR

SEQ ID NO: 47650 - protein, 11 aa, Homo sapiens
MVTPGHACTQK

SEQ ID NO: 47651 - protein, 16 aa, Homo sapiens
PCIGGVILFHETLYQK

SEQ ID NO: 47652 - protein, 13 aa, Homo sapiens
PYQYPALTPEQKK

SEQ ID NO: 47653 - protein, 9 aa, Homo sapiens
QLLLTADDR

SEQ ID NO: 47654 - protein, 15 aa, Homo sapiens
RLQSIGTENTEENRR

SEQ ID NO: 47655 - protein, 28 aa, Homo sapiens
RYASICQQNGIVPIVEPEILPDGDHDLK

SEQ ID NO: 47656 - protein, 30 aa, Homo sapiens
TVPPAVTGITFLSGGQSEEEASINLNAINK

SEQ ID NO: 47657 - protein, 26 aa, Homo sapiens
VDKGVVPLAGTNGETTTQGLDGLSER

SEQ ID NO: 47658 - protein, 18 aa, Homo sapiens
VNPCIGGVILFHETLYQK

SEQ ID NO: 47659 - protein, 27 aa, Homo sapiens
YASICQQNGIVPIVEPEILPDGDHDLK

SEQ ID NO: 47660 - protein, 28 aa, Homo sapiens
YASICQQNGIVPIVEPEILPDGDHDLKR

SEQ ID NO: 47661 - protein, 22 aa, Homo sapiens
YTPSGQAGAAASESLFVSNHAY

SEQ ID NO: 47662 - protein, 21 aa, Homo sapiens
SVGPYSFLVVANTFNGTSTKV

SEQ ID NO: 47663 - protein, 20 aa, Homo sapiens
KTMLVQKNVTSESTCCVAKS

SEQ ID NO: 47664 - protein, 8 aa, Homo sapiens
VTVMGGFK

SEQ ID NO: 47665 - protein, 34 aa, Homo sapiens
PINATLAVEKEGCPVCITVNTTICAGYCPTMTRV

SEQ ID NO: 47666 - protein, 13 aa, Homo sapiens
EITGFDLMDLFSV

SEQ ID NO: 47667 - protein, 25 aa, Homo sapiens
GEKGDPGLPGEPGLQGRPGELGPQG

SEQ ID NO: 47668 - protein, 27 aa, Homo sapiens
DLEEHIISAGLADMVAAAETITTDSEK

SEQ ID NO: 47669 - protein, 14 aa, Homo sapiens
IHQALKEDILEFIK

SEQ ID NO: 47670 - protein, 37 aa, Homo sapiens
MSDLVEITNLIDSKKHITVFGSTEGESSDDSLVDLAV

SEQ ID NO: 47671 - protein, 15 aa, Homo sapiens
RLVSFEVPQNTSVKI

SEQ ID NO: 47672 - protein, 37 aa, Homo sapiens
RSVTPLQASGGLVLLEEMLALGNNHFIGFVNDSVTKS

SEQ ID NO: 47673 - protein, 7 aa, Homo sapiens
DIAAHIK

SEQ ID NO: 47674 - protein, 22 aa, Homo sapiens
NADMSEEMQQDSVECATQALEK

SEQ ID NO: 47675 - protein, 11 aa, Homo sapiens
NFGSYVTHETK

SEQ ID NO: 47676 - protein, 11 aa, Homo sapiens
YNPTWHCIVGR

SEQ ID NO: 47677 - protein, 22 aa, Homo sapiens
RERTSSSIVFEDSGCDNASSKE

SEQ ID NO: 47678 - protein, 25 aa, Homo sapiens
KYEYLMTLHGVVNESTVCLMGHERR

SEQ ID NO: 47679 - protein, 23 aa, Homo sapiens
RIGVRDVRLNGSAASHVLHQDSG

SEQ ID NO: 47680 - protein, 19 aa, Homo sapiens
RWSLISLSNNSGKNVELKF

SEQ ID NO: 47681 - protein, 18 aa, Homo sapiens
AGYIIPLQGPGLTTTESR

SEQ ID NO: 47682 - protein, 18 aa, Homo sapiens
AHFPLDVQWNDLDYMDSR

SEQ ID NO: 47683 - protein, 10 aa, Homo sapiens
DAQAHPGRPR

SEQ ID NO: 47684 - protein, 14 aa, Homo sapiens
DFPAMVQELHQGGR

SEQ ID NO: 47685 - protein, 10 aa, Homo sapiens
DFTFNKDGFR

SEQ ID NO: 47686 - protein, 18 aa, Homo sapiens
DGFRDFPAMVQELHQGGR

SEQ ID NO: 47687 - protein, 27 aa, Homo sapiens
DSSTWTVDHQLLWGEALLITPVLQAGK

SEQ ID NO: 47688 - protein, 26 aa, Homo sapiens
ELSGSSPVLEETHPAHQQGASRPGPR

SEQ ID NO: 47689 - protein, 25 aa, Homo sapiens
EPAIHSEGQWVTLPAPLDTINVHLR

SEQ ID NO: 47690 - protein, 11 aa, Homo sapiens
GAYTQVIFLAR

SEQ ID NO: 47691 - protein, 16 aa, Homo sapiens
GELFWDDGESLEVLER

SEQ ID NO: 47692 - protein, 9 aa, Homo sapiens
GTRPFVISR

SEQ ID NO: 47693 - protein, 29 aa, Homo sapiens
ICASSHQFLSTHYNLHNLYGLTEAIASHR

SEQ ID NO: 47694 - protein, 19 aa, Homo sapiens
KLENLSSSEMGYTATLTRT

SEQ ID NO: 47695 - protein, 10 aa, Homo sapiens
LDVMMETENR

SEQ ID NO: 47696 - protein, 11 aa, Homo sapiens
LHFTIKDPANR

SEQ ID NO: 47697 - protein, 12 aa, Homo sapiens
LHFTIKDPANRR

SEQ ID NO: 47698 - protein, 24 aa, Homo sapiens
NHNSLLSLPQEPYSFSEPAQQAMR

SEQ ID NO: 47699 - protein, 12 aa, Homo sapiens
QQPMALAVALTK

SEQ ID NO: 47700 - protein, 17 aa, Homo sapiens
RGVFITNETGQPLIGKV

SEQ ID NO: 47701 - protein, 12 aa, Homo sapiens
RNNTIVNELVRV

SEQ ID NO: 47702 - protein, 28 aa, Homo sapiens
RQVVENMTRAHFPLDVQWNDLDYMDSRR

SEQ ID NO: 47703 - protein, 12 aa, Homo sapiens
RVLLNTTVAPLF

SEQ ID NO: 47704 - protein, 8 aa, Homo sapiens
STFAGHGR

SEQ ID NO: 47705 - protein, 12 aa, Homo sapiens
VPTQCDVPPNSR

SEQ ID NO: 47706 - protein, 12 aa, Homo sapiens
VTSEGAGLQLQK

SEQ ID NO: 47707 - protein, 30 aa, Homo sapiens
VTVLGVATAPQQVLSNGVPVSNFTYSPDTK

SEQ ID NO: 47708 - protein, 10 aa, Homo sapiens
WGYSSTAITR

SEQ ID NO: 47709 - protein, 12 aa, Homo sapiens
WTQLGAFYPFMR

SEQ ID NO: 47710 - protein, 26 aa, Homo sapiens
YMMIVDPAISSSGPAGSYRPYDEGLR

SEQ ID NO: 47711 - protein, 18 aa, Homo sapiens
KINPKNYTENELEKITRR

SEQ ID NO: 47712 - protein, 17 aa, Homo sapiens
IFEDIPTLEDLAETLKK

SEQ ID NO: 47713 - protein, 9 aa, Homo sapiens
INQLCSQTK

SEQ ID NO: 47714 - protein, 19 aa, Homo sapiens
NGFLEVYPFTLVADVNADR

SEQ ID NO: 47715 - protein, 17 aa, Homo sapiens
VLSTTKPFEYETPEMEK

SEQ ID NO: 47716 - protein, 22 aa, Homo sapiens
EDIDLFEVEDTIGQQLEFLTTK

SEQ ID NO: 47717 - protein, 19 aa, Homo sapiens
LCHNALDVQSLSALGFVYK

SEQ ID NO: 47718 - protein, 17 aa, Homo sapiens
RNTSPDTNYTLYYWHRS

SEQ ID NO: 47719 - protein, 28 aa, Homo sapiens
MDSSCHNATTKMLATAPARGNMMSTSKP

SEQ ID NO: 47720 - protein, 17 aa, Homo sapiens
KDFANMTSLVDLTLSRN

SEQ ID NO: 47721 - protein, 16 aa, Homo sapiens
AGAGSATLSMAYAGAR

SEQ ID NO: 47722 - protein, 9 aa, Homo sapiens
ANTFVAELK

SEQ ID NO: 47723 - protein, 21 aa, Homo sapiens
DDLFNTNATIVATLTAACAQH

SEQ ID NO: 47724 - protein, 10 aa, Homo sapiens
EGVVECSFVK

SEQ ID NO: 47725 - protein, 12 aa, Homo sapiens
FVFSLVDAMNGK

SEQ ID NO: 47726 - protein, 13 aa, Homo sapiens
GCDVVVIPAGVPR

SEQ ID NO: 47727 - protein, 13 aa, Homo sapiens
GYLGPEQLPDCLK

SEQ ID NO: 47728 - protein, 20 aa, Homo sapiens
ICVIANPVNSTIPITAEVFK

SEQ ID NO: 47729 - protein, 11 aa, Homo sapiens
IFGVTTLDIVR

SEQ ID NO: 47730 - protein, 10 aa, Homo sapiens
IQEAGTEVVK

SEQ ID NO: 47731 - protein, 22 aa, Homo sapiens
LTLYDIAHTPGVAADLSHIETK

SEQ ID NO: 47732 - protein, 20 aa, Homo sapiens
LYDIAHTPGVAADLSHIETK

SEQ ID NO: 47733 - protein, 10 aa, Homo sapiens
MISDAIPELK

SEQ ID NO: 47734 - protein, 17 aa, Homo sapiens
SQETECTYFSTPLLLGK

SEQ ID NO: 47735 - protein, 12 aa, Homo sapiens
TIIPLISQCTPK

SEQ ID NO: 47736 - protein, 21 aa, Homo sapiens
TLYDIAHTPGVAADLSHIETK

SEQ ID NO: 47737 - protein, 19 aa, Homo sapiens
VAVLGASGGIGQPLSLLLK

SEQ ID NO: 47738 - protein, 14 aa, Homo sapiens
VDFPQDQLTALTGR

SEQ ID NO: 47739 - protein, 12 aa, Homo sapiens
VNVPVIGGHAGK

SEQ ID NO: 47740 - protein, 21 aa, Homo sapiens
AADHDVGSELPPEGVLGALLR

SEQ ID NO: 47741 - protein, 35 aa, Homo sapiens
AALRPRPPVYDDGPAGPDAEEAGDETPDVDPELLR

SEQ ID NO: 47742 - protein, 20 aa, Homo sapiens
ADHDVGSELPPEGVLGALLR

SEQ ID NO: 47743 - protein, 10 aa, Homo sapiens
ALAHLLEAER

SEQ ID NO: 47744 - protein, 13 aa, Homo sapiens
ALAHLLEAERQER

SEQ ID NO: 47745 - protein, 15 aa, Homo sapiens
ALAHLLEAERQERAR

SEQ ID NO: 47746 - protein, 14 aa, Homo sapiens
ARAEAQEAEDQQAR

SEQ ID NO: 47747 - protein, 21 aa, Homo sapiens
ARAEAQEAEDQQARVLAQLLR

SEQ ID NO: 47748 - protein, 19 aa, Homo sapiens
DHDVGSELPPEGVLGALLR

SEQ ID NO: 47749 - protein, 12 aa, Homo sapiens
GEAAGAVQELAR

SEQ ID NO: 47750 - protein, 16 aa, Homo sapiens
GLSAASPPLAETGAPR

SEQ ID NO: 47751 - protein, 15 aa, Homo sapiens
ILAGSADSEGVAAPR

SEQ ID NO: 47752 - protein, 21 aa, Homo sapiens
NSDPALGLDDDPDAPAAQLAR

SEQ ID NO: 47753 - protein, 11 aa, Homo sapiens
PPEGVLGALLR

SEQ ID NO: 47754 - protein, 14 aa, Homo sapiens
PRGEAAGAVQELAR

SEQ ID NO: 47755 - protein, 16 aa, Homo sapiens
SVPRGEAAGAVQELAR

SEQ ID NO: 47756 - protein, 14 aa, Homo sapiens
VKRLETPAPQVPAR

SEQ ID NO: 47757 - protein, 15 aa, Homo sapiens
VKRLETPAPQVPARR

SEQ ID NO: 47758 - protein, 7 aa, Homo sapiens
VLAQLLR

SEQ ID NO: 47759 - protein, 27 aa, Homo sapiens
VWGAPRNSDPALGLDDDPDAPAAQLAR

SEQ ID NO: 47760 - protein, 13 aa, Homo sapiens
LHVGNISPTCTNK

SEQ ID NO: 47761 - protein, 16 aa, Homo sapiens
VADLTEQYNEQYGAVR

SEQ ID NO: 47762 - protein, 28 aa, Homo sapiens
AGTEALPDGLSVEDILNLLGMESAANQK

SEQ ID NO: 47763 - protein, 14 aa, Homo sapiens
FPVGPPKNDDTPNR

SEQ ID NO: 47764 - protein, 24 aa, Homo sapiens
FPVGPPKNDDTPNRQYWDEDLLMK

SEQ ID NO: 47765 - protein, 14 aa, Homo sapiens
LENVQKFPSPEMIR

SEQ ID NO: 47766 - protein, 19 aa, Homo sapiens
LFEKPLDSQSIYQLIEISR

SEQ ID NO: 47767 - protein, 11 aa, Homo sapiens
NQLLQKEPDLR

SEQ ID NO: 47768 - protein, 17 aa, Homo sapiens
NQLLQKEPDLRLENVQK

SEQ ID NO: 47769 - protein, 25 aa, Homo sapiens
SGQLGIQEEDLRKESKDQLSDDVSK

SEQ ID NO: 47770 - protein, 9 aa, Homo sapiens
SGYPKTPGR

SEQ ID NO: 47771 - protein, 26 aa, Homo sapiens
TNEIVEEQYTPQSLATLESVFQELGK

SEQ ID NO: 47772 - protein, 12 aa, Homo sapiens
VLEYLNQEKAEK

SEQ ID NO: 47773 - protein, 18 aa, Homo sapiens
VLEYLNQEKAEKGREHIA

SEQ ID NO: 47774 - protein, 19 aa, Homo sapiens
KENNLTEDNPNLSMAQRRH

SEQ ID NO: 47775 - protein, 25 aa, Homo sapiens
RTTSTLSLSAEDSQSTESNMSVPKK

SEQ ID NO: 47776 - protein, 23 aa, Homo sapiens
KDLNGNVFQDAVFNQTVTVIERE

SEQ ID NO: 47777 - protein, 15 aa, Homo sapiens
AFAGPSQKPETIELR

SEQ ID NO: 47778 - protein, 10 aa, Homo sapiens
AVAEPGIQLK

SEQ ID NO: 47779 - protein, 22 aa, Homo sapiens
CDACPVGFTGPMVQGVGISFAK

SEQ ID NO: 47780 - protein, 19 aa, Homo sapiens
DIFGDACDNCLSVLNNDQK

SEQ ID NO: 47781 - protein, 10 aa, Homo sapiens
KPQDFLEELK

SEQ ID NO: 47782 - protein, 25 aa, Homo sapiens
KYRCNDTIPEDFQEFQTQNFDRFDN

SEQ ID NO: 47783 - protein, 25 aa, Homo sapiens
LNPGALLPVLTDPALNDLYVISTFK

SEQ ID NO: 47784 - protein, 16 aa, Homo sapiens
SSATIFGLYSSTDNSK

SEQ ID NO: 47785 - protein, 15 aa, Homo sapiens
VHLVVFNNLQLADGR

SEQ ID NO: 47786 - protein, 34 aa, Homo sapiens
AATAPLLEAVDNLSAFASNPEFSSIPAQISPEGR

SEQ ID NO: 47787 - protein, 20 aa, Homo sapiens
ACEFAGFQCQIQFGPHNEQK

SEQ ID NO: 47788 - protein, 14 aa, Homo sapiens
AGALQCSPSDAYTK

SEQ ID NO: 47789 - protein, 11 aa, Homo sapiens
AHATGAGPAGR

SEQ ID NO: 47790 - protein, 38 aa, Homo sapiens
ALCGFTEAAAQAAYLVGVSDPNSQAGQQGLVEPTQFAR

SEQ ID NO: 47791 - protein, 20 aa, Homo sapiens
AVEGCVSASQAATEDGQLLR

SEQ ID NO: 47792 - protein, 26 aa, Homo sapiens
AVSSAIAQLLGEVAQGNENYAGIAAR

SEQ ID NO: 47793 - protein, 21 aa, Homo sapiens
DKAPGQLECETAIAALNSCLR

SEQ ID NO: 47794 - protein, 19 aa, Homo sapiens
ECANGYLELLDHVLLTLQK

SEQ ID NO: 47795 - protein, 25 aa, Homo sapiens
ECANGYLELLDHVLLTLQKPSPELK

SEQ ID NO: 47796 - protein, 31 aa, Homo sapiens
EGISQEALHTQMLTAVQEISHLIEPLANAAR

SEQ ID NO: 47797 - protein, 11 aa, Homo sapiens
FFYSDQNVDSR

SEQ ID NO: 47798 - protein, 30 aa, Homo sapiens
GTEWVDPEDPTVIAENELLGAAAAIEAAAK

SEQ ID NO: 47799 - protein, 25 aa, Homo sapiens
GVAALTSDPAVQAIVLDTASDVLDK

SEQ ID NO: 47800 - protein, 21 aa, Homo sapiens
GVGAAATAVTQALNELLQHVK

SEQ ID NO: 47801 - protein, 10 aa, Homo sapiens
HTSALCNSCR

SEQ ID NO: 47802 - protein, 13 aa, Homo sapiens
IGITNHDEYSLVR

SEQ ID NO: 47803 - protein, 8 aa, Homo sapiens
KLEQLKPR

SEQ ID NO: 47804 - protein, 14 aa, Homo sapiens
LHTDDELNWLDHGR

SEQ ID NO: 47805 - protein, 21 aa, Homo sapiens
LLAALLEDEGGSGRPLLQAAK

SEQ ID NO: 47806 - protein, 20 aa, Homo sapiens
LNEAAAGLNQAATELVQASR

SEQ ID NO: 47807 - protein, 25 aa, Homo sapiens
MVAAATNNLCEAANAAVQGHASQEK

SEQ ID NO: 47808 - protein, 16 aa, Homo sapiens
NGNLPEFGDAISTASK

SEQ ID NO: 47809 - protein, 16 aa, Homo sapiens
PAAVAAENEEIGSHIK

SEQ ID NO: 47810 - protein, 21 aa, Homo sapiens
QAAASATQTIAAAQHAASTPK

SEQ ID NO: 47811 - protein, 16 aa, Homo sapiens
RAATAPLLEAVDNLSA

SEQ ID NO: 47812 - protein, 29 aa, Homo sapiens
TEDSGLQTQVIAAATQCALSTSQLVACTK

SEQ ID NO: 47813 - protein, 23 aa, Homo sapiens
VGAIPANALDDGQWSQGLISAAR

SEQ ID NO: 47814 - protein, 12 aa, Homo sapiens
VLVQNAAGSQEK

SEQ ID NO: 47815 - protein, 14 aa, Homo sapiens
VQELGHGCAALVTK

SEQ ID NO: 47816 - protein, 13 aa, Homo sapiens
VSHVLAALQAGNR

SEQ ID NO: 47817 - protein, 20 aa, Homo sapiens
VVAPTISSPVCQEQLVEAGR

SEQ ID NO: 47818 - protein, 10 aa, Homo sapiens
LLSESAQPLK

SEQ ID NO: 47819 - protein, 11 aa, Homo sapiens
RRPQPYPYPSK

SEQ ID NO: 47820 - protein, 23 aa, Homo sapiens
RRRPQPYPYPSKKLLSESAQPLK

SEQ ID NO: 47821 - protein, 12 aa, Homo sapiens
VDVTEQPGLSGR

SEQ ID NO: 47822 - protein, 17 aa, Homo sapiens
RSSNLTTHKIIHTGEKP

SEQ ID NO: 47823 - protein, 13 aa, Homo sapiens
AGVFSDLSNQELK

SEQ ID NO: 47824 - protein, 14 aa, Homo sapiens
ALCLFEMPTGVPLR

SEQ ID NO: 47825 - protein, 9 aa, Homo sapiens
AVHSFLWSK

SEQ ID NO: 47826 - protein, 10 aa, Homo sapiens
CLAFTDVAPR

SEQ ID NO: 47827 - protein, 9 aa, Homo sapiens
DNGPNYVQR

SEQ ID NO: 47828 - protein, 8 aa, Homo sapiens
DTVIVWPR

SEQ ID NO: 47829 - protein, 7 aa, Homo sapiens
FLDKGER

SEQ ID NO: 47830 - protein, 10 aa, Homo sapiens
FYGSPEELAR

SEQ ID NO: 47831 - protein, 13 aa, Homo sapiens
GDFPSPIHVSGPR

SEQ ID NO: 47832 - protein, 17 aa, Homo sapiens
GHDSTEEPPLFSSHKPR

SEQ ID NO: 47833 - protein, 7 aa, Homo sapiens
GQVLVLR

SEQ ID NO: 47834 - protein, 14 aa, Homo sapiens
KAGVFSDLSNQELK

SEQ ID NO: 47835 - protein, 17 aa, Homo sapiens
LHTHLIGNIHTHLVHYR

SEQ ID NO: 47836 - protein, 25 aa, Homo sapiens
LQIHSMADQVLPPGWQEEQAITWAR

SEQ ID NO: 47837 - protein, 11 aa, Homo sapiens
LQPSSTTTMAK

SEQ ID NO: 47838 - protein, 8 aa, Homo sapiens
LVQPHGPR

SEQ ID NO: 47839 - protein, 9 aa, Homo sapiens
NSFQTLQMK

SEQ ID NO: 47840 - protein, 18 aa, Homo sapiens
RDCSMPPPFSYNGTYRPV

SEQ ID NO: 47841 - protein, 8 aa, Homo sapiens
RSWLIIQR

SEQ ID NO: 47842 - protein, 16 aa, Homo sapiens
SSSGLQVLNVHFGGER

SEQ ID NO: 47843 - protein, 7 aa, Homo sapiens
SWLIIQR

SEQ ID NO: 47844 - protein, 9 aa, Homo sapiens
VDLDVAGTK

SEQ ID NO: 47845 - protein, 15 aa, Homo sapiens
VVQPTLEQTQYSWER

SEQ ID NO: 47846 - protein, 16 aa, Homo sapiens
YLLFTSPQENPWGHKR

SEQ ID NO: 47847 - protein, 7 aa, Homo sapiens
YPLAVTK

SEQ ID NO: 47848 - protein, 22 aa, Homo sapiens
ACLISLGYDIGNDPQGEAEFAR

SEQ ID NO: 47849 - protein, 17 aa, Homo sapiens
AGTQIENIEEDFRDGLK

SEQ ID NO: 47850 - protein, 18 aa, Homo sapiens
AIMTYVSSFYHAFSGAQK

SEQ ID NO: 47851 - protein, 8 aa, Homo sapiens
ALDFIASK

SEQ ID NO: 47852 - protein, 11 aa, Homo sapiens
ASIHEAWTDGK

SEQ ID NO: 47853 - protein, 10 aa, Homo sapiens
ATLPDADKER

SEQ ID NO: 47854 - protein, 16 aa, Homo sapiens
DDPLTNLNTAFDVAEK

SEQ ID NO: 47855 - protein, 11 aa, Homo sapiens
DGLGFCALIHR

SEQ ID NO: 47856 - protein, 13 aa, Homo sapiens
ELPPDQAEYCIAR

SEQ ID NO: 47857 - protein, 11 aa, Homo sapiens
GISQEQMNEFR

SEQ ID NO: 47858 - protein, 10 aa, Homo sapiens
HRPELIDYGK

SEQ ID NO: 47859 - protein, 14 aa, Homo sapiens
ICDQWDNLGALTQK

SEQ ID NO: 47860 - protein, 20 aa, Homo sapiens
IDQLEGDHQLIQEALIFDNK

SEQ ID NO: 47861 - protein, 17 aa, Homo sapiens
ISIEMHGTLEDQLSHLR

SEQ ID NO: 47862 - protein, 26 aa, Homo sapiens
IVQTYHVNMAGTNPYTTITPQEINGK

SEQ ID NO: 47863 - protein, 18 aa, Homo sapiens
KAGTQIENIEEDFRDGLK

SEQ ID NO: 47864 - protein, 17 aa, Homo sapiens
KDDPLTNLNTAFDVAEK

SEQ ID NO: 47865 - protein, 12 aa, Homo sapiens
LAILGIHNEVSK

SEQ ID NO: 47866 - protein, 10 aa, Homo sapiens
LASDLLEWIR

SEQ ID NO: 47867 - protein, 14 aa, Homo sapiens
LLETIDQLYLEYAK

SEQ ID NO: 47868 - protein, 12 aa, Homo sapiens
LMLLLEVISGER

SEQ ID NO: 47869 - protein, 13 aa, Homo sapiens
LSNRPAFMPSEGR

SEQ ID NO: 47870 - protein, 18 aa, Homo sapiens
MAGTNPYTTITPQEINGK

SEQ ID NO: 47871 - protein, 16 aa, Homo sapiens
MLDAEDIVGTARPDEK

SEQ ID NO: 47872 - protein, 17 aa, Homo sapiens
MVSDINNAWGCLEQVEK

SEQ ID NO: 47873 - protein, 12 aa, Homo sapiens
NVNIQNFHISWK

SEQ ID NO: 47874 - protein, 14 aa, Homo sapiens
PLTNLNTAFDVAEK

SEQ ID NO: 47875 - protein, 11 aa, Homo sapiens
PPDQAEYCIAR

SEQ ID NO: 47876 - protein, 11 aa, Homo sapiens
RDQALTEEHAR

SEQ ID NO: 47877 - protein, 12 aa, Homo sapiens
TINEVENQILTR

SEQ ID NO: 47878 - protein, 12 aa, Homo sapiens
VGWEQLLTTIAR

SEQ ID NO: 47879 - protein, 17 aa, Homo sapiens
VLAVNQENEQLMEDYEK

SEQ ID NO: 47880 - protein, 13 aa, Homo sapiens
VSSFYHAFSGAQK

SEQ ID NO: 47881 - protein, 21 aa, Homo sapiens
ADEEFDVVVCDQVSACIPVFR

SEQ ID NO: 47882 - protein, 11 aa, Homo sapiens
FLLLSINRYER

SEQ ID NO: 47883 - protein, 20 aa, Homo sapiens
MVQQSDLGQYVTFLRSFSDK

SEQ ID NO: 47884 - protein, 17 aa, Homo sapiens
RKKNLTLALEALVQLRG

SEQ ID NO: 47885 - protein, 30 aa, Homo sapiens
AGQLTSEEDTLSLVTADHSHVFSFGGYPLR

SEQ ID NO: 47886 - protein, 13 aa, Homo sapiens
GNEVISVMNRAKK

SEQ ID NO: 47887 - protein, 17 aa, Homo sapiens
HVPDSGATATAYLCGVK

SEQ ID NO: 47888 - protein, 23 aa, Homo sapiens
TYNVDKHVPDSGATATAYLCGVK

SEQ ID NO: 47889 - protein, 22 aa, Homo sapiens
AYQGTPLPANILDWQALNYEIR

SEQ ID NO: 47890 - protein, 7 aa, Homo sapiens
AYSDLSR

SEQ ID NO: 47891 - protein, 10 aa, Homo sapiens
AYSLFSYNTQ

SEQ ID NO: 47892 - protein, 12 aa, Homo sapiens
AYSLFSYNTQGR

SEQ ID NO: 47893 - protein, 8 aa, Homo sapiens
DNELLVYK

SEQ ID NO: 47894 - protein, 10 aa, Homo sapiens
DNELLVYKER

SEQ ID NO: 47895 - protein, 12 aa, Homo sapiens
EKPLQNFTLCFR

SEQ ID NO: 47896 - protein, 6 aa, Homo sapiens
ELLVYK

SEQ ID NO: 47897 - protein, 13 aa, Homo sapiens
ESVTDHVNLITPL

SEQ ID NO: 47898 - protein, 15 aa, Homo sapiens
ESVTDHVNLITPLEK

SEQ ID NO: 47899 - protein, 22 aa, Homo sapiens
ESVTDHVNLITPLEKPLQNFTL

SEQ ID NO: 47900 - protein, 25 aa, Homo sapiens
ESVTDHVNLITPLEKPLQNFTLCFR

SEQ ID NO: 47901 - protein, 9 aa, Homo sapiens
FAHTDLSGK

SEQ ID NO: 47902 - protein, 13 aa, Homo sapiens
GLRQGYFVEAQPK

SEQ ID NO: 47903 - protein, 11 aa, Homo sapiens
GYVIIKPLVWV

SEQ ID NO: 47904 - protein, 7 aa, Homo sapiens
HTDLSGK

SEQ ID NO: 47905 - protein, 13 aa, Homo sapiens
HTDLSGKVFVFPR

SEQ ID NO: 47906 - protein, 12 aa, Homo sapiens
ILDWQALNYEIR

SEQ ID NO: 47907 - protein, 25 aa, Homo sapiens
ILSAYQGTPLPANILDWQALNYEIR

SEQ ID NO: 47908 - protein, 16 aa, Homo sapiens
ITPLEKPLQNFTLCFR

SEQ ID NO: 47909 - protein, 10 aa, Homo sapiens
IVLGQEQDSY

SEQ ID NO: 47910 - protein, 13 aa, Homo sapiens
IVLGQEQDSYGGK

SEQ ID NO: 47911 - protein, 16 aa, Homo sapiens
IVLGQEQDSYGGKFDR

SEQ ID NO: 47912 - protein, 13 aa, Homo sapiens
LEKPLQNFTLCFR

SEQ ID NO: 47913 - protein, 11 aa, Homo sapiens
LGQEQDSYGGK

SEQ ID NO: 47914 - protein, 13 aa, Homo sapiens
NILDWQALNYEIR

SEQ ID NO: 47915 - protein, 14 aa, Homo sapiens
PLEKPLQNFTLCFR

SEQ ID NO: 47916 - protein, 20 aa, Homo sapiens
QGTPLPANILDWQALNYEIR

SEQ ID NO: 47917 - protein, 10 aa, Homo sapiens
QGYFVEAQPK

SEQ ID NO: 47918 - protein, 27 aa, Homo sapiens
RESVTDHVNLITPLEKPLQNFTLCFRA

SEQ ID NO: 47919 - protein, 23 aa, Homo sapiens
SAYQGTPLPANILDWQALNYEIR

SEQ ID NO: 47920 - protein, 10 aa, Homo sapiens
SLFSYNTQGR

SEQ ID NO: 47921 - protein, 12 aa, Homo sapiens
SQSFVGEIGDLY

SEQ ID NO: 47922 - protein, 47 aa, Homo sapiens
SQSFVGEIGDLYMWDSVLPPENILSAYQGTPLPANILDWQALNYEIR

SEQ ID NO: 47923 - protein, 16 aa, Homo sapiens
SSGIAEFWINGTPLVK

SEQ ID NO: 47924 - protein, 22 aa, Homo sapiens
TDHVNLITPLEKPLQNFTLCFR

SEQ ID NO: 47925 - protein, 15 aa, Homo sapiens
TPLEKPLQNFTLCFR

SEQ ID NO: 47926 - protein, 6 aa, Homo sapiens
VFVFPR

SEQ ID NO: 47927 - protein, 10 aa, Homo sapiens
VGEYSLYIGR

SEQ ID NO: 47928 - protein, 16 aa, Homo sapiens
VGEYSLYIGRHKVTSK

SEQ ID NO: 47929 - protein, 23 aa, Homo sapiens
VTDHVNLITPLEKPLQNFTLCFR

SEQ ID NO: 47930 - protein, 15 aa, Homo sapiens
MNLNTSSNTGDTQRL

SEQ ID NO: 47931 - protein, 15 aa, Homo sapiens
QNSELQAKTNETEKA

SEQ ID NO: 47932 - protein, 28 aa, Homo sapiens
ASEEDHTNAACFACILLSHGEENVIYGK

SEQ ID NO: 47933 - protein, 17 aa, Homo sapiens
GSWFVQALCSILEEHGK

SEQ ID NO: 47934 - protein, 25 aa, Homo sapiens
RGTELDDGIQADSGPINDTDANPRY

SEQ ID NO: 47935 - protein, 8 aa, Homo sapiens
AGLQVYNK

SEQ ID NO: 47936 - protein, 10 aa, Homo sapiens
ENELTYYCCK

SEQ ID NO: 47937 - protein, 12 aa, Homo sapiens
FEHCNFNDVTTR

SEQ ID NO: 47938 - protein, 18 aa, Homo sapiens
KTAVNCSSDFDACLITKA

SEQ ID NO: 47939 - protein, 14 aa, Homo sapiens
LQCYNCPNPTADCK

SEQ ID NO: 47940 - protein, 12 aa, Homo sapiens
LRENELTYYCCK

SEQ ID NO: 47941 - protein, 13 aa, Homo sapiens
LRENELTYYCCKK

SEQ ID NO: 47942 - protein, 49 aa, Homo sapiens
AASAAGAAGSAGGSSGAAGAAGGGAGAGTRPGDGGTASAGAAGPGAATK

SEQ ID NO: 47943 - protein, 14 aa, Homo sapiens
LQLDNQYAVLENQK

SEQ ID NO: 47944 - protein, 30 aa, Homo sapiens
TAPVQAPPAPVIVTETPEPAMTSGVYRPPG

SEQ ID NO: 47945 - protein, 38 aa, Homo sapiens
KEEKSVLILPPRAGTPKLFNAALAMTGKMGGKGAKGGK

SEQ ID NO: 47946 - protein, 17 aa, Homo sapiens
SCMDSTVKYMNFYKIPK

SEQ ID NO: 47947 - protein, 16 aa, Homo sapiens
DAAIQTTPSCNSFDGK

SEQ ID NO: 47948 - protein, 21 aa, Homo sapiens
DTGTAPFAPNLEEINNILESK

SEQ ID NO: 47949 - protein, 21 aa, Homo sapiens
RVRAGSLQLSSMSAGNSSLRR

SEQ ID NO: 47950 - protein, 33 aa, Homo sapiens
SQGTLIIHSEDPLTVKDPICAHGNDDLLPPVDR

SEQ ID NO: 47951 - protein, 16 aa, Homo sapiens
TQHSCLSSQDSVNTSR

SEQ ID NO: 47952 - protein, 17 aa, Homo sapiens
VSPHASLQELAPIICSK

SEQ ID NO: 47953 - protein, 18 aa, Homo sapiens
DEPMDFKINTDEIMTSLK

SEQ ID NO: 47954 - protein, 29 aa, Homo sapiens
GPGPQGPPGKNGETGPQGPPGPTGPGGDK

SEQ ID NO: 47955 - protein, 11 aa, Homo sapiens
KHWWTDSSAEK

SEQ ID NO: 47956 - protein, 12 aa, Homo sapiens
KHWWTDSSAEKK

SEQ ID NO: 47957 - protein, 16 aa, Homo sapiens
LMGSNEGEFKAEGNSK

SEQ ID NO: 47958 - protein, 14 aa, Homo sapiens
NSIAYMDQASGNVK

SEQ ID NO: 47959 - protein, 15 aa, Homo sapiens
NSIAYMDQASGNVKK

SEQ ID NO: 47960 - protein, 18 aa, Homo sapiens
NSIAYMDQASGNVKKALK

SEQ ID NO: 47961 - protein, 21 aa, Homo sapiens
ILDEEVFEGDIQQLLFVSDHR

SEQ ID NO: 47962 - protein, 13 aa, Homo sapiens
KNVTLILDCKKKT

SEQ ID NO: 47963 - protein, 20 aa, Homo sapiens
KVYCNFTAGGSTCVFPDKKS

SEQ ID NO: 47964 - protein, 19 aa, Homo sapiens
QLYPASAFPEDFSILTTVK

SEQ ID NO: 47965 - protein, 11 aa, Homo sapiens
RPLGTQQNPAR

SEQ ID NO: 47966 - protein, 22 aa, Homo sapiens
SPVFLYEDHTGKPGPEDYPLFR

SEQ ID NO: 47967 - protein, 13 aa, Homo sapiens
SSKGPDVAYRVTK

SEQ ID NO: 47968 - protein, 13 aa, Homo sapiens
VLDFHNLPDGITK

SEQ ID NO: 47969 - protein, 21 aa, Homo sapiens
VLDFHNLPDGITKTTGFCATR

SEQ ID NO: 47970 - protein, 9 aa, Homo sapiens
ALTFELTLR

SEQ ID NO: 47971 - protein, 25 aa, Homo sapiens
CDEAQVLQVWDDPYPEVLSQEPFHK

SEQ ID NO: 47972 - protein, 16 aa, Homo sapiens
FIQSQDYQCSALMGGR

SEQ ID NO: 47973 - protein, 9 aa, Homo sapiens
HTFTLSLPR

SEQ ID NO: 47974 - protein, 16 aa, Homo sapiens
HTNYSFSPWHGFTIHR

SEQ ID NO: 47975 - protein, 22 aa, Homo sapiens
IPVIEPSVPELVVKPGATVTLR

SEQ ID NO: 47976 - protein, 9 aa, Homo sapiens
KLANATTKD

SEQ ID NO: 47977 - protein, 29 aa, Homo sapiens
KVLTLNLDQVDFQHAGNYSCVASNVQGKH

SEQ ID NO: 47978 - protein, 30 aa, Homo sapiens
KVMVEAYPGLQGFNWTYLGPFSDHQPEPKL

SEQ ID NO: 47979 - protein, 13 aa, Homo sapiens
LAIPQQSDFHNNR

SEQ ID NO: 47980 - protein, 16 aa, Homo sapiens
LGLNPYPGILVNSKFY

SEQ ID NO: 47981 - protein, 6 aa, Homo sapiens
LLLLYK

SEQ ID NO: 47982 - protein, 15 aa, Homo sapiens
LLTDPVLEAGVSLVR

SEQ ID NO: 47983 - protein, 8 aa, Homo sapiens
PGATVTLR

SEQ ID NO: 47984 - protein, 15 aa, Homo sapiens
PGPPALTLVPAELVR

SEQ ID NO: 47985 - protein, 9 aa, Homo sapiens
PWHGFTIHR

SEQ ID NO: 47986 - protein, 18 aa, Homo sapiens
RHTNYSFSPWHGFTIHRA

SEQ ID NO: 47987 - protein, 30 aa, Homo sapiens
RVVESAYLNLSSEQNLIQEVTVGEGLNLKV

SEQ ID NO: 47988 - protein, 17 aa, Homo sapiens
VIPGPPALTLVPAELVR

SEQ ID NO: 47989 - protein, 27 aa, Homo sapiens
VLTLNLDQVDFQHAGNYSCVASNVQGK

SEQ ID NO: 47990 - protein, 28 aa, Homo sapiens
VMVEAYPGLQGFNWTYLGPFSDHQPEPK

SEQ ID NO: 47991 - protein, 21 aa, Homo sapiens
VTVQSLLTVETLEHNQTYECR

SEQ ID NO: 47992 - protein, 22 aa, Homo sapiens
VVESAYLNLSSEQNLIQEVTVG

SEQ ID NO: 47993 - protein, 16 aa, Homo sapiens
EALCGCTVNVPTLDGR

SEQ ID NO: 47994 - protein, 18 aa, Homo sapiens
EGDQTSNNIPADIVFVLK

SEQ ID NO: 47995 - protein, 30 aa, Homo sapiens
KGSGPSGGSGGGANGTSFSYTFHGDPHAMF

SEQ ID NO: 47996 - protein, 12 aa, Homo sapiens
KKQDPPVTHDLR

SEQ ID NO: 47997 - protein, 12 aa, Homo sapiens
VSLEEIYSGCTK

SEQ ID NO: 47998 - protein, 9 aa, Homo sapiens
DEKPVEAIR

SEQ ID NO: 47999 - protein, 10 aa, Homo sapiens
LIESAEELIR

SEQ ID NO: 48000 - protein, 11 aa, Homo sapiens
LKNDNTEAFYK

SEQ ID NO: 48001 - protein, 17 aa, Homo sapiens
SNPSENEEKEAQSQLIK

SEQ ID NO: 48002 - protein, 21 aa, Homo sapiens
SQALNAFGSGDYTAAIAFLDK

SEQ ID NO: 48003 - protein, 20 aa, Homo sapiens
KSNISPNFNFMGQLLDFERS

SEQ ID NO: 48004 - protein, 9 aa, Homo sapiens
HLSAEDFSR

SEQ ID NO: 48005 - protein, 20 aa, Homo sapiens
HLSAEDFSRVFAMSPEEFGK

SEQ ID NO: 48006 - protein, 30 aa, Homo sapiens
LQKQPLTSPGSVSPSRDSSVPGSPSSIVAK

SEQ ID NO: 48007 - protein, 9 aa, Homo sapiens
MILKEEMEK

SEQ ID NO: 48008 - protein, 18 aa, Homo sapiens
SLPDRTPFHTSLHQGTSK

SEQ ID NO: 48009 - protein, 12 aa, Homo sapiens
SPGIISQASAPR

SEQ ID NO: 48010 - protein, 26 aa, Homo sapiens
TSLPHFHHPETSRPDSNIYKKPPIYK

SEQ ID NO: 48011 - protein, 28 aa, Homo sapiens
TSLPHFHHPETSRPDSNIYKKPPIYKQR

SEQ ID NO: 48012 - protein, 11 aa, Homo sapiens
VFAMSPEEFGK

SEQ ID NO: 48013 - protein, 24 aa, Homo sapiens
AAQAQGQSCEYSLMVGYQCGQVFR

SEQ ID NO: 48014 - protein, 17 aa, Homo sapiens
CATPHGDNASLEATFVK

SEQ ID NO: 48015 - protein, 18 aa, Homo sapiens
CATPHGDNASLEATFVKR

SEQ ID NO: 48016 - protein, 9 aa, Homo sapiens
CCHCCLLGR

SEQ ID NO: 48017 - protein, 11 aa, Homo sapiens
CLAFECPENYR

SEQ ID NO: 48018 - protein, 12 aa, Homo sapiens
CLAFECPENYRR

SEQ ID NO: 48019 - protein, 16 aa, Homo sapiens
CVDVDECAPPAEPCGK

SEQ ID NO: 48020 - protein, 9 aa, Homo sapiens
CVNSPGSFR

SEQ ID NO: 48021 - protein, 11 aa, Homo sapiens
DCSLPYATESK

SEQ ID NO: 48022 - protein, 14 aa, Homo sapiens
DCSLPYATESKECR

SEQ ID NO: 48023 - protein, 17 aa, Homo sapiens
DSSCGTGYELTEDNSCK

SEQ ID NO: 48024 - protein, 13 aa, Homo sapiens
DVLLEACCADGHR

SEQ ID NO: 48025 - protein, 10 aa, Homo sapiens
GYHLNEEGTR

SEQ ID NO: 48026 - protein, 30 aa, Homo sapiens
GYQLSDVDGVTCEDIDECALPTGGHICSYR

SEQ ID NO: 48027 - protein, 10 aa, Homo sapiens
HGTVSSFVAK

SEQ ID NO: 48028 - protein, 16 aa, Homo sapiens
HLSFPTNIQAPAVVFR

SEQ ID NO: 48029 - protein, 16 aa, Homo sapiens
IIEVEEEQEDPYLNDR

SEQ ID NO: 48030 - protein, 13 aa, Homo sapiens
ITGGNEEGFFTTR

SEQ ID NO: 48031 - protein, 20 aa, Homo sapiens
ITYYHLSFPTNIQAPAVVFR

SEQ ID NO: 48032 - protein, 19 aa, Homo sapiens
KVSPHSGVVALTKPVPEPR

SEQ ID NO: 48033 - protein, 7 aa, Homo sapiens
LPCHENR

SEQ ID NO: 48034 - protein, 17 aa, Homo sapiens
MATHQKDCSLPYATESK

SEQ ID NO: 48035 - protein, 20 aa, Homo sapiens
MATHQKDCSLPYATESKECR

SEQ ID NO: 48036 - protein, 10 aa, Homo sapiens
MCVDVNECQR

SEQ ID NO: 48037 - protein, 28 aa, Homo sapiens
MGPSSAVPGDSMQLAITGGNEEGFFTTR

SEQ ID NO: 48038 - protein, 28 aa, Homo sapiens
MVQEQCCHSQLEELHCATGISLANEQDR

SEQ ID NO: 48039 - protein, 29 aa, Homo sapiens
NCQDIDECVTGIHNCSINETCFNIQGGFR

SEQ ID NO: 48040 - protein, 17 aa, Homo sapiens
NVPNCGRGYHLNEEGTR

SEQ ID NO: 48041 - protein, 19 aa, Homo sapiens
RCATPHGDNASLEATFVKR

SEQ ID NO: 48042 - protein, 10 aa, Homo sapiens
RCCHCCLLGR

SEQ ID NO: 48043 - protein, 31 aa, Homo sapiens
RNCQDIDECVTGIHNCSINETCFNIQGGFRC

SEQ ID NO: 48044 - protein, 14 aa, Homo sapiens
SGVVALTKPVPEPR

SEQ ID NO: 48045 - protein, 17 aa, Homo sapiens
SQETGDLDVGGLQETDK

SEQ ID NO: 48046 - protein, 33 aa, Homo sapiens
SQETGDLDVGGLQETDKIIEVEEEQEDPYLNDR

SEQ ID NO: 48047 - protein, 10 aa, Homo sapiens
TGYYFDGISR

SEQ ID NO: 48048 - protein, 12 aa, Homo sapiens
VSPHSGVVALTK

SEQ ID NO: 48049 - protein, 18 aa, Homo sapiens
VSPHSGVVALTKPVPEPR

SEQ ID NO: 48050 - protein, 23 aa, Homo sapiens
AITPPHPASQANIIFDITEGNLR

SEQ ID NO: 48051 - protein, 12 aa, Homo sapiens
EFTRPEEIIFLR

SEQ ID NO: 48052 - protein, 11 aa, Homo sapiens
IIFDITEGNLR

SEQ ID NO: 48053 - protein, 14 aa, Homo sapiens
LEMNYVVGGVVSHR

SEQ ID NO: 48054 - protein, 25 aa, Homo sapiens
PNDVTCVFDPVHTISHTVISLPTFR

SEQ ID NO: 48055 - protein, 16 aa, Homo sapiens
PVHTISHTVISLPTFR

SEQ ID NO: 48056 - protein, 9 aa, Homo sapiens
SAATLQQEK

SEQ ID NO: 48057 - protein, 14 aa, Homo sapiens
SAATLQQEKTDTVR

SEQ ID NO: 48058 - protein, 28 aa, Homo sapiens
SCRPNDVTCVFDPVHTISHTVISLPTFR

SEQ ID NO: 48059 - protein, 11 aa, Homo sapiens
YMDGMTVGVVR

SEQ ID NO: 48060 - protein, 10 aa, Homo sapiens
YVVGGVVSHR

SEQ ID NO: 48061 - protein, 13 aa, Homo sapiens
KLTLLPAVVMHLK

SEQ ID NO: 48062 - protein, 28 aa, Homo sapiens
SAIDYSDSAMLQAQQLLLGLGSFLEDAR

SEQ ID NO: 48063 - protein, 18 aa, Homo sapiens
VTENIPQIISFIEGIIAR

SEQ ID NO: 48064 - protein, 17 aa, Homo sapiens
VVDAILGLAHHGNGQLR

SEQ ID NO: 48065 - protein, 9 aa, Homo sapiens
AANMHAQIK

SEQ ID NO: 48066 - protein, 16 aa, Homo sapiens
EVQVTMCIGACPSQFR

SEQ ID NO: 48067 - protein, 16 aa, Homo sapiens
TDTGVSLQTYDDLLAK

SEQ ID NO: 48068 - protein, 20 aa, Homo sapiens
FVLQDGAHHMVDSNEISFIR

SEQ ID NO: 48069 - protein, 27 aa, Homo sapiens
GVQPLLDAVLEYLPNPSEVQNYAILNK

SEQ ID NO: 48070 - protein, 22 aa, Homo sapiens
QELIECVANSDEQLGEMFLEEK

SEQ ID NO: 48071 - protein, 15 aa, Homo sapiens
YQPCLPSTQEDVINK

SEQ ID NO: 48072 - protein, 18 aa, Homo sapiens
DIQAAGGIVTAEDLNNYR

SEQ ID NO: 48073 - protein, 9 aa, Homo sapiens
EPDNHVYTR

SEQ ID NO: 48074 - protein, 9 aa, Homo sapiens
FVDVTEVVR

SEQ ID NO: 48075 - protein, 12 aa, Homo sapiens
GGLSVAVPGEIR

SEQ ID NO: 48076 - protein, 9 aa, Homo sapiens
GLAAALENK

SEQ ID NO: 48077 - protein, 10 aa, Homo sapiens
GLAAALENKR

SEQ ID NO: 48078 - protein, 8 aa, Homo sapiens
GYELAHQR

SEQ ID NO: 48079 - protein, 8 aa, Homo sapiens
KAEVINAR

SEQ ID NO: 48080 - protein, 10 aa, Homo sapiens
LFQPSIQLAR

SEQ ID NO: 48081 - protein, 13 aa, Homo sapiens
NIDQAVTAALETR

SEQ ID NO: 48082 - protein, 7 aa, Homo sapiens
QGFPVGK

SEQ ID NO: 48083 - protein, 19 aa, Homo sapiens
QPLSSMCPTIMVGQDGQVR

SEQ ID NO: 48084 - protein, 17 aa, Homo sapiens
RLAFATMFNSSEQSQKG

SEQ ID NO: 48085 - protein, 16 aa, Homo sapiens
RLHNQLLPNVTTVERN

SEQ ID NO: 48086 - protein, 34 aa, Homo sapiens
RLTLPQLADTYETLAIEGAQAFYNGSLTAQIVKD

SEQ ID NO: 48087 - protein, 12 aa, Homo sapiens
TAGGWAAASDSR

SEQ ID NO: 48088 - protein, 7 aa, Homo sapiens
TLLGDPK

SEQ ID NO: 48089 - protein, 14 aa, Homo sapiens
QVNGLVLSVVLPER

SEQ ID NO: 48090 - protein, 20 aa, Homo sapiens
RAAENASLGPTNGSKLMNRQ

SEQ ID NO: 48091 - protein, 30 aa, Homo sapiens
FNVGEDCPVFDGLFEFCQLSTGGSVASAVK

SEQ ID NO: 48092 - protein, 19 aa, Homo sapiens
LHISPSNMTNQNTNEYLEK

SEQ ID NO: 48093 - protein, 12 aa, Homo sapiens
SIRPDNMSEYSK

SEQ ID NO: 48094 - protein, 17 aa, Homo sapiens
ATENDIYNFFSPLNPVR

SEQ ID NO: 48095 - protein, 26 aa, Homo sapiens
EEIVQFFSGLEIVPNGITLPVDPEGK

SEQ ID NO: 48096 - protein, 29 aa, Homo sapiens
GLPWSCSVEDVQNFLSDCTIHDGAAGVHF

SEQ ID NO: 48097 - protein, 33 aa, Homo sapiens
GLPWSCSVEDVQNFLSDCTIHDGAAGVHFIYTR

SEQ ID NO: 48098 - protein, 17 aa, Homo sapiens
ITGEAFVQFASQELAEK

SEQ ID NO: 48099 - protein, 31 aa, Homo sapiens
PWSCSVEDVQNFLSDCTIHDGAAGVHFIYTR

SEQ ID NO: 48100 - protein, 28 aa, Homo sapiens
RYIELFLNSTTGASNGAYSSQVMQGMGV

SEQ ID NO: 48101 - protein, 14 aa, Homo sapiens
YGDSEFTVQSTTGH

SEQ ID NO: 48102 - protein, 17 aa, Homo sapiens
YGDSEFTVQSTTGHCVH

SEQ ID NO: 48103 - protein, 19 aa, Homo sapiens
YGDSEFTVQSTTGHCVHMR

SEQ ID NO: 48104 - protein, 12 aa, Homo sapiens
AKFEELNMDLFR

SEQ ID NO: 48105 - protein, 9 aa, Homo sapiens
ALSSQHQAR

SEQ ID NO: 48106 - protein, 12 aa, Homo sapiens
DAGTIAGLNVMR

SEQ ID NO: 48107 - protein, 18 aa, Homo sapiens
DNHLLGTFDLTGIPPAPR

SEQ ID NO: 48108 - protein, 22 aa, Homo sapiens
EDVGTVVGIDLGTTYSCVGVFK

SEQ ID NO: 48109 - protein, 28 aa, Homo sapiens
EEEDKKEDVGTVVGIDLGTTYSCVGVFK

SEQ ID NO: 48110 - protein, 12 aa, Homo sapiens
ELEEIVQPIISK

SEQ ID NO: 48111 - protein, 10 aa, Homo sapiens
FEELNMDLFR

SEQ ID NO: 48112 - protein, 18 aa, Homo sapiens
GVPQIEVTFEIDVNGILR

SEQ ID NO: 48113 - protein, 18 aa, Homo sapiens
IEIESFYEGEDFSETLTR

SEQ ID NO: 48114 - protein, 16 aa, Homo sapiens
IEWLESHQDADIEDFK

SEQ ID NO: 48115 - protein, 16 aa, Homo sapiens
IINEPTAAAIAYGLDK

SEQ ID NO: 48116 - protein, 17 aa, Homo sapiens
IINEPTAAAIAYGLDKR

SEQ ID NO: 48117 - protein, 9 aa, Homo sapiens
ITITNDQNR

SEQ ID NO: 48118 - protein, 14 aa, Homo sapiens
ITPSYVAFTPEGER

SEQ ID NO: 48119 - protein, 14 aa, Homo sapiens
KKELEEIVQPIISK

SEQ ID NO: 48120 - protein, 15 aa, Homo sapiens
KSDIDEIVLVGGSTR

SEQ ID NO: 48121 - protein, 18 aa, Homo sapiens
KVTHAVVTVPAYFNDAQR

SEQ ID NO: 48122 - protein, 8 aa, Homo sapiens
LTPEEIER

SEQ ID NO: 48123 - protein, 21 aa, Homo sapiens
LYGSAGPPPTGEEDTAEKDEL

SEQ ID NO: 48124 - protein, 11 aa, Homo sapiens
MKETAEAYLGK

SEQ ID NO: 48125 - protein, 12 aa, Homo sapiens
MKETAEAYLGKK

SEQ ID NO: 48126 - protein, 11 aa, Homo sapiens
NELESYAYSLK

SEQ ID NO: 48127 - protein, 15 aa, Homo sapiens
NQLTSNPENTVFDAK

SEQ ID NO: 48128 - protein, 10 aa, Homo sapiens
RALSSQHQAR

SEQ ID NO: 48129 - protein, 14 aa, Homo sapiens
SDIDEIVLVGGSTR

SEQ ID NO: 48130 - protein, 17 aa, Homo sapiens
SQIFSTASDNQPTVTIK

SEQ ID NO: 48131 - protein, 14 aa, Homo sapiens
TFAPEEISAMVLTK

SEQ ID NO: 48132 - protein, 15 aa, Homo sapiens
TKPYIQVDIGGGQTK

SEQ ID NO: 48133 - protein, 12 aa, Homo sapiens
TWNDPSVQQDIK

SEQ ID NO: 48134 - protein, 8 aa, Homo sapiens
VLEDSDLK

SEQ ID NO: 48135 - protein, 26 aa, Homo sapiens
VLEDSDLKKSDIDEIVLVGGSTRIPK

SEQ ID NO: 48136 - protein, 11 aa, Homo sapiens
VTAEDKGTGNK

SEQ ID NO: 48137 - protein, 17 aa, Homo sapiens
VTHAVVTVPAYFNDAQR

SEQ ID NO: 48138 - protein, 10 aa, Homo sapiens
VYEGERPLTK

SEQ ID NO: 48139 - protein, 17 aa, Homo sapiens
ALAQCAPPPAVCAELVR

SEQ ID NO: 48140 - protein, 20 aa, Homo sapiens
AYLLPAPPAPGNASESEEDR

SEQ ID NO: 48141 - protein, 35 aa, Homo sapiens
AYLLPAPPAPGNASESEEDRSAGSVESPSVSSTHR

SEQ ID NO: 48142 - protein, 18 aa, Homo sapiens
CQPSPDEARPLQALLDGR

SEQ ID NO: 48143 - protein, 10 aa, Homo sapiens
EMEDTLNHLK

SEQ ID NO: 48144 - protein, 18 aa, Homo sapiens
EMEDTLNHLKFLNVLSPR

SEQ ID NO: 48145 - protein, 7 aa, Homo sapiens
FHPLHSK

SEQ ID NO: 48146 - protein, 8 aa, Homo sapiens
FLNVLSPR

SEQ ID NO: 48147 - protein, 12 aa, Homo sapiens
GASSAGLGPVVR

SEQ ID NO: 48148 - protein, 12 aa, Homo sapiens
GKEDVHCYSMQS

SEQ ID NO: 48149 - protein, 11 aa, Homo sapiens
GLCVNASAVSR

SEQ ID NO: 48150 - protein, 13 aa, Homo sapiens
GSVESPSVSSTHR

SEQ ID NO: 48151 - protein, 17 aa, Homo sapiens
IIIIKKGHAKDSQRYKV

SEQ ID NO: 48152 - protein, 19 aa, Homo sapiens
KVDYESQSTDTQNFSSESK

SEQ ID NO: 48153 - protein, 20 aa, Homo sapiens
KVDYESQSTDTQNFSSESKR

SEQ ID NO: 48154 - protein, 9 aa, Homo sapiens
PLQALLDGR

SEQ ID NO: 48155 - protein, 22 aa, Homo sapiens
RAYLLPAPPAPGNASESEEDRS

SEQ ID NO: 48156 - protein, 13 aa, Homo sapiens
RGLCVNASAVSRL

SEQ ID NO: 48157 - protein, 15 aa, Homo sapiens
SAGSVESPSVSSTHR

SEQ ID NO: 48158 - protein, 18 aa, Homo sapiens
VDYESQSTDTQNFSSESK

SEQ ID NO: 48159 - protein, 19 aa, Homo sapiens
VDYESQSTDTQNFSSESKR

SEQ ID NO: 48160 - protein, 12 aa, Homo sapiens
VSDPKFHPLHSK

SEQ ID NO: 48161 - protein, 11 aa, Homo sapiens
YGQPLPGYTTK

SEQ ID NO: 48162 - protein, 13 aa, Homo sapiens
YGQPLPGYTTKGK

SEQ ID NO: 48163 - protein, 20 aa, Homo sapiens
YKVDYESQSTDTQNFSSESK

SEQ ID NO: 48164 - protein, 21 aa, Homo sapiens
YKVDYESQSTDTQNFSSESKR

SEQ ID NO: 48165 - protein, 22 aa, Homo sapiens
AMLVNLEEPLASTYQDILYQAK

SEQ ID NO: 48166 - protein, 24 aa, Homo sapiens
ANELSVDEAALHAAVIAINEAIDR

SEQ ID NO: 48167 - protein, 33 aa, Homo sapiens
AQAHAENNEFITWNDIQACVDHVNLVVQEEHER

SEQ ID NO: 48168 - protein, 19 aa, Homo sapiens
EELQSGVDAANSAAQQYQR

SEQ ID NO: 48169 - protein, 27 aa, Homo sapiens
EKAQEIQDESAVLWLDEIQGGIWQSNK

SEQ ID NO: 48170 - protein, 22 aa, Homo sapiens
EKLEAYQHLFYLLQTNPTYLAK

SEQ ID NO: 48171 - protein, 20 aa, Homo sapiens
ERDVYEELLTQAEIQGNINK

SEQ ID NO: 48172 - protein, 14 aa, Homo sapiens
FFQTACDVPELQDK

SEQ ID NO: 48173 - protein, 28 aa, Homo sapiens
FFQTACDVPELQDKFNVDEYSDLVTLTK

SEQ ID NO: 48174 - protein, 11 aa, Homo sapiens
FLSAIVSSVDK

SEQ ID NO: 48175 - protein, 25 aa, Homo sapiens
FQPGETLTEILETPATSEQEAEHQR

SEQ ID NO: 48176 - protein, 20 aa, Homo sapiens
FVHLLDQSDQDFQEELDLMK

SEQ ID NO: 48177 - protein, 15 aa, Homo sapiens
GVLLEIEDLQVNQFK

SEQ ID NO: 48178 - protein, 19 aa, Homo sapiens
HTDNVIQWLNAMDEIGLPK

SEQ ID NO: 48179 - protein, 29 aa, Homo sapiens
IGGILANELSVDEAALHAAVIAINEAIDR

SEQ ID NO: 48180 - protein, 30 aa, Homo sapiens
IGGILANELSVDEAALHAAVIAINEAIDRR

SEQ ID NO: 48181 - protein, 18 aa, Homo sapiens
ILAIGLINEALDEGDAQK

SEQ ID NO: 48182 - protein, 13 aa, Homo sapiens
LAAVALINAAIQK

SEQ ID NO: 48183 - protein, 20 aa, Homo sapiens
LEAYQHLFYLLQTNPTYLAK

SEQ ID NO: 48184 - protein, 18 aa, Homo sapiens
LEGVLAEVAQHYQDTLIR

SEQ ID NO: 48185 - protein, 17 aa, Homo sapiens
LPYDVTPEQALAHEEVK

SEQ ID NO: 48186 - protein, 22 aa, Homo sapiens
MFLGDNAHLSIINEYLSQSYQK

SEQ ID NO: 48187 - protein, 25 aa, Homo sapiens
NPNAMLVNLEEPLASTYQDILYQAK

SEQ ID NO: 48188 - protein, 18 aa, Homo sapiens
NVIFEISPTEEVGDFEVK

SEQ ID NO: 48189 - protein, 23 aa, Homo sapiens
PGETLTEILETPATSEQEAEHQR

SEQ ID NO: 48190 - protein, 19 aa, Homo sapiens
QLSSSVTGLTNIEEENCQR

SEQ ID NO: 48191 - protein, 15 aa, Homo sapiens
QNVAYEYLCHLEEAK

SEQ ID NO: 48192 - protein, 16 aa, Homo sapiens
RQNVAYEYLCHLEEAK

SEQ ID NO: 48193 - protein, 18 aa, Homo sapiens
SKVDQIQEIVTGNPTVIK

SEQ ID NO: 48194 - protein, 25 aa, Homo sapiens
SPDVGLYGVIPECGETYHSDLAEAK

SEQ ID NO: 48195 - protein, 9 aa, Homo sapiens
TCLDNLASK

SEQ ID NO: 48196 - protein, 24 aa, Homo sapiens
VNTFSALANIDLALEQGDALALFR

SEQ ID NO: 48197 - protein, 28 aa, Homo sapiens
YMNPAIVAPDAFDIIDLSAGGQLTTDQR

SEQ ID NO: 48198 - protein, 23 aa, Homo sapiens
KRRKPGSHTHSASEDNTTNNVRE

SEQ ID NO: 48199 - protein, 16 aa, Homo sapiens
RDGNSSLIAAVAEVRV

SEQ ID NO: 48200 - protein, 23 aa, Homo sapiens
MRGVTNDLLSIQGNTGPSWINKT

SEQ ID NO: 48201 - protein, 14 aa, Homo sapiens
AVHPTQPSSNPAGR

SEQ ID NO: 48202 - protein, 22 aa, Homo sapiens
CDKYNAQPVGNWSDCILPEGKV

SEQ ID NO: 48203 - protein, 12 aa, Homo sapiens
TCHDMVSPAGTR

SEQ ID NO: 48204 - protein, 23 aa, Homo sapiens
AKPTCTTYNSPQLSAQENFQFDK

SEQ ID NO: 48205 - protein, 16 aa, Homo sapiens
FTEDLVGSVVHVLSHR

SEQ ID NO: 48206 - protein, 22 aa, Homo sapiens
HVFGGFASCSWEVKPQFQGDNR

SEQ ID NO: 48207 - protein, 13 aa, Homo sapiens
LLGPQWLDYDCDR

SEQ ID NO: 48208 - protein, 25 aa, Homo sapiens
SFCSQFLPEEQAEIDQLFDALSSDK

SEQ ID NO: 48209 - protein, 20 aa, Homo sapiens
ARPVSSAASVYAGAGGSGSR

SEQ ID NO: 48210 - protein, 26 aa, Homo sapiens
GGMGSGGLATGIAGGLAGMGGIQNEK

SEQ ID NO: 48211 - protein, 28 aa, Homo sapiens
KVIDDTNITRLQLETEIEALKEELLFMK

SEQ ID NO: 48212 - protein, 25 aa, Homo sapiens
LLEDGEDFNLGDALDSSNSMQTIQK

SEQ ID NO: 48213 - protein, 18 aa, Homo sapiens
LQLETEIEALKEELLFMK

SEQ ID NO: 48214 - protein, 9 aa, Homo sapiens
VIDDTNITR

SEQ ID NO: 48215 - protein, 23 aa, Homo sapiens
YALQMEQLNGILLHLESELAQTR

SEQ ID NO: 48216 - protein, 8 aa, Homo sapiens
AEAESWYR

SEQ ID NO: 48217 - protein, 9 aa, Homo sapiens
AQYDDIVTR

SEQ ID NO: 48218 - protein, 11 aa, Homo sapiens
ATAENEFVALK

SEQ ID NO: 48219 - protein, 9 aa, Homo sapiens
CCITAAPYR

SEQ ID NO: 48220 - protein, 9 aa, Homo sapiens
EYQEVMNSK

SEQ ID NO: 48221 - protein, 7 aa, Homo sapiens
FAAFIDK

SEQ ID NO: 48222 - protein, 14 aa, Homo sapiens
ILQSHISDTSVVVK

SEQ ID NO: 48223 - protein, 19 aa, Homo sapiens
KSDLEANVEALIQEIDFLR

SEQ ID NO: 48224 - protein, 9 aa, Homo sapiens
KYEEEVSLR

SEQ ID NO: 48225 - protein, 10 aa, Homo sapiens
LAELEGALQK

SEQ ID NO: 48226 - protein, 12 aa, Homo sapiens
LAELEGALQKAK

SEQ ID NO: 48227 - protein, 16 aa, Homo sapiens
LASELNHVQEVLEGYK

SEQ ID NO: 48228 - protein, 20 aa, Homo sapiens
LEAAVAQSEQQGEAALSDAR

SEQ ID NO: 48229 - protein, 11 aa, Homo sapiens
LGLDIEIATYR

SEQ ID NO: 48230 - protein, 8 aa, Homo sapiens
LLEGEEQR

SEQ ID NO: 48231 - protein, 9 aa, Homo sapiens
LTAEVENAK

SEQ ID NO: 48232 - protein, 18 aa, Homo sapiens
SDLEANVEALIQEIDFLR

SEQ ID NO: 48233 - protein, 12 aa, Homo sapiens
SLNSRFAAFIDK

SEQ ID NO: 48234 - protein, 10 aa, Homo sapiens
TKEEINELNR

SEQ ID NO: 48235 - protein, 16 aa, Homo sapiens
VAQSEQQGEAALSDAR

SEQ ID NO: 48236 - protein, 11 aa, Homo sapiens
ATAENEFVVLK

SEQ ID NO: 48237 - protein, 12 aa, Homo sapiens
ATAENEFVVLKK

SEQ ID NO: 48238 - protein, 9 aa, Homo sapiens
CCISAAPYR

SEQ ID NO: 48239 - protein, 9 aa, Homo sapiens
FAAFIDKVR

SEQ ID NO: 48240 - protein, 8 aa, Homo sapiens
GLTGFGSR

SEQ ID NO: 48241 - protein, 6 aa, Homo sapiens
GVSCYR

SEQ ID NO: 48242 - protein, 19 aa, Homo sapiens
KSDLEANVEALVEESSFLR

SEQ ID NO: 48243 - protein, 9 aa, Homo sapiens
KYEEEVALR

SEQ ID NO: 48244 - protein, 17 aa, Homo sapiens
LASELNHVQEVLEGYKK

SEQ ID NO: 48245 - protein, 16 aa, Homo sapiens
LCEGVGSVNVCVSSSR

SEQ ID NO: 48246 - protein, 20 aa, Homo sapiens
LEAAVAEAEQQGEAALSDAR

SEQ ID NO: 48247 - protein, 7 aa, Homo sapiens
LYEEEIR

SEQ ID NO: 48248 - protein, 8 aa, Homo sapiens
QDMACLLK

SEQ ID NO: 48249 - protein, 9 aa, Homo sapiens
RLLEGEEHR

SEQ ID NO: 48250 - protein, 10 aa, Homo sapiens
SRAEAESWYR

SEQ ID NO: 48251 - protein, 14 aa, Homo sapiens
VLQAHISDTSVIVK

SEQ ID NO: 48252 - protein, 8 aa, Homo sapiens
YEEEVALR

SEQ ID NO: 48253 - protein, 8 aa, Homo sapiens
AFSVNIFK

SEQ ID NO: 48254 - protein, 11 aa, Homo sapiens
ALQATVGNSYK

SEQ ID NO: 48255 - protein, 16 aa, Homo sapiens
FFLQGIQLNTILPDAR

SEQ ID NO: 48256 - protein, 10 aa, Homo sapiens
GHTLTLNFTR

SEQ ID NO: 48257 - protein, 18 aa, Homo sapiens
KNMTFDLPSDATVVLNRS

SEQ ID NO: 48258 - protein, 14 aa, Homo sapiens
LLFQFGMNASSSRF

SEQ ID NO: 48259 - protein, 29 aa, Homo sapiens
MFMVKNGNGTACIMANFSAAFSVNYDTKS

SEQ ID NO: 48260 - protein, 34 aa, Homo sapiens
RCVSGTQVHMNNVTVTLHDATIQAYLSNSSFSRG

SEQ ID NO: 48261 - protein, 12 aa, Homo sapiens
RGHTLTLNFTRN

SEQ ID NO: 48262 - protein, 16 aa, Homo sapiens
RGHTLTLNFTRNATRY

SEQ ID NO: 48263 - protein, 10 aa, Homo sapiens
RKDNTTVTRL

SEQ ID NO: 48264 - protein, 21 aa, Homo sapiens
RSSCGKENTSDPSLVIAFGRG

SEQ ID NO: 48265 - protein, 26 aa, Homo sapiens
RYSVQLMSFVYNLSDTHLFPNASSKE

SEQ ID NO: 48266 - protein, 8 aa, Homo sapiens
SHAGYQTI

SEQ ID NO: 48267 - protein, 9 aa, Homo sapiens
TVESITDIR

SEQ ID NO: 48268 - protein, 11 aa, Homo sapiens
ATQTEVKPSVR

SEQ ID NO: 48269 - protein, 26 aa, Homo sapiens
AVHLFVDSLVNQDKPSFAFQCTDSNR

SEQ ID NO: 48270 - protein, 7 aa, Homo sapiens
IHVFSYK

SEQ ID NO: 48271 - protein, 18 aa, Homo sapiens
ITGLDPAGPMFEGADIHK

SEQ ID NO: 48272 - protein, 18 aa, Homo sapiens
KLTFCTEDPENTSISPGR

SEQ ID NO: 48273 - protein, 9 aa, Homo sapiens
LEDKLHKPK

SEQ ID NO: 48274 - protein, 17 aa, Homo sapiens
LSPDDADFVDVLHTYTR

SEQ ID NO: 48275 - protein, 17 aa, Homo sapiens
LTFCTEDPENTSISPGR

SEQ ID NO: 48276 - protein, 8 aa, Homo sapiens
LVSALHTR

SEQ ID NO: 48277 - protein, 30 aa, Homo sapiens
NMGEIEPTFYVTLYGTNADSQTLPLEIVER

SEQ ID NO: 48278 - protein, 24 aa, Homo sapiens
RIEQNATNTFLVYTEEDLGDLLKI

SEQ ID NO: 48279 - protein, 7 aa, Homo sapiens
SYLSQPR

SEQ ID NO: 48280 - protein, 8 aa, Homo sapiens
VVGHSIAR

SEQ ID NO: 48281 - protein, 19 aa, Homo sapiens
KTLEELHLTGNLSAENNRY

SEQ ID NO: 48282 - protein, 30 aa, Homo sapiens
RGWAAPGPEPTYPNSTILPTPDTGPTGIKY

SEQ ID NO: 48283 - protein, 27 aa, Homo sapiens
RSPTQGYRVTPDAVHSVGGNSSQSSSP

SEQ ID NO: 48284 - protein, 18 aa, Homo sapiens
GVSAVAGPHDIGASPGDK

SEQ ID NO: 48285 - protein, 34 aa, Homo sapiens
VVKPESNDKETEAAYESDIPEELCGHHLPQQSLK

SEQ ID NO: 48286 - protein, 13 aa, Homo sapiens
EMEVYRVTESLQR

SEQ ID NO: 48287 - protein, 28 aa, Homo sapiens
LEGQCTALHHDKHETKAENTKLKLTNQE

SEQ ID NO: 48288 - protein, 17 aa, Homo sapiens
REFSAGTVYPETNKTKN

SEQ ID NO: 48289 - protein, 23 aa, Homo sapiens
LAHGGQVNLDMEDHRDEDFVKPK

SEQ ID NO: 48290 - protein, 23 aa, Homo sapiens
LGSTAPQVLSTSSPAQQAENEAK

SEQ ID NO: 48291 - protein, 12 aa, Homo sapiens
QHSSQDVHVVLK

SEQ ID NO: 48292 - protein, 13 aa, Homo sapiens
KLDNYSTQELGKT

SEQ ID NO: 48293 - protein, 26 aa, Homo sapiens
RGNVISSHGNPILLNSSIPEDPSIKA

SEQ ID NO: 48294 - protein, 14 aa, Homo sapiens
WELTILHTNDVHSR

SEQ ID NO: 48295 - protein, 24 aa, Homo sapiens
YDAMALGNHEFDNGVEGLIEPLLK

SEQ ID NO: 48296 - protein, 14 aa, Homo sapiens
DQSHDLGLHVLSCR

SEQ ID NO: 48297 - protein, 17 aa, Homo sapiens
NILKLDGSTHLNIFFAK

SEQ ID NO: 48298 - protein, 22 aa, Homo sapiens
ERPVFTNHFLVELHKGGEDKAR

SEQ ID NO: 48299 - protein, 13 aa, Homo sapiens
LVLTLTTDACEGK

SEQ ID NO: 48300 - protein, 17 aa, Homo sapiens
RYLEHVQAVITVNATRR

SEQ ID NO: 48301 - protein, 30 aa, Homo sapiens
KTGFTQLGTSCITNHTCSNADETFCEMVKS

SEQ ID NO: 48302 - protein, 9 aa, Homo sapiens
FKWWGLQNK

SEQ ID NO: 48303 - protein, 8 aa, Homo sapiens
GPLGPNWK

SEQ ID NO: 48304 - protein, 12 aa, Homo sapiens
HVEAVYIDIADR

SEQ ID NO: 48305 - protein, 7 aa, Homo sapiens
IYHLQSK

SEQ ID NO: 48306 - protein, 13 aa, Homo sapiens
MLAPEGALNIHEK

SEQ ID NO: 48307 - protein, 19 aa, Homo sapiens
NETGGGEGVEVLVNEPYEK

SEQ ID NO: 48308 - protein, 7 aa, Homo sapiens
QELVNQK

SEQ ID NO: 48309 - protein, 7 aa, Homo sapiens
VENFIHK

SEQ ID NO: 48310 - protein, 23 aa, Homo sapiens
VILPVSVDEYQVGQLYSVAEASK

SEQ ID NO: 48311 - protein, 10 aa, Homo sapiens
DVLAFTCEPK

SEQ ID NO: 48312 - protein, 10 aa, Homo sapiens
HSGLYACSVR

SEQ ID NO: 48313 - protein, 22 aa, Homo sapiens
RVYSNASLLIQNVTQEDAGSYT

SEQ ID NO: 48314 - protein, 22 aa, Homo sapiens
AILENYISALNTLWHPECFVCR

SEQ ID NO: 48315 - protein, 27 aa, Homo sapiens
ECFTPFVNGSFFEHDGQPYCEVHYHER

SEQ ID NO: 48316 - protein, 14 aa, Homo sapiens
EQNDKPYCQNCFLK

SEQ ID NO: 48317 - protein, 13 aa, Homo sapiens
FHPEHFVCAFCLK

SEQ ID NO: 48318 - protein, 13 aa, Homo sapiens
FVCTHCQEEIGSR

SEQ ID NO: 48319 - protein, 14 aa, Homo sapiens
GSLCSGCQKPITGR

SEQ ID NO: 48320 - protein, 15 aa, Homo sapiens
RGSLCSGCQKPITGR

SEQ ID NO: 48321 - protein, 17 aa, Homo sapiens
TSSVSNPQDSVGSPCSR

SEQ ID NO: 48322 - protein, 24 aa, Homo sapiens
TWHPEHFFCAQCGAFFGPEGFHEK

SEQ ID NO: 48323 - protein, 19 aa, Homo sapiens
TWHPEHFVCTHCQEEIGSR

SEQ ID NO: 48324 - protein, 21 aa, Homo sapiens
VNGSFFEHDGQPYCEVHYHER

SEQ ID NO: 48325 - protein, 13 aa, Homo sapiens
DINFLLALAMTLK

SEQ ID NO: 48326 - protein, 11 aa, Homo sapiens
EVAVKLGAVPK

SEQ ID NO: 48327 - protein, 7 aa, Homo sapiens
IANEVFK

SEQ ID NO: 48328 - protein, 9 aa, Homo sapiens
KIKWVPACK

SEQ ID NO: 48329 - protein, 12 aa, Homo sapiens
KLDASIQHPLIK

SEQ ID NO: 48330 - protein, 11 aa, Homo sapiens
LDASIQHPLIK

SEQ ID NO: 48331 - protein, 7 aa, Homo sapiens
LDSLGVK

SEQ ID NO: 48332 - protein, 10 aa, Homo sapiens
MDLLSGNFLK

SEQ ID NO: 48333 - protein, 29 aa, Homo sapiens
NAYVDSEKVSFHLNFEAAPYLYQLPNKYK

SEQ ID NO: 48334 - protein, 21 aa, Homo sapiens
NPENHDIANEVFKHLQNEINR

SEQ ID NO: 48335 - protein, 19 aa, Homo sapiens
AINASVGAAGSAENAPSKE

SEQ ID NO: 48336 - protein, 32 aa, Homo sapiens
GLAAAEPTANGGLALASIEDQGAAAGGYCGSR

SEQ ID NO: 48337 - protein, 17 aa, Homo sapiens
RSYSTTYEERNITGTRV

SEQ ID NO: 48338 - protein, 23 aa, Homo sapiens
SCTVLNVEGDALGAGLLQNYVDR

SEQ ID NO: 48339 - protein, 20 aa, Homo sapiens
SELPLDPLPVPTEEGNPLLK

SEQ ID NO: 48340 - protein, 16 aa, Homo sapiens
SIEDQGAAAGGYCGSR

SEQ ID NO: 48341 - protein, 10 aa, Homo sapiens
FYNETYYGRT

SEQ ID NO: 48342 - protein, 15 aa, Homo sapiens
LVSGYDSYGNICGQK

SEQ ID NO: 48343 - protein, 15 aa, Homo sapiens
YVFFLDPCNLDLINR

SEQ ID NO: 48344 - protein, 29 aa, Homo sapiens
TDCGHTWNSPNCTDPKLLNGSVLGNHTKY

SEQ ID NO: 48345 - protein, 15 aa, Homo sapiens
ALEQKPDDAQYYCQR

SEQ ID NO: 48346 - protein, 18 aa, Homo sapiens
AYCHILLGNYCVAVADAK

SEQ ID NO: 48347 - protein, 17 aa, Homo sapiens
KKSLELNPNNSTAMLRK

SEQ ID NO: 48348 - protein, 28 aa, Homo sapiens
KRAMNKSFMESGGTVLSTNWSDVGKRKV

SEQ ID NO: 48349 - protein, 15 aa, Homo sapiens
LELLHPIIPEQSTFK

SEQ ID NO: 48350 - protein, 31 aa, Homo sapiens
RCGEPPSIMNGYASGSNYSFGAMVAYSCNKG

SEQ ID NO: 48351 - protein, 16 aa, Homo sapiens
RSCLSCPENTSTVKRG

SEQ ID NO: 48352 - protein, 36 aa, Homo sapiens
REGGHDVPSNKDVTSLDWNTNGTLLATGSYDGFARI

SEQ ID NO: 48353 - protein, 8 aa, Homo sapiens
FFFNIFTR

SEQ ID NO: 48354 - protein, 9 aa, Homo sapiens
FYYNSVIGK

SEQ ID NO: 48355 - protein, 10 aa, Homo sapiens
RYFYNNQTKQ

SEQ ID NO: 48356 - protein, 15 aa, Homo sapiens
LQVSVDDQCEGSTEK

SEQ ID NO: 48357 - protein, 10 aa, Homo sapiens
QPTNPYASSK

SEQ ID NO: 48358 - protein, 36 aa, Homo sapiens
LAPNQYVISGEVAILNSTTIEISELPVRTWTQTYKE

SEQ ID NO: 48359 - protein, 12 aa, Homo sapiens
DTSEAPSSSDEK

SEQ ID NO: 48360 - protein, 8 aa, Homo sapiens
MLQQQPPR

SEQ ID NO: 48361 - protein, 14 aa, Homo sapiens
AYHPGCFTCVVCHR

SEQ ID NO: 48362 - protein, 23 aa, Homo sapiens
GGLRPGSLDAEIDLLSSTLAELN

SEQ ID NO: 48363 - protein, 23 aa, Homo sapiens
GLDGIPFTVDATSQIHCIEDFHR

SEQ ID NO: 48364 - protein, 21 aa, Homo sapiens
GPAWVGSHGVLQHTQGLPADR

SEQ ID NO: 48365 - protein, 18 aa, Homo sapiens
GTPGPPPAHGAALQPHPR

SEQ ID NO: 48366 - protein, 8 aa, Homo sapiens
SFHIGCYK

SEQ ID NO: 48367 - protein, 16 aa, Homo sapiens
TVDATSQIHCIEDFHR

SEQ ID NO: 48368 - protein, 13 aa, Homo sapiens
VFHVGCFVCSTCR

SEQ ID NO: 48369 - protein, 21 aa, Homo sapiens
VNFCPLPSEQCYQAPGGPEDR

SEQ ID NO: 48370 - protein, 24 aa, Homo sapiens
KQTDVINASWWVMSNKTRDELERS

SEQ ID NO: 48371 - protein, 14 aa, Homo sapiens
LNRSDSDSSTLAKK

SEQ ID NO: 48372 - protein, 9 aa, Homo sapiens
IHAAQKPYR

SEQ ID NO: 48373 - protein, 15 aa, Homo sapiens
SHTGEKPFPCPECGR

SEQ ID NO: 48374 - protein, 27 aa, Homo sapiens
KYDHMEKSVNSSSLVSPPQRISSTVKT

SEQ ID NO: 48375 - protein, 26 aa, Homo sapiens
AQMQTVPNAGHWIHADRPQDFIAAIR

SEQ ID NO: 48376 - protein, 21 aa, Homo sapiens
LLDGEAALPAVVFLHGLFGSK

SEQ ID NO: 48377 - protein, 20 aa, Homo sapiens
ICTICNELFPENVYSVHFEK

SEQ ID NO: 48378 - protein, 18 aa, Homo sapiens
IFHAPNASAPSSSLSTFK

SEQ ID NO: 48379 - protein, 25 aa, Homo sapiens
KEHKAEKVPAVANYIMKIHNFTSKC

SEQ ID NO: 48380 - protein, 16 aa, Homo sapiens
SQSAAVTPSSTTSSTR

SEQ ID NO: 48381 - protein, 19 aa, Homo sapiens
TSGNVEDDLIIFPDDCEFK

SEQ ID NO: 48382 - protein, 20 aa, Homo sapiens
TSGNVEDDLIIFPDDCEFKR

SEQ ID NO: 48383 - protein, 37 aa, Homo sapiens
IVMTAAAKHLTPVTLELGGKNPCYVDDNCDPQTVANR

SEQ ID NO: 48384 - protein, 17 aa, Homo sapiens
NPCYVDDNCDPQTVANR

SEQ ID NO: 48385 - protein, 14 aa, Homo sapiens
GAPTTSLISVAVTK

SEQ ID NO: 48386 - protein, 17 aa, Homo sapiens
GEVITTYCPANNEPIAR

SEQ ID NO: 48387 - protein, 26 aa, Homo sapiens
GSDCGIVNVNIPTSGAEIGGAFGGEK

SEQ ID NO: 48388 - protein, 24 aa, Homo sapiens
ILVEGVGEVQEYVDICDYAVGLSR

SEQ ID NO: 48389 - protein, 14 aa, Homo sapiens
LFIHESIHDEVVNR

SEQ ID NO: 48390 - protein, 33 aa, Homo sapiens
PGNYVEPTIVTGLGHDASIAHTETFAPILYVFK

SEQ ID NO: 48391 - protein, 16 aa, Homo sapiens
REENEGVYNGSWGGRG

SEQ ID NO: 48392 - protein, 37 aa, Homo sapiens
SLLELGGNNAIIAFEDADLSLVVPSALFAAVGTAGQR

SEQ ID NO: 48393 - protein, 27 aa, Homo sapiens
VLEDNKLPGAICSLTCGGADIGTAMAK

SEQ ID NO: 48394 - protein, 32 aa, Homo sapiens
HRVLHNSLGNISMLPCSSFTPNWPVQNPDSRK

SEQ ID NO: 48395 - protein, 14 aa, Homo sapiens
ALLLYGADIESKNK

SEQ ID NO: 48396 - protein, 11 aa, Homo sapiens
DCDREVEEEIK

SEQ ID NO: 48397 - protein, 16 aa, Homo sapiens
LRAMQLNEEALTKTNI

SEQ ID NO: 48398 - protein, 12 aa, Homo sapiens
QKMNSELSLSHK

SEQ ID NO: 48399 - protein, 28 aa, Homo sapiens
RSRKPENQQFPDTENEEYHSDEQNDTRK

SEQ ID NO: 48400 - protein, 27 aa, Homo sapiens
NWYIQATCATSGDGLYEGLDWLSNQLR

SEQ ID NO: 48401 - protein, 10 aa, Homo sapiens
DAVLLLFANK

SEQ ID NO: 48402 - protein, 28 aa, Homo sapiens
TWYVQATCATQGTGLYEGLDWLSNELSK

SEQ ID NO: 48403 - protein, 15 aa, Homo sapiens
QDMPNAMPVSELTDK

SEQ ID NO: 48404 - protein, 28 aa, Homo sapiens
TWYVQATCATQGTGLYDGLDWLSHELSK

SEQ ID NO: 48405 - protein, 30 aa, Homo sapiens
KLVLSLLSGLPNEVDFAINVCTLLSNESKH

SEQ ID NO: 48406 - protein, 17 aa, Homo sapiens
EKDNIDITLQWLIQHSK

SEQ ID NO: 48407 - protein, 23 aa, Homo sapiens
NELHNLLDKPQLQGIPVLVLGNK

SEQ ID NO: 48408 - protein, 24 aa, Homo sapiens
NELHNLLDKPQLQGIPVLVLGNKR

SEQ ID NO: 48409 - protein, 16 aa, Homo sapiens
KAAAGPLDMSLPSTPD

SEQ ID NO: 48410 - protein, 21 aa, Homo sapiens
NCEEVGLFNELASSFEHEFKK

SEQ ID NO: 48411 - protein, 26 aa, Homo sapiens
KSNEVVAVPTNGTVNNVAQEPVNTLG

SEQ ID NO: 48412 - protein, 27 aa, Homo sapiens
ILITQEKPSAEFITLNDCLQLAYLPSK

SEQ ID NO: 48413 - protein, 35 aa, Homo sapiens
KRNHMLLLYPREILILDLEVNQTVGVIAIERTGVP

SEQ ID NO: 48414 - protein, 13 aa, Homo sapiens
LAEGVQLLCLIDK

SEQ ID NO: 48415 - protein, 20 aa, Homo sapiens
LSNPLDICYDVLCENAYFQK

SEQ ID NO: 48416 - protein, 17 aa, Homo sapiens
NFPTITALEWSPSHNLK

SEQ ID NO: 48417 - protein, 18 aa, Homo sapiens
TQIINGSVDVDTEDRQKR

SEQ ID NO: 48418 - protein, 28 aa, Homo sapiens
LPCTTLCQVLHAVSHQDSCPGDSSSVGK

SEQ ID NO: 48419 - protein, 19 aa, Homo sapiens
TDPVPVTIALDSLSWLLLR

SEQ ID NO: 48420 - protein, 12 aa, Homo sapiens
DKLPRPPCVSVK

SEQ ID NO: 48421 - protein, 33 aa, Homo sapiens
ECLLFLEETIGSLDTEADSGLSTDESEPATTPR

SEQ ID NO: 48422 - protein, 20 aa, Homo sapiens
HTEAAPGDSGLISCSLQEQR

SEQ ID NO: 48423 - protein, 24 aa, Homo sapiens
LGLPQDQDEPGLHLSKPTSSIRPK

SEQ ID NO: 48424 - protein, 25 aa, Homo sapiens
LSPAPGLAQPAAPAQASAAIPAAGK

SEQ ID NO: 48425 - protein, 30 aa, Homo sapiens
AKENENSSPVAGAFGVFSTISTAVQSTGKS

SEQ ID NO: 48426 - protein, 21 aa, Homo sapiens
DIRHDPSLQPWSVSYDGGSAK

SEQ ID NO: 48427 - protein, 9 aa, Homo sapiens
VVFDDTYDR

SEQ ID NO: 48428 - protein, 16 aa, Homo sapiens
KTRPQNGSMILYNRKK

SEQ ID NO: 48429 - protein, 12 aa, Homo sapiens
ADFDDRVSDEEK

SEQ ID NO: 48430 - protein, 13 aa, Homo sapiens
DHYSNGFCTVYAK

SEQ ID NO: 48431 - protein, 16 aa, Homo sapiens
DVQDSLTVSNEAQTAK

SEQ ID NO: 48432 - protein, 15 aa, Homo sapiens
EASDPQPEEADGGLK

SEQ ID NO: 48433 - protein, 19 aa, Homo sapiens
EGAAHAFAQYNMDQFTPVK

SEQ ID NO: 48434 - protein, 18 aa, Homo sapiens
FITHAPPGEFNEVFNDVR

SEQ ID NO: 48435 - protein, 15 aa, Homo sapiens
FTITPPTAQVVGVLK

SEQ ID NO: 48436 - protein, 20 aa, Homo sapiens
IEGYEDQVLITEHGDLGNSR

SEQ ID NO: 48437 - protein, 30 aa, Homo sapiens
IIENAENEYQTAISENYQTMSDTTFKALRR

SEQ ID NO: 48438 - protein, 17 aa, Homo sapiens
IQVHYYEDGNVQLVSHK

SEQ ID NO: 48439 - protein, 10 aa, Homo sapiens
LLLNNDNLLR

SEQ ID NO: 48440 - protein, 7 aa, Homo sapiens
RQLPVTR

SEQ ID NO: 48441 - protein, 20 aa, Homo sapiens
TIDGQQTIIACIESHQFQPK

SEQ ID NO: 48442 - protein, 17 aa, Homo sapiens
ELLESNFTLVGDDGTNK

SEQ ID NO: 48443 - protein, 16 aa, Homo sapiens
LNQENEHIYNLWCSGR

SEQ ID NO: 48444 - protein, 25 aa, Homo sapiens
FDPETNSDDACTYHPGVPVFHDALK

SEQ ID NO: 48445 - protein, 16 aa, Homo sapiens
FQEHIIQAPKPVEAIK

SEQ ID NO: 48446 - protein, 15 aa, Homo sapiens
TSDFNTFLAQEGCTK

SEQ ID NO: 48447 - protein, 15 aa, Homo sapiens
TTDFSDFLSIVGCTK

SEQ ID NO: 48448 - protein, 21 aa, Homo sapiens
RDDALKNLSHTPVSKFVLDRI

SEQ ID NO: 48449 - protein, 20 aa, Homo sapiens
AAEEAASTLASSIHPEQCIK

SEQ ID NO: 48450 - protein, 17 aa, Homo sapiens
ASVFCLVAIYSVIGEDL

SEQ ID NO: 48451 - protein, 19 aa, Homo sapiens
TSPLTSPTNCSHGGLSPSR

SEQ ID NO: 48452 - protein, 26 aa, Homo sapiens
VSSSSGTTPFSSAAALPPGSYASLGR

SEQ ID NO: 48453 - protein, 17 aa, Homo sapiens
RNSSYFLGLSDPGGRRH

SEQ ID NO: 48454 - protein, 27 aa, Homo sapiens
KFNLTEDMYAQDSIELLTTSGIQFKKH

SEQ ID NO: 48455 - protein, 13 aa, Homo sapiens
AQPENIPAKNWYR

SEQ ID NO: 48456 - protein, 9 aa, Homo sapiens
DYEVDATLK

SEQ ID NO: 48457 - protein, 15 aa, Homo sapiens
EGLRGPRGDQGPVGR

SEQ ID NO: 48458 - protein, 13 aa, Homo sapiens
FTYTVLVDGCSKK

SEQ ID NO: 48459 - protein, 12 aa, Homo sapiens
GEPGNIGFPGPK

SEQ ID NO: 48460 - protein, 18 aa, Homo sapiens
GETGPSGPVGPAGAVGPR

SEQ ID NO: 48461 - protein, 14 aa, Homo sapiens
GPAGPSGPAGKDGR

SEQ ID NO: 48462 - protein, 11 aa, Homo sapiens
GPRGDQGPVGR

SEQ ID NO: 48463 - protein, 21 aa, Homo sapiens
GPTGDPGKNGDKGHAGLAGAR

SEQ ID NO: 48464 - protein, 22 aa, Homo sapiens
HGNRGETGPSGPVGPAGAVGPR

SEQ ID NO: 48465 - protein, 29 aa, Homo sapiens
HGNRGETGPSGPVGPAGAVGPRGPSGPQG

SEQ ID NO: 48466 - protein, 24 aa, Homo sapiens
HVWLGETINAGSQFEYNVEGVTSK

SEQ ID NO: 48467 - protein, 20 aa, Homo sapiens
KGEPGAPGENGTPGQTGARG

SEQ ID NO: 48468 - protein, 15 aa, Homo sapiens
NSIAYMDEETGNLKK

SEQ ID NO: 48469 - protein, 11 aa, Homo sapiens
PENIPAKNWYR

SEQ ID NO: 48470 - protein, 19 aa, Homo sapiens
RGETGPSGPVGPAGAVGPR

SEQ ID NO: 48471 - protein, 17 aa, Homo sapiens
RLLANYASQNITYHCKN

SEQ ID NO: 48472 - protein, 17 aa, Homo sapiens
SAPSLRPKDYEVDATLK

SEQ ID NO: 48473 - protein, 33 aa, Homo sapiens
SAPSLRPKDYEVDATLKSLNNQIETLLTPEGSR

SEQ ID NO: 48474 - protein, 16 aa, Homo sapiens
SLNNQIETLLTPEGSR

SEQ ID NO: 48475 - protein, 13 aa, Homo sapiens
VYCDFSTGETCIR

SEQ ID NO: 48476 - protein, 17 aa, Homo sapiens
AIVDCIISIIEENSESK

SEQ ID NO: 48477 - protein, 17 aa, Homo sapiens
ALQQYTLEPSEKPFDLK

SEQ ID NO: 48478 - protein, 7 aa, Homo sapiens
CAHILTK

SEQ ID NO: 48479 - protein, 33 aa, Homo sapiens
DCDPTTGETDDEGYEDEYVLEDLEVTVADHIQK

SEQ ID NO: 48480 - protein, 13 aa, Homo sapiens
DSPLFDFIESCLR

SEQ ID NO: 48481 - protein, 17 aa, Homo sapiens
ELAPAVSVLQLFCSSPK

SEQ ID NO: 48482 - protein, 22 aa, Homo sapiens
ETGLSHLCEFIEDCEFTVLATR

SEQ ID NO: 48483 - protein, 17 aa, Homo sapiens
FGAQNEEMLPSILVLLK

SEQ ID NO: 48484 - protein, 21 aa, Homo sapiens
HPSAVTACNLDLENLVTDSNR

SEQ ID NO: 48485 - protein, 11 aa, Homo sapiens
ILHLLGQEGPK

SEQ ID NO: 48486 - protein, 26 aa, Homo sapiens
LNFEAAWDEVGDEFEKEETFTLSTIK

SEQ ID NO: 48487 - protein, 12 aa, Homo sapiens
NTHTLLLAGVFR

SEQ ID NO: 48488 - protein, 18 aa, Homo sapiens
SLPYNQPGTCYTLVALPK

SEQ ID NO: 48489 - protein, 18 aa, Homo sapiens
SSPEPVALTESETEYVIR

SEQ ID NO: 48490 - protein, 17 aa, Homo sapiens
VPSVSSSALVSSLHLLK

SEQ ID NO: 48491 - protein, 12 aa, Homo sapiens
DNIYTSEVVSQR

SEQ ID NO: 48492 - protein, 22 aa, Homo sapiens
GLVGFEIPSIPTSAQHVWLETK

SEQ ID NO: 48493 - protein, 23 aa, Homo sapiens
GPGWFPGESGPAVAPEEGAAIAR

SEQ ID NO: 48494 - protein, 12 aa, Homo sapiens
LAVTPSMVPLGR

SEQ ID NO: 48495 - protein, 9 aa, Homo sapiens
LEAYILDPR

SEQ ID NO: 48496 - protein, 28 aa, Homo sapiens
QDGGLYTDEAVPAFQPHTGSLVAVAPSR

SEQ ID NO: 48497 - protein, 10 aa, Homo sapiens
TQQLSPEVER

SEQ ID NO: 48498 - protein, 19 aa, Homo sapiens
VELSYPDGSPAEGVTVQIK

SEQ ID NO: 48499 - protein, 9 aa, Homo sapiens
AASQPGELK

SEQ ID NO: 48500 - protein, 15 aa, Homo sapiens
AASQPGELKDWFVGR

SEQ ID NO: 48501 - protein, 15 aa, Homo sapiens
EALVSVWLQCTAISR

SEQ ID NO: 48502 - protein, 10 aa, Homo sapiens
EGGPNNHLLK

SEQ ID NO: 48503 - protein, 22 aa, Homo sapiens
ELLVIELSDNPGVHEPGEPEFK

SEQ ID NO: 48504 - protein, 8 aa, Homo sapiens
FPPEETLK

SEQ ID NO: 48505 - protein, 14 aa, Homo sapiens
IHIMPSLNPDGFEK

SEQ ID NO: 48506 - protein, 7 aa, Homo sapiens
IVDQNTK

SEQ ID NO: 48507 - protein, 7 aa, Homo sapiens
IVYVNEK

SEQ ID NO: 48508 - protein, 17 aa, Homo sapiens
IVYVNEKEGGPNNHLLK

SEQ ID NO: 48509 - protein, 15 aa, Homo sapiens
KGNETIVNLIHSTRI

SEQ ID NO: 48510 - protein, 8 aa, Homo sapiens
KIVDQNTK

SEQ ID NO: 48511 - protein, 22 aa, Homo sapiens
KVAVPYSPAAGVDFELESFSER

SEQ ID NO: 48512 - protein, 8 aa, Homo sapiens
LLIPGNYK

SEQ ID NO: 48513 - protein, 22 aa, Homo sapiens
LLIPGNYKLTASAPGYLAITKK

SEQ ID NO: 48514 - protein, 13 aa, Homo sapiens
LQQEDGISFEYHR

SEQ ID NO: 48515 - protein, 18 aa, Homo sapiens
LQQEDGISFEYHRYPELR

SEQ ID NO: 48516 - protein, 13 aa, Homo sapiens
LTASAPGYLAITK

SEQ ID NO: 48517 - protein, 14 aa, Homo sapiens
LTASAPGYLAITKK

SEQ ID NO: 48518 - protein, 7 aa, Homo sapiens
NFPDLDR

SEQ ID NO: 48519 - protein, 12 aa, Homo sapiens
NSLISYLEQIHR

SEQ ID NO: 48520 - protein, 27 aa, Homo sapiens
RDLQGNPIANATISVEGIDHDVTSAKD

SEQ ID NO: 48521 - protein, 14 aa, Homo sapiens
RLQQEDGISFEYHR

SEQ ID NO: 48522 - protein, 21 aa, Homo sapiens
SGSAHEYSSSPDDAIFQSLAR

SEQ ID NO: 48523 - protein, 10 aa, Homo sapiens
SNAQGIDLNR

SEQ ID NO: 48524 - protein, 19 aa, Homo sapiens
TYWEDNKNSLISYLEQIHR

SEQ ID NO: 48525 - protein, 21 aa, Homo sapiens
VAVPYSPAAGVDFELESFSER

SEQ ID NO: 48526 - protein, 13 aa, Homo sapiens
YIGNMHGNEAVGR

SEQ ID NO: 48527 - protein, 16 aa, Homo sapiens
AIPREDKEEILMLHNK

SEQ ID NO: 48528 - protein, 19 aa, Homo sapiens
CSGPMCTHYTQIVWATTNK

SEQ ID NO: 48529 - protein, 17 aa, Homo sapiens
DYTYPYPSECNPWCPER

SEQ ID NO: 48530 - protein, 12 aa, Homo sapiens
EDKEEILMLHNK

SEQ ID NO: 48531 - protein, 10 aa, Homo sapiens
GNWIGEAPYK

SEQ ID NO: 48532 - protein, 21 aa, Homo sapiens
GQVQPQASNMEYMTWDDELEK

SEQ ID NO: 48533 - protein, 17 aa, Homo sapiens
GYLLPNVTLLEELLSKY

SEQ ID NO: 48534 - protein, 9 aa, Homo sapiens
IGCAVNTCR

SEQ ID NO: 48535 - protein, 11 aa, Homo sapiens
KYQHNESHSRV

SEQ ID NO: 48536 - protein, 12 aa, Homo sapiens
NGVQSESLGTPR

SEQ ID NO: 48537 - protein, 14 aa, Homo sapiens
SPGFHVQSWYDEVK

SEQ ID NO: 48538 - protein, 15 aa, Homo sapiens
GFGFGQGAGALVHSE

SEQ ID NO: 48539 - protein, 17 aa, Homo sapiens
GLESTTLADKDGEIYCK

SEQ ID NO: 48540 - protein, 22 aa, Homo sapiens
GYGYGQGAGTLSTDKGESLGIK

SEQ ID NO: 48541 - protein, 17 aa, Homo sapiens
NLDSTTVAVHGEEIYCK

SEQ ID NO: 48542 - protein, 17 aa, Homo sapiens
TVYFAEEVQCEGNSFHK

SEQ ID NO: 48543 - protein, 15 aa, Homo sapiens
ALSAIADLLTNEHER

SEQ ID NO: 48544 - protein, 22 aa, Homo sapiens
DMDLTEVITGTLWNLSSHDSIK

SEQ ID NO: 48545 - protein, 20 aa, Homo sapiens
ECDGLVDALIFIVQAEIGQK

SEQ ID NO: 48546 - protein, 11 aa, Homo sapiens
EVHLGACGALK

SEQ ID NO: 48547 - protein, 13 aa, Homo sapiens
GIPVLVGLLDHPK

SEQ ID NO: 48548 - protein, 16 aa, Homo sapiens
HIEWESVLTNTAGCLR

SEQ ID NO: 48549 - protein, 15 aa, Homo sapiens
KPIEDPANDTVDFPK

SEQ ID NO: 48550 - protein, 13 aa, Homo sapiens
KSDNNYSTPNERG

SEQ ID NO: 48551 - protein, 19 aa, Homo sapiens
MEIVDHALHALTDEVIIPH

SEQ ID NO: 48552 - protein, 24 aa, Homo sapiens
MEIVDHALHALTDEVIIPHSGWER

SEQ ID NO: 48553 - protein, 20 aa, Homo sapiens
NGNGGPGPYVGQAGTATLPR

SEQ ID NO: 48554 - protein, 8 aa, Homo sapiens
NLSYQVHR

SEQ ID NO: 48555 - protein, 18 aa, Homo sapiens
PNVANNTGPHAASCFGAK

SEQ ID NO: 48556 - protein, 14 aa, Homo sapiens
QPELPEVIAMLGFR

SEQ ID NO: 48557 - protein, 25 aa, Homo sapiens
RYQEAAPNVANNTGPHAASCFGAKK

SEQ ID NO: 48558 - protein, 13 aa, Homo sapiens
SNAAAYLQHLCYR

SEQ ID NO: 48559 - protein, 17 aa, Homo sapiens
SQSSHSYDDSTLPLIDR

SEQ ID NO: 48560 - protein, 19 aa, Homo sapiens
TPAILEASAGAIQNLCAGR

SEQ ID NO: 48561 - protein, 16 aa, Homo sapiens
VANNTGPHAASCFGAK

SEQ ID NO: 48562 - protein, 10 aa, Homo sapiens
VGGSSVDLHR

SEQ ID NO: 48563 - protein, 23 aa, Homo sapiens
YQEAAPNVANNTGPHAASCFGAK

SEQ ID NO: 48564 - protein, 19 aa, Homo sapiens
LLGPDAAINLTDPDGALAK

SEQ ID NO: 48565 - protein, 23 aa, Homo sapiens
TTGTPPDSSLVTYELHSRPEQDK

SEQ ID NO: 48566 - protein, 19 aa, Homo sapiens
ATSLAWHPTHPSTVAVGSK

SEQ ID NO: 48567 - protein, 9 aa, Homo sapiens
HFQHLTPIK

SEQ ID NO: 48568 - protein, 14 aa, Homo sapiens
HPVNAACFSPDGAR

SEQ ID NO: 48569 - protein, 19 aa, Homo sapiens
VYSASQWDCPLGLIPHPHR

SEQ ID NO: 48570 - protein, 12 aa, Homo sapiens
AIGSDGLCCQSR

SEQ ID NO: 48571 - protein, 19 aa, Homo sapiens
DQLSVLENGVDIVVGTPGR

SEQ ID NO: 48572 - protein, 18 aa, Homo sapiens
EAQTSFLHLGYLPNQLFR

SEQ ID NO: 48573 - protein, 21 aa, Homo sapiens
FLVLDEADGLLSQGYSDFINR

SEQ ID NO: 48574 - protein, 19 aa, Homo sapiens
GEDSVPDTVHHVVVPVNPK

SEQ ID NO: 48575 - protein, 13 aa, Homo sapiens
GHQFSCVCLHGDR

SEQ ID NO: 48576 - protein, 18 aa, Homo sapiens
GHVDILAPTVQELAALEK

SEQ ID NO: 48577 - protein, 19 aa, Homo sapiens
GIDIHGVPYVINVTLPDEK

SEQ ID NO: 48578 - protein, 14 aa, Homo sapiens
HYYEVSCHDQGLCR

SEQ ID NO: 48579 - protein, 19 aa, Homo sapiens
IDCDNLEQYFIQQGGGPDK

SEQ ID NO: 48580 - protein, 20 aa, Homo sapiens
IDCDNLEQYFIQQGGGPDKK

SEQ ID NO: 48581 - protein, 30 aa, Homo sapiens
IMHFPTWVDLKGEDSVPDTVHHVVVPVNPK

SEQ ID NO: 48582 - protein, 16 aa, Homo sapiens
LQVIVCSATLHSFDVK

SEQ ID NO: 48583 - protein, 9 aa, Homo sapiens
VWYHVCSSR

SEQ ID NO: 48584 - protein, 20 aa, Homo sapiens
DMAAPGTSSVPAPTAGNAEK

SEQ ID NO: 48585 - protein, 21 aa, Homo sapiens
HGYEKPTPIQTQAIPAIMSGR

SEQ ID NO: 48586 - protein, 12 aa, Homo sapiens
SCPNHYEDYVHR

SEQ ID NO: 48587 - protein, 18 aa, Homo sapiens
VVCVYGGTGISEQIAELK

SEQ ID NO: 48588 - protein, 21 aa, Homo sapiens
EDVETGLDPLSLLATECTGGK

SEQ ID NO: 48589 - protein, 22 aa, Homo sapiens
KKSSLDSNSSEMAIMMGADAKI

SEQ ID NO: 48590 - protein, 33 aa, Homo sapiens
LDLPSNLPGLILTSEHCNEGVQLPLSSLSQDSK

SEQ ID NO: 48591 - protein, 34 aa, Homo sapiens
RLDLPSNLPGLILTSEHCNEGVQLPLSSLSQDSK

SEQ ID NO: 48592 - protein, 22 aa, Homo sapiens
ESSLILAVTPANMDLANSDALK

SEQ ID NO: 48593 - protein, 29 aa, Homo sapiens
LQDAFSSIGQSCHLDLPQIAVVGGQSAGK

SEQ ID NO: 48594 - protein, 37 aa, Homo sapiens
MINNTKAFIHHELLAYLYSSADQSSLMEESADQAQRR

SEQ ID NO: 48595 - protein, 10 aa, Homo sapiens
TEHAEFLHCK

SEQ ID NO: 48596 - protein, 19 aa, Homo sapiens
VYSPHVLNLTLIDLPGITK

SEQ ID NO: 48597 - protein, 18 aa, Homo sapiens
AGGSPAPGPETPAISPSK

SEQ ID NO: 48598 - protein, 8 aa, Homo sapiens
IAQLICER

SEQ ID NO: 48599 - protein, 14 aa, Homo sapiens
TDIQIALPSGCYGR

SEQ ID NO: 48600 - protein, 30 aa, Homo sapiens
GMMGVNSFSGQLAVNVSEASQATNQGFTRN

SEQ ID NO: 48601 - protein, 17 aa, Homo sapiens
KEYLEQISTLINTTDRC

SEQ ID NO: 48602 - protein, 17 aa, Homo sapiens
KHLLENSTASVSEAERK

SEQ ID NO: 48603 - protein, 35 aa, Homo sapiens
KLLGGGDEEAIRPQMQQILDFETALANITIPQEKR

SEQ ID NO: 48604 - protein, 19 aa, Homo sapiens
MVEQYSNYSVNGEPVNGRH

SEQ ID NO: 48605 - protein, 21 aa, Homo sapiens
NTIFYPVEINESEPIVVYDKE

SEQ ID NO: 48606 - protein, 8 aa, Homo sapiens
RDYYLNKT

SEQ ID NO: 48607 - protein, 9 aa, Homo sapiens
RFFNFSWRV

SEQ ID NO: 48608 - protein, 14 aa, Homo sapiens
RLGGWNITGPWAKD

SEQ ID NO: 48609 - protein, 17 aa, Homo sapiens
DRPGKPLFHLEHYIEGK

SEQ ID NO: 48610 - protein, 8 aa, Homo sapiens
GASNYVAK

SEQ ID NO: 48611 - protein, 18 aa, Homo sapiens
GHVTQDAPIPGSPLYTIK

SEQ ID NO: 48612 - protein, 12 aa, Homo sapiens
NVTLCGHLHHGK

SEQ ID NO: 48613 - protein, 17 aa, Homo sapiens
SIVIRPLEPQPAPHLAR

SEQ ID NO: 48614 - protein, 18 aa, Homo sapiens
SLSVFHHWQIVPGDPLDK

SEQ ID NO: 48615 - protein, 16 aa, Homo sapiens
TCFVDCLIEQTHPEIR

SEQ ID NO: 48616 - protein, 19 aa, Homo sapiens
VADPVVTFCETVVETSSLK

SEQ ID NO: 48617 - protein, 25 aa, Homo sapiens
VEESGEHVILGTGELYLDCVMHDLR

SEQ ID NO: 48618 - protein, 13 aa, Homo sapiens
VLSGTIHAGQPVK

SEQ ID NO: 48619 - protein, 17 aa, Homo sapiens
YDQDLCYTDILFTEQER

SEQ ID NO: 48620 - protein, 34 aa, Homo sapiens
YYPTAEEVYGPEVETIVQEEDTQPLTEPIIKPVK

SEQ ID NO: 48621 - protein, 14 aa, Homo sapiens
IVLTNPVCTEVGEK

SEQ ID NO: 48622 - protein, 25 aa, Homo sapiens
IVSLFAEHNDLQYAAPGGLIGVGTK

SEQ ID NO: 48623 - protein, 11 aa, Homo sapiens
LTPLSHEVISR

SEQ ID NO: 48624 - protein, 16 aa, Homo sapiens
QATINIGTIGHVAHGK

SEQ ID NO: 48625 - protein, 18 aa, Homo sapiens
SCGSSTPDEFPTDIPGTK

SEQ ID NO: 48626 - protein, 15 aa, Homo sapiens
SFDVNKPGCEVDDLK

SEQ ID NO: 48627 - protein, 25 aa, Homo sapiens
SFDVNKPGCEVDDLKGGVAGGSILK

SEQ ID NO: 48628 - protein, 14 aa, Homo sapiens
VGQEIEVRPGIVSK

SEQ ID NO: 48629 - protein, 22 aa, Homo sapiens
FYTMYFEEPDSSGHAGGPVSAR

SEQ ID NO: 48630 - protein, 14 aa, Homo sapiens
VPFYEPSHAEEVSK

SEQ ID NO: 48631 - protein, 31 aa, Homo sapiens
KKAADTAVGWALGYMLNLTNLIPADPPGLRK

SEQ ID NO: 48632 - protein, 24 aa, Homo sapiens
LGDVYQSPCTMAQRPQNFNSSARV

SEQ ID NO: 48633 - protein, 16 aa, Homo sapiens
RLLNLTNPEASTSVLM

SEQ ID NO: 48634 - protein, 29 aa, Homo sapiens
MNNSCLTNAVHLNNVSVVSPVNVHINTRT

SEQ ID NO: 48635 - protein, 27 aa, Homo sapiens
KFPDEEGACQPCPINCTHSCVDLDDKG

SEQ ID NO: 48636 - protein, 17 aa, Homo sapiens
KHSDCLACLHFNHSGIC

SEQ ID NO: 48637 - protein, 21 aa, Homo sapiens
RGHCWGPGPTQCVNCSQFLRG

SEQ ID NO: 48638 - protein, 37 aa, Homo sapiens
RGTQLFEDNYALAVLDNGDPLNNTTPVTGASPGGLRE

SEQ ID NO: 48639 - protein, 30 aa, Homo sapiens
RHCLPCHPECQPQNGSVTCFGPEADQCVAC

SEQ ID NO: 48640 - protein, 27 aa, Homo sapiens
RHLYQGCQVVQGNLELTYLPTNASLSF

SEQ ID NO: 48641 - protein, 37 aa, Homo sapiens
RNGSANRNSSHRTAAQPAETPEDVPGSLDDGADCEAV

SEQ ID NO: 48642 - protein, 25 aa, Homo sapiens
KKLEEVVIEHFKSWNAENTTEKKRD

SEQ ID NO: 48643 - protein, 17 aa, Homo sapiens
RQPVSLDLSWTNISKKQ

SEQ ID NO: 48644 - protein, 11 aa, Homo sapiens
MDQDSLSSSLK

SEQ ID NO: 48645 - protein, 17 aa, Homo sapiens
VPLLHNFHSFLYQPDWR

SEQ ID NO: 48646 - protein, 16 aa, Homo sapiens
AIGIEPSLATYHHIIR

SEQ ID NO: 48647 - protein, 19 aa, Homo sapiens
DKHPPELQVAFADCAADIK

SEQ ID NO: 48648 - protein, 10 aa, Homo sapiens
LFDQPGDPLK

SEQ ID NO: 48649 - protein, 15 aa, Homo sapiens
SSFIIYDIMNELMGK

SEQ ID NO: 48650 - protein, 12 aa, Homo sapiens
VMSDFAINQEQK

SEQ ID NO: 48651 - protein, 29 aa, Homo sapiens
VSNSPSQAIEVVELASAFSLPICEGLTQR

SEQ ID NO: 48652 - protein, 15 aa, Homo sapiens
DQEAAVAELQAALER

SEQ ID NO: 48653 - protein, 17 aa, Homo sapiens
LRDQEAAVAELQAALER

SEQ ID NO: 48654 - protein, 16 aa, Homo sapiens
ALGNNFYEYYVDDPPR

SEQ ID NO: 48655 - protein, 8 aa, Homo sapiens
IVLDKLER

SEQ ID NO: 48656 - protein, 14 aa, Homo sapiens
ANEQVVQSLNQTYK

SEQ ID NO: 48657 - protein, 10 aa, Homo sapiens
DVIVHPLPLK

SEQ ID NO: 48658 - protein, 19 aa, Homo sapiens
FSNVPSSPESPIGGTITYK

SEQ ID NO: 48659 - protein, 16 aa, Homo sapiens
KANEQVVQSLNQTYKM

SEQ ID NO: 48660 - protein, 21 aa, Homo sapiens
KVLQQQWTNQSSQLLHSVERF

SEQ ID NO: 48661 - protein, 25 aa, Homo sapiens
MKVMCDNNPVSLNCCSQGNVNWSKV

SEQ ID NO: 48662 - protein, 13 aa, Homo sapiens
REWNGTYHCIFRY

SEQ ID NO: 48663 - protein, 15 aa, Homo sapiens
RYEEQQLEIQNSSRF

SEQ ID NO: 48664 - protein, 12 aa, Homo sapiens
YLDGAESVLTVK

SEQ ID NO: 48665 - protein, 19 aa, Homo sapiens
MNSNLPAENLTIAVNMTKT

SEQ ID NO: 48666 - protein, 14 aa, Homo sapiens
HGAEVIDTPVFELK

SEQ ID NO: 48667 - protein, 22 aa, Homo sapiens
IGDYVQQHGGVSLVEQLLQDPK

SEQ ID NO: 48668 - protein, 25 aa, Homo sapiens
LLNQLQYCEEAGIPLVAIIGEQELK

SEQ ID NO: 48669 - protein, 15 aa, Homo sapiens
RHGAEVIDTPVFELK

SEQ ID NO: 48670 - protein, 20 aa, Homo sapiens
EPAPDSGLLGLFQGQNSLLH

SEQ ID NO: 48671 - protein, 29 aa, Homo sapiens
GLQVHVVVDACSSRSQVDRLVALARMRQS

SEQ ID NO: 48672 - protein, 33 aa, Homo sapiens
LLEVPVMLTEQYPQGLGPTVPELGTEGLRPLAK

SEQ ID NO: 48673 - protein, 26 aa, Homo sapiens
QSGAFLSTSEGLILQLVGDAVHPQFK

SEQ ID NO: 48674 - protein, 13 aa, Homo sapiens
IENIDHLGFFIYR

SEQ ID NO: 48675 - protein, 17 aa, Homo sapiens
KCYVIPLNTSIVMPPRN

SEQ ID NO: 48676 - protein, 11 aa, Homo sapiens
LTAYLDLNLDK

SEQ ID NO: 48677 - protein, 10 aa, Homo sapiens
NLLELLINIK

SEQ ID NO: 48678 - protein, 15 aa, Homo sapiens
HSDHDNSTSLNGGKR

SEQ ID NO: 48679 - protein, 18 aa, Homo sapiens
KNDSDLFGLGLEEAGPKE

SEQ ID NO: 48680 - protein, 20 aa, Homo sapiens
RVPVSHSFPHPLYNMSLLKH

SEQ ID NO: 48681 - protein, 39 aa, Homo sapiens
DTCGGDSGGPLVCNGVLQGITSWGPEPCALPEKPAVYTK

SEQ ID NO: 48682 - protein, 7 aa, Homo sapiens
DTIAANP

SEQ ID NO: 48683 - protein, 12 aa, Homo sapiens
HNLFEPEDTGQR

SEQ ID NO: 48684 - protein, 18 aa, Homo sapiens
HQSLRPDEDSSHDLMLLR

SEQ ID NO: 48685 - protein, 9 aa, Homo sapiens
IVGGWECEK

SEQ ID NO: 48686 - protein, 9 aa, Homo sapiens
KNSQVWLGR

SEQ ID NO: 48687 - protein, 11 aa, Homo sapiens
KWIKDTIAANP

SEQ ID NO: 48688 - protein, 12 aa, Homo sapiens
LSEPAKITDVVK

SEQ ID NO: 48689 - protein, 8 aa, Homo sapiens
NSQVWLGR

SEQ ID NO: 48690 - protein, 17 aa, Homo sapiens
SLQCVSLHLLSNDMCAR

SEQ ID NO: 48691 - protein, 32 aa, Homo sapiens
VLGLPTQEPALGTTCYASGWGSIEPEEFLRPR

SEQ ID NO: 48692 - protein, 10 aa, Homo sapiens
WIKDTIAANP

SEQ ID NO: 48693 - protein, 11 aa, Homo sapiens
RNKSVILLGRH

SEQ ID NO: 48694 - protein, 21 aa, Homo sapiens
AVCGGVLVHPQWVLTAAHCIR

SEQ ID NO: 48695 - protein, 7 aa, Homo sapiens
DTIVANP

SEQ ID NO: 48696 - protein, 16 aa, Homo sapiens
FLRPGDDSSHDLMLLR

SEQ ID NO: 48697 - protein, 28 aa, Homo sapiens
FLRPGDDSSHDLMLLRLSEPAELTDAVK

SEQ ID NO: 48698 - protein, 7 aa, Homo sapiens
FMLCAGR

SEQ ID NO: 48699 - protein, 30 aa, Homo sapiens
HSLFHPEDTGQVFQVSHSFPHPLYDMSLLK

SEQ ID NO: 48700 - protein, 32 aa, Homo sapiens
HSLFHPEDTGQVFQVSHSFPHPLYDMSLLKNR

SEQ ID NO: 48701 - protein, 12 aa, Homo sapiens
HSQPWQVLVASR

SEQ ID NO: 48702 - protein, 21 aa, Homo sapiens
IVGGWECEKHSQPWQVLVASR

SEQ ID NO: 48703 - protein, 22 aa, Homo sapiens
KLQCVDLHVISNDVCAQVHPQK

SEQ ID NO: 48704 - protein, 11 aa, Homo sapiens
KWIKDTIVANP

SEQ ID NO: 48705 - protein, 21 aa, Homo sapiens
LQCVDLHVISNDVCAQVHPQK

SEQ ID NO: 48706 - protein, 12 aa, Homo sapiens
LSEPAELTDAVK

SEQ ID NO: 48707 - protein, 39 aa, Homo sapiens
STCSGDSGGPLVCNGVLQGITSWGSEPCALPERPSLYTK

SEQ ID NO: 48708 - protein, 7 aa, Homo sapiens
SVILLGR

SEQ ID NO: 48709 - protein, 32 aa, Homo sapiens
VMDLPTQEPALGTTCYASGWGSIEPEEFLTPK

SEQ ID NO: 48710 - protein, 10 aa, Homo sapiens
VTKFMLCAGR

SEQ ID NO: 48711 - protein, 10 aa, Homo sapiens
WIKDTIVANP

SEQ ID NO: 48712 - protein, 31 aa, Homo sapiens
EEPEKWPLPPIVDYSQTDFSQLLNCPEFVPR

SEQ ID NO: 48713 - protein, 12 aa, Homo sapiens
FQQVPTDALANK

SEQ ID NO: 48714 - protein, 8 aa, Homo sapiens
QLALEDAK

SEQ ID NO: 48715 - protein, 19 aa, Homo sapiens
SLPTTVPESPNYRNTRTPR

SEQ ID NO: 48716 - protein, 27 aa, Homo sapiens
TASISSSPSEGTPTVGSYGCTPQSLPK

SEQ ID NO: 48717 - protein, 28 aa, Homo sapiens
RELAITDSEHSDAEVSCTDNGTFNLSRG

SEQ ID NO: 48718 - protein, 24 aa, Homo sapiens
RFGSGAAGGSGSSNSSGDALVTRI

SEQ ID NO: 48719 - protein, 21 aa, Homo sapiens
IEDDVVVTQDSPLILSADCPK

SEQ ID NO: 48720 - protein, 31 aa, Homo sapiens
YLGQPSPFTHPHLLRPGEVTPGLSQVEYALR

SEQ ID NO: 48721 - protein, 26 aa, Homo sapiens
KALQLNELTMDDDTAVLVIDNGSGMC

SEQ ID NO: 48722 - protein, 7 aa, Homo sapiens
VEIIIGR

SEQ ID NO: 48723 - protein, 21 aa, Homo sapiens
RPLEATFDLGIPQAVLPPLPK

SEQ ID NO: 48724 - protein, 11 aa, Homo sapiens
YFHPPAHLQAK

SEQ ID NO: 48725 - protein, 17 aa, Homo sapiens
LASALAPSIYEHEDIKK

SEQ ID NO: 48726 - protein, 20 aa, Homo sapiens
LGEINVIGEPFLNVNCEHIK

SEQ ID NO: 48727 - protein, 19 aa, Homo sapiens
NLNPEDIDQLITISGMVIR

SEQ ID NO: 48728 - protein, 9 aa, Homo sapiens
THIDVIHYR

SEQ ID NO: 48729 - protein, 15 aa, Homo sapiens
TTIENIQLPHTLLSR

SEQ ID NO: 48730 - protein, 33 aa, Homo sapiens
ALPVTTLHNTVTSSVSTLKAELPPTGTSNATRV

SEQ ID NO: 48731 - protein, 8 aa, Homo sapiens
AIAQLNSK

SEQ ID NO: 48732 - protein, 13 aa, Homo sapiens
ALYGTTSETATWR

SEQ ID NO: 48733 - protein, 7 aa, Homo sapiens
AYQNYIK

SEQ ID NO: 48734 - protein, 8 aa, Homo sapiens
AYQNYIKK

SEQ ID NO: 48735 - protein, 15 aa, Homo sapiens
CANYVNGNMENAVGR

SEQ ID NO: 48736 - protein, 17 aa, Homo sapiens
DGDLVDWWTQQSASNFK

SEQ ID NO: 48737 - protein, 9 aa, Homo sapiens
DLQNLMSWR

SEQ ID NO: 48738 - protein, 7 aa, Homo sapiens
DVLQEPK

SEQ ID NO: 48739 - protein, 10 aa, Homo sapiens
DYYECTGIYK

SEQ ID NO: 48740 - protein, 13 aa, Homo sapiens
EDEYFENIIQNLK

SEQ ID NO: 48741 - protein, 23 aa, Homo sapiens
EKVDKDEWISGAAVVNAFYSSGR

SEQ ID NO: 48742 - protein, 18 aa, Homo sapiens
EVFIQTLDDLTWMDAETK

SEQ ID NO: 48743 - protein, 11 aa, Homo sapiens
FIMDLVSSLSR

SEQ ID NO: 48744 - protein, 7 aa, Homo sapiens
GGEPLLK

SEQ ID NO: 48745 - protein, 18 aa, Homo sapiens
GKSESQMDITDINTPKPK

SEQ ID NO: 48746 - protein, 11 aa, Homo sapiens
HVVEDLIAQIR

SEQ ID NO: 48747 - protein, 13 aa, Homo sapiens
IGYPDDIVSNDNK

SEQ ID NO: 48748 - protein, 18 aa, Homo sapiens
IIGTLQNSAEFSEAFHCR

SEQ ID NO: 48749 - protein, 14 aa, Homo sapiens
KALYGTTSETATWR

SEQ ID NO: 48750 - protein, 14 aa, Homo sapiens
KEIANATAKPEDRN

SEQ ID NO: 48751 - protein, 7 aa, Homo sapiens
LKPILTK

SEQ ID NO: 48752 - protein, 18 aa, Homo sapiens
LLPDIYGWPVATENWEQK

SEQ ID NO: 48753 - protein, 10 aa, Homo sapiens
LLPGLDLNHK

SEQ ID NO: 48754 - protein, 14 aa, Homo sapiens
LPIDENQLALEMNK

SEQ ID NO: 48755 - protein, 12 aa, Homo sapiens
LYVEAAFAGESK

SEQ ID NO: 48756 - protein, 9 aa, Homo sapiens
NDPMLLYNK

SEQ ID NO: 48757 - protein, 21 aa, Homo sapiens
NFNKDGDLVDWWTQQSASNFK

SEQ ID NO: 48758 - protein, 13 aa, Homo sapiens
NSVNHVIHIDQPR

SEQ ID NO: 48759 - protein, 9 aa, Homo sapiens
NSYMNPEKK

SEQ ID NO: 48760 - protein, 13 aa, Homo sapiens
RSCINESAIDSRG

SEQ ID NO: 48761 - protein, 16 aa, Homo sapiens
SESQMDITDINTPKPK

SEQ ID NO: 48762 - protein, 10 aa, Homo sapiens
TDVHSPGNFR

SEQ ID NO: 48763 - protein, 9 aa, Homo sapiens
TEDIVAVQK

SEQ ID NO: 48764 - protein, 21 aa, Homo sapiens
VDKDEWISGAAVVNAFYSSGR

SEQ ID NO: 48765 - protein, 8 aa, Homo sapiens
YACGGWLK

SEQ ID NO: 48766 - protein, 9 aa, Homo sapiens
YGASWTAEK

SEQ ID NO: 48767 - protein, 34 aa, Homo sapiens
RTIDTTPSGGNTTPSGTGITLDTTLSATETTFEY

SEQ ID NO: 48768 - protein, 10 aa, Homo sapiens
EDCKYIVVEK

SEQ ID NO: 48769 - protein, 8 aa, Homo sapiens
IFKKEDCK

SEQ ID NO: 48770 - protein, 14 aa, Homo sapiens
IFKKEDCKYIVVEK

SEQ ID NO: 48771 - protein, 11 aa, Homo sapiens
KEDCKYIVVEK

SEQ ID NO: 48772 - protein, 10 aa, Homo sapiens
KTCSVSEWII

SEQ ID NO: 48773 - protein, 9 aa, Homo sapiens
TCSVSEWII

SEQ ID NO: 48774 - protein, 7 aa, Homo sapiens
YIVVEKK

SEQ ID NO: 48775 - protein, 24 aa, Homo sapiens
HTILADIVISAAGIPNLITADMIK

SEQ ID NO: 48776 - protein, 21 aa, Homo sapiens
ICNAVSPDKDVDGFHVINVGR

SEQ ID NO: 48777 - protein, 22 aa, Homo sapiens
RPHLSVILVGENPASHSYVLNK

SEQ ID NO: 48778 - protein, 16 aa, Homo sapiens
AGQQGLSVAFDLATHR

SEQ ID NO: 48779 - protein, 24 aa, Homo sapiens
EVAQQAVDADVHAVGVSTLAAGHK

SEQ ID NO: 48780 - protein, 23 aa, Homo sapiens
GKNPEDLIWHTPEGISIKPLYSK

SEQ ID NO: 48781 - protein, 16 aa, Homo sapiens
LHQQQPLHPEWAALAK

SEQ ID NO: 48782 - protein, 21 aa, Homo sapiens
NPEDLIWHTPEGISIKPLYSK

SEQ ID NO: 48783 - protein, 28 aa, Homo sapiens
EAPMFTQPLVNTYAIAGYNATLNCSVRG

SEQ ID NO: 48784 - protein, 17 aa, Homo sapiens
GNRPVILTYHDIGMNHK

SEQ ID NO: 48785 - protein, 19 aa, Homo sapiens
ISGWTQALPDMVVSHLFGK

SEQ ID NO: 48786 - protein, 25 aa, Homo sapiens
SHTSEGAHLDITPNSGAAGNSAGPK

SEQ ID NO: 48787 - protein, 26 aa, Homo sapiens
MWSHMQPHLFHNQSVLAEQMALNKKF

SEQ ID NO: 48788 - protein, 9 aa, Homo sapiens
AHNLLCQQK

SEQ ID NO: 48789 - protein, 8 aa, Homo sapiens
FQIAQVVR

SEQ ID NO: 48790 - protein, 16 aa, Homo sapiens
KPYNPIIGETFHCSWK

SEQ ID NO: 48791 - protein, 14 aa, Homo sapiens
LQICTQHHTEAIGK

SEQ ID NO: 48792 - protein, 25 aa, Homo sapiens
FENLTYNQAASDSGSCGHVPVSPKA

SEQ ID NO: 48793 - protein, 27 aa, Homo sapiens
IAGTEGGFSLSWKPQPGDVIGYVVDWC

SEQ ID NO: 48794 - protein, 23 aa, Homo sapiens
KENPHLIIMNVSDCIPDAIEVVS

SEQ ID NO: 48795 - protein, 29 aa, Homo sapiens
KMQMAVSLRLALPPPTENSSLSSITLLDP

SEQ ID NO: 48796 - protein, 19 aa, Homo sapiens
QNFTTLEAAPSEAPDVWRI

SEQ ID NO: 48797 - protein, 13 aa, Homo sapiens
RSVNILFNLTHRV

SEQ ID NO: 48798 - protein, 11 aa, Homo sapiens
SVNILFNLTHR

SEQ ID NO: 48799 - protein, 19 aa, Homo sapiens
LVLQDSAAGFIANLSVQRQ

SEQ ID NO: 48800 - protein, 20 aa, Homo sapiens
NFGEEVDDESLKELFSQFGK

SEQ ID NO: 48801 - protein, 16 aa, Homo sapiens
SKVDEAVAVLQAHHAK

SEQ ID NO: 48802 - protein, 16 aa, Homo sapiens
KMLSLNNYSVPQSTRE

SEQ ID NO: 48803 - protein, 31 aa, Homo sapiens
AALANLCIGDVITAIDGENTSNMTHLEAQNR

SEQ ID NO: 48804 - protein, 10 aa, Homo sapiens
DFEQPLAISR

SEQ ID NO: 48805 - protein, 12 aa, Homo sapiens
GCTDNLTLTVAR

SEQ ID NO: 48806 - protein, 13 aa, Homo sapiens
GHFFVEDQIYCEK

SEQ ID NO: 48807 - protein, 15 aa, Homo sapiens
HPECYVCTDCGTNLK

SEQ ID NO: 48808 - protein, 19 aa, Homo sapiens
MNLASEPQEVLHIGSAHNR

SEQ ID NO: 48809 - protein, 17 aa, Homo sapiens
QSTSFLVLQEILESEEK

SEQ ID NO: 48810 - protein, 27 aa, Homo sapiens
QSTSFLVLQEILESEEKGDPNKPSGFR

SEQ ID NO: 48811 - protein, 15 aa, Homo sapiens
SEPQEVLHIGSAHNR

SEQ ID NO: 48812 - protein, 26 aa, Homo sapiens
TAASGVEANSRPLDHAQPPSSLVIDK

SEQ ID NO: 48813 - protein, 28 aa, Homo sapiens
VITNQYNNPAGLYSSENISNFNNALESK

SEQ ID NO: 48814 - protein, 12 aa, Homo sapiens
VWSPLVTEEGKR

SEQ ID NO: 48815 - protein, 21 aa, Homo sapiens
AKPSPAPPSTTTAPDASGPQK

SEQ ID NO: 48816 - protein, 19 aa, Homo sapiens
FEMVLDLMQQLQDLGHPPK

SEQ ID NO: 48817 - protein, 16 aa, Homo sapiens
MAAAEEGCSVGAEADR

SEQ ID NO: 48818 - protein, 11 aa, Homo sapiens
LNHLCGADFVK

SEQ ID NO: 48819 - protein, 37 aa, Homo sapiens
VYAEADSQESADHLAHEVSLAVFQLAGGIGERPQPGF

SEQ ID NO: 48820 - protein, 14 aa, Homo sapiens
RCEGSQPWNLTPRQ

SEQ ID NO: 48821 - protein, 27 aa, Homo sapiens
GDIPDLSQAPSSLLDALEQHLASLEGK

SEQ ID NO: 48822 - protein, 15 aa, Homo sapiens
ITAAQHSVTGSAVSK

SEQ ID NO: 48823 - protein, 17 aa, Homo sapiens
LANLVGNLGIGNGTTKN

SEQ ID NO: 48824 - protein, 12 aa, Homo sapiens
KTYNASVLPVRV

SEQ ID NO: 48825 - protein, 8 aa, Homo sapiens
AAATCFAR

SEQ ID NO: 48826 - protein, 18 aa, Homo sapiens
EAALSYGFYGCHCGVGGR

SEQ ID NO: 48827 - protein, 12 aa, Homo sapiens
ALSTGEKGFGYK

SEQ ID NO: 48828 - protein, 11 aa, Homo sapiens
EGMNIVEAMER

SEQ ID NO: 48829 - protein, 9 aa, Homo sapiens
FEDENFILK

SEQ ID NO: 48830 - protein, 17 aa, Homo sapiens
HTGPGILSMANAGPNTN

SEQ ID NO: 48831 - protein, 18 aa, Homo sapiens
HTGPGILSMANAGPNTNG

SEQ ID NO: 48832 - protein, 22 aa, Homo sapiens
HTGPGILSMANAGPNTNGSQFF

SEQ ID NO: 48833 - protein, 27 aa, Homo sapiens
HTGPGILSMANAGPNTNGSQFFICTAK

SEQ ID NO: 48834 - protein, 14 aa, Homo sapiens
IIPGFMCQGGDFTR

SEQ ID NO: 48835 - protein, 10 aa, Homo sapiens
ITIADCGQLE

SEQ ID NO: 48836 - protein, 20 aa, Homo sapiens
KHTGPGILSMANAGPNTNGS

SEQ ID NO: 48837 - protein, 11 aa, Homo sapiens
KITIADCGQLE

SEQ ID NO: 48838 - protein, 19 aa, Homo sapiens
MVNPTVFFDIAVDGEPLGR

SEQ ID NO: 48839 - protein, 17 aa, Homo sapiens
NPTVFFDIAVDGEPLGR

SEQ ID NO: 48840 - protein, 12 aa, Homo sapiens
PGFMCQGGDFTR

SEQ ID NO: 48841 - protein, 16 aa, Homo sapiens
PTVFFDIAVDGEPLGR

SEQ ID NO: 48842 - protein, 15 aa, Homo sapiens
SIYGEKFEDENFILK

SEQ ID NO: 48843 - protein, 13 aa, Homo sapiens
VKEGMNIVEAMER

SEQ ID NO: 48844 - protein, 18 aa, Homo sapiens
VNPTVFFDIAVDGEPLGR

SEQ ID NO: 48845 - protein, 9 aa, Homo sapiens
VSFELFADK

SEQ ID NO: 48846 - protein, 12 aa, Homo sapiens
VSFELFADKVPK

SEQ ID NO: 48847 - protein, 18 aa, Homo sapiens
VSFELFADKVPKTAENFR

SEQ ID NO: 48848 - protein, 14 aa, Homo sapiens
ICGDIHGQYYDLLR

SEQ ID NO: 48849 - protein, 33 aa, Homo sapiens
IMRPTDVPDQGLLCDLLWSDPDKDVQGWGENDR

SEQ ID NO: 48850 - protein, 22 aa, Homo sapiens
LFEYGGFPPESNYLFLGDYVDR

SEQ ID NO: 48851 - protein, 11 aa, Homo sapiens
LLEVQGSRPGK

SEQ ID NO: 48852 - protein, 9 aa, Homo sapiens
AHSCPSVWK

SEQ ID NO: 48853 - protein, 10 aa, Homo sapiens
AHSCPSVWKK

SEQ ID NO: 48854 - protein, 20 aa, Homo sapiens
AIPDQCSPLPCNEDGYMSCK

SEQ ID NO: 48855 - protein, 22 aa, Homo sapiens
ALVSGNNTVPFAVSLVDSTSEK

SEQ ID NO: 48856 - protein, 15 aa, Homo sapiens
ASFTCTCKPGWQGEK

SEQ ID NO: 48857 - protein, 11 aa, Homo sapiens
AVSLVDSTSEK

SEQ ID NO: 48858 - protein, 9 aa, Homo sapiens
CEFDINECK

SEQ ID NO: 48859 - protein, 18 aa, Homo sapiens
DVDECSLKPSICGTAVCK

SEQ ID NO: 48860 - protein, 12 aa, Homo sapiens
EAVMDINKPGPL

SEQ ID NO: 48861 - protein, 23 aa, Homo sapiens
EAVMDINKPGPLFKPENGLLETK

SEQ ID NO: 48862 - protein, 9 aa, Homo sapiens
EVQLKNEHT

SEQ ID NO: 48863 - protein, 11 aa, Homo sapiens
FKPENGLLETK

SEQ ID NO: 48864 - protein, 8 aa, Homo sapiens
FSAEFDFR

SEQ ID NO: 48865 - protein, 12 aa, Homo sapiens
GSYYPGSGIAQF

SEQ ID NO: 48866 - protein, 12 aa, Homo sapiens
GVQLDLDEAISK

SEQ ID NO: 48867 - protein, 8 aa, Homo sapiens
HCLVTVEK

SEQ ID NO: 48868 - protein, 11 aa, Homo sapiens
IETISHEDLQR

SEQ ID NO: 48869 - protein, 12 aa, Homo sapiens
IEVQLKNEHTSK

SEQ ID NO: 48870 - protein, 14 aa, Homo sapiens
INGVQLDLDEAISK

SEQ ID NO: 48871 - protein, 17 aa, Homo sapiens
IQALSLCSDQQSHLEFR

SEQ ID NO: 48872 - protein, 33 aa, Homo sapiens
IRPSTGTGVMLALVSGNNTVPFAVSLVDSTSEK

SEQ ID NO: 48873 - protein, 14 aa, Homo sapiens
ITTGGDVINNGLWN

SEQ ID NO: 48874 - protein, 28 aa, Homo sapiens
ITTGGDVINNGLWNMVSVEELEHSISIK

SEQ ID NO: 48875 - protein, 8 aa, Homo sapiens
KVESELIK

SEQ ID NO: 48876 - protein, 13 aa, Homo sapiens
KVESELIKPINPR

SEQ ID NO: 48877 - protein, 13 aa, Homo sapiens
LAEQFAGVVLYLK

SEQ ID NO: 48878 - protein, 22 aa, Homo sapiens
LVSGNNTVPFAVSLVDSTSEKS

SEQ ID NO: 48879 - protein, 14 aa, Homo sapiens
MVSVEELEHSISIK

SEQ ID NO: 48880 - protein, 9 aa, Homo sapiens
NGFVMLSNK

SEQ ID NO: 48881 - protein, 15 aa, Homo sapiens
NIPGDFECECPEGYR

SEQ ID NO: 48882 - protein, 10 aa, Homo sapiens
NNLELSTPLK

SEQ ID NO: 48883 - protein, 21 aa, Homo sapiens
NNLELSTPLKIETISHEDLQR

SEQ ID NO: 48884 - protein, 15 aa, Homo sapiens
PGPLFKPENGLLETK

SEQ ID NO: 48885 - protein, 10 aa, Homo sapiens
PSICGTAVCK

SEQ ID NO: 48886 - protein, 13 aa, Homo sapiens
QGASGIKEIIQEK

SEQ ID NO: 48887 - protein, 7 aa, Homo sapiens
QLAVLDK

SEQ ID NO: 48888 - protein, 12 aa, Homo sapiens
QLAVLDKAMKAK

SEQ ID NO: 48889 - protein, 10 aa, Homo sapiens
QSTNAYPDLR

SEQ ID NO: 48890 - protein, 16 aa, Homo sapiens
SCEVVSVCLPLNLDTK

SEQ ID NO: 48891 - protein, 24 aa, Homo sapiens
SCVNAIPDQCSPLPCNEDGYMSCK

SEQ ID NO: 48892 - protein, 11 aa, Homo sapiens
SFQTGLFTAAR

SEQ ID NO: 48893 - protein, 15 aa, Homo sapiens
SQDILLSVENTVIYR

SEQ ID NO: 48894 - protein, 9 aa, Homo sapiens
SVENTVIYR

SEQ ID NO: 48895 - protein, 15 aa, Homo sapiens
TVPFAVSLVDSTSEK

SEQ ID NO: 48896 - protein, 20 aa, Homo sapiens
TYDSEGVILYAESIDHSAWL

SEQ ID NO: 48897 - protein, 25 aa, Homo sapiens
TYDSEGVILYAESIDHSAWLLIALR

SEQ ID NO: 48898 - protein, 19 aa, Homo sapiens
VATYLGGLPDVPFSATPVN

SEQ ID NO: 48899 - protein, 12 aa, Homo sapiens
VESELIKPINPR

SEQ ID NO: 48900 - protein, 24 aa, Homo sapiens
VNRNNLELSTPLKIETISHEDLQR

SEQ ID NO: 48901 - protein, 8 aa, Homo sapiens
VYFAGFPR

SEQ ID NO: 48902 - protein, 18 aa, Homo sapiens
YELLYLAEQFAGVVLYLK

SEQ ID NO: 48903 - protein, 17 aa, Homo sapiens
ALQDEWDAVMLHSFTLR

SEQ ID NO: 48904 - protein, 10 aa, Homo sapiens
ALYQHDAACR

SEQ ID NO: 48905 - protein, 14 aa, Homo sapiens
IWSVPNASCVQVVR

SEQ ID NO: 48906 - protein, 15 aa, Homo sapiens
QELSHALYQHDAACR

SEQ ID NO: 48907 - protein, 28 aa, Homo sapiens
QVASHVGLHSASIPGILALDLCPSDTNK

SEQ ID NO: 48908 - protein, 14 aa, Homo sapiens
TVPEELVKPEELSK

SEQ ID NO: 48909 - protein, 20 aa, Homo sapiens
VAHPIRPKPPSATSIPAILK

SEQ ID NO: 48910 - protein, 23 aa, Homo sapiens
VGLHSASIPGILALDLCPSDTNK

SEQ ID NO: 48911 - protein, 23 aa, Homo sapiens
VTSVVFHPSQDLVFSASPDATIR

SEQ ID NO: 48912 - protein, 24 aa, Homo sapiens
YIAENGTDPINNQPLSEEQLIDIK

SEQ ID NO: 48913 - protein, 18 aa, Homo sapiens
EKAPSIIFIDELDAIGTK

SEQ ID NO: 48914 - protein, 11 aa, Homo sapiens
LKPGDLVGVNK

SEQ ID NO: 48915 - protein, 33 aa, Homo sapiens
TLPYLVSNVIELLDVDPNDQEEDGANIDLDSQR

SEQ ID NO: 48916 - protein, 24 aa, Homo sapiens
DLGLPTEAYISVEEVHDDGTPTSK

SEQ ID NO: 48917 - protein, 10 aa, Homo sapiens
DTTVGTLSQR

SEQ ID NO: 48918 - protein, 9 aa, Homo sapiens
ITNQVHGLK

SEQ ID NO: 48919 - protein, 28 aa, Homo sapiens
LPINHQIIYQLQDVFNLLPDVSLQEFVK

SEQ ID NO: 48920 - protein, 12 aa, Homo sapiens
SVVALHNLINNK

SEQ ID NO: 48921 - protein, 24 aa, Homo sapiens
TFEHVTSEIGAEEAEEVGVEHLLR

SEQ ID NO: 48922 - protein, 15 aa, Homo sapiens
TNDQMVVVYLASLIR

SEQ ID NO: 48923 - protein, 17 aa, Homo sapiens
VVVHPLVLLSVVDHFNR

SEQ ID NO: 48924 - protein, 15 aa, Homo sapiens
YCPNSVLVIIDVKPK

SEQ ID NO: 48925 - protein, 28 aa, Homo sapiens
RVHLTPVEGVPDSDYINASFINGYQEKN

SEQ ID NO: 48926 - protein, 18 aa, Homo sapiens
CIECVQPQSLQFIIDAFK

SEQ ID NO: 48927 - protein, 14 aa, Homo sapiens
GQVFALSTHPYGCR

SEQ ID NO: 48928 - protein, 7 aa, Homo sapiens
ADLPDQR

SEQ ID NO: 48929 - protein, 11 aa, Homo sapiens
AVETLLDLIMK

SEQ ID NO: 48930 - protein, 12 aa, Homo sapiens
AVETLLDLIMKR

SEQ ID NO: 48931 - protein, 11 aa, Homo sapiens
LLALGDSGVGK

SEQ ID NO: 48932 - protein, 23 aa, Homo sapiens
NWMSQLQANAYCENPDIVLIGNK

SEQ ID NO: 48933 - protein, 10 aa, Homo sapiens
TDGDYDYLIK

SEQ ID NO: 48934 - protein, 14 aa, Homo sapiens
VVYNAQGPNGSSGK

SEQ ID NO: 48935 - protein, 18 aa, Homo sapiens
YGIPYFETSAATGQNVEK

SEQ ID NO: 48936 - protein, 10 aa, Homo sapiens
ATIGADFLTK

SEQ ID NO: 48937 - protein, 13 aa, Homo sapiens
DPENFPFVVLGNK

SEQ ID NO: 48938 - protein, 14 aa, Homo sapiens
EAINVEQAFQTIAR

SEQ ID NO: 48939 - protein, 10 aa, Homo sapiens
FQSLGVAFYR

SEQ ID NO: 48940 - protein, 18 aa, Homo sapiens
GADCCVLVFDVTAPNTFK

SEQ ID NO: 48941 - protein, 14 aa, Homo sapiens
LVTMQIWDTAGQER

SEQ ID NO: 48942 - protein, 11 aa, Homo sapiens
NNIPYFETSAK

SEQ ID NO: 48943 - protein, 11 aa, Homo sapiens
VIILGDSGVGK

SEQ ID NO: 48944 - protein, 19 aa, Homo sapiens
GEVWQLLAGCHNNDHLVEK

SEQ ID NO: 48945 - protein, 19 aa, Homo sapiens
KNNTDTLYEVVCLESESER

SEQ ID NO: 48946 - protein, 32 aa, Homo sapiens
KKDYPSNTTSSTSNSGNETSGSSTIGETSNRS

SEQ ID NO: 48947 - protein, 16 aa, Homo sapiens
EEFTAFLHPEEFEHMK

SEQ ID NO: 48948 - protein, 16 aa, Homo sapiens
HWILPQDYDHAQAEAR

SEQ ID NO: 48949 - protein, 32 aa, Homo sapiens
NGDGFVDQDEYIADMFSHEENGPEPDWVLSER

SEQ ID NO: 48950 - protein, 24 aa, Homo sapiens
QATYGYYLGNPAEFHDSSDHHTFK

SEQ ID NO: 48951 - protein, 29 aa, Homo sapiens
VVRPDSELGERPPEDNQSFQYDHEAFLGK

SEQ ID NO: 48952 - protein, 22 aa, Homo sapiens
RFDESTTGSNFSFKSALSLSKS

SEQ ID NO: 48953 - protein, 13 aa, Homo sapiens
EYKIWCLGNETRF

SEQ ID NO: 48954 - protein, 27 aa, Homo sapiens
KKNKNSSKPQKNNGSTWANVPLPPPPV

SEQ ID NO: 48955 - protein, 30 aa, Homo sapiens
KTVRTTEEAPSAPPQSVTVLTVGSYNSTSI

SEQ ID NO: 48956 - protein, 8 aa, Homo sapiens
AQCPIVER

SEQ ID NO: 48957 - protein, 20 aa, Homo sapiens
HAFEIIHLLTGENPLQVLVN

SEQ ID NO: 48958 - protein, 9 aa, Homo sapiens
KAQCPIVER

SEQ ID NO: 48959 - protein, 9 aa, Homo sapiens
QAVDVSPLR

SEQ ID NO: 48960 - protein, 10 aa, Homo sapiens
RQAVDVSPLR

SEQ ID NO: 48961 - protein, 15 aa, Homo sapiens
TIAECLADELINAAK

SEQ ID NO: 48962 - protein, 13 aa, Homo sapiens
VNQAIWLLCTGAR

SEQ ID NO: 48963 - protein, 20 aa, Homo sapiens
WSTDDVQINDISLQDYIAVK

SEQ ID NO: 48964 - protein, 16 aa, Homo sapiens
LDILDTAGQEEFGAMR

SEQ ID NO: 48965 - protein, 12 aa, Homo sapiens
LNVDEAFEQLVR

SEQ ID NO: 48966 - protein, 19 aa, Homo sapiens
AHRGTQNPSQDQGNSPSGK

SEQ ID NO: 48967 - protein, 11 aa, Homo sapiens
DHDKSKGHFHR

SEQ ID NO: 48968 - protein, 14 aa, Homo sapiens
DIFSTQDELLVYNK

SEQ ID NO: 48969 - protein, 20 aa, Homo sapiens
DIFSTQDELLVYNKNQHQTK

SEQ ID NO: 48970 - protein, 13 aa, Homo sapiens
DVSQRSIYSQTEK

SEQ ID NO: 48971 - protein, 14 aa, Homo sapiens
DVSQSSIYSQTEEK

SEQ ID NO: 48972 - protein, 10 aa, Homo sapiens
EQDLLSHEQK

SEQ ID NO: 48973 - protein, 12 aa, Homo sapiens
EQDLLSHEQKGR

SEQ ID NO: 48974 - protein, 10 aa, Homo sapiens
EQTSVSGAQK

SEQ ID NO: 48975 - protein, 12 aa, Homo sapiens
EQTSVSGAQKGR

SEQ ID NO: 48976 - protein, 19 aa, Homo sapiens
ETKNSHQNKGHYQNVVEVR

SEQ ID NO: 48977 - protein, 19 aa, Homo sapiens
GESGQSTNREQDLLSHEQK

SEQ ID NO: 48978 - protein, 10 aa, Homo sapiens
GHYQNVVEVR

SEQ ID NO: 48979 - protein, 16 aa, Homo sapiens
GHYQNVVEVREEHSSK

SEQ ID NO: 48980 - protein, 12 aa, Homo sapiens
GISSQYSNTEER

SEQ ID NO: 48981 - protein, 8 aa, Homo sapiens
GKQQTESK

SEQ ID NO: 48982 - protein, 8 aa, Homo sapiens
GQHYSGQK

SEQ ID NO: 48983 - protein, 22 aa, Homo sapiens
GRKQGGSQSSYVLQTEELVANK

SEQ ID NO: 48984 - protein, 25 aa, Homo sapiens
GRKQGGSQSSYVLQTEELVANKQQR

SEQ ID NO: 48985 - protein, 15 aa, Homo sapiens
GRLPSEFSQFPHGQK

SEQ ID NO: 48986 - protein, 20 aa, Homo sapiens
GSFSIQYTYHVDANDHDQSR

SEQ ID NO: 48987 - protein, 21 aa, Homo sapiens
GSFSIQYTYHVDANDHDQSRK

SEQ ID NO: 48988 - protein, 16 aa, Homo sapiens
GTQNPSQDQGNSPSGK

SEQ ID NO: 48989 - protein, 10 aa, Homo sapiens
HLAQHLNNDR

SEQ ID NO: 48990 - protein, 15 aa, Homo sapiens
HLAQHLNNDRNPLFT

SEQ ID NO: 48991 - protein, 12 aa, Homo sapiens
HLGGSQQLLHNK

SEQ ID NO: 48992 - protein, 16 aa, Homo sapiens
HLGGSQQLLHNKQEGR

SEQ ID NO: 48993 - protein, 22 aa, Homo sapiens
HQHGSHGGLDIVIIEQEDDSDR

SEQ ID NO: 48994 - protein, 11 aa, Homo sapiens
ISYQSSSTEER

SEQ ID NO: 48995 - protein, 12 aa, Homo sapiens
ISYQSSSTEERR

SEQ ID NO: 48996 - protein, 20 aa, Homo sapiens
KQGGSQSSYVLQTEELVANK

SEQ ID NO: 48997 - protein, 23 aa, Homo sapiens
KQGGSQSSYVLQTEELVANKQQR

SEQ ID NO: 48998 - protein, 26 aa, Homo sapiens
KQGGSQSSYVLQTEELVANKQQRETK

SEQ ID NO: 48999 - protein, 12 aa, Homo sapiens
KSQQYDLNALHK

SEQ ID NO: 49000 - protein, 10 aa, Homo sapiens
LHYGENGVQK

SEQ ID NO: 49001 - protein, 13 aa, Homo sapiens
LPSEFSQFPHGQK

SEQ ID NO: 49002 - protein, 21 aa, Homo sapiens
LPSEFSQFPHGQKGQHYSGQK

SEQ ID NO: 49003 - protein, 20 aa, Homo sapiens
LQHGSKDIFSTQDELLVYNK

SEQ ID NO: 49004 - protein, 26 aa, Homo sapiens
LQHGSKDIFSTQDELLVYNKNQHQTK

SEQ ID NO: 49005 - protein, 8 aa, Homo sapiens
LWVHGLSK

SEQ ID NO: 49006 - protein, 18 aa, Homo sapiens
LWVHGLSKEQTSVSGAQK

SEQ ID NO: 49007 - protein, 10 aa, Homo sapiens
NLNQDQQHGR

SEQ ID NO: 49008 - protein, 11 aa, Homo sapiens
NLNQDQQHGRK

SEQ ID NO: 49009 - protein, 16 aa, Homo sapiens
NQHQTKNLNQDQQHGR

SEQ ID NO: 49010 - protein, 16 aa, Homo sapiens
NSHQNKGHYQNVVEVR

SEQ ID NO: 49011 - protein, 9 aa, Homo sapiens
QDLLSHEQK

SEQ ID NO: 49012 - protein, 11 aa, Homo sapiens
QDLLSHEQKGR

SEQ ID NO: 49013 - protein, 10 aa, Homo sapiens
QEPWHGENAK

SEQ ID NO: 49014 - protein, 19 aa, Homo sapiens
QEPWHGENAKGESGQSTNR

SEQ ID NO: 49015 - protein, 19 aa, Homo sapiens
QGGSQSSYVLQTEELVANK

SEQ ID NO: 49016 - protein, 22 aa, Homo sapiens
QGGSQSSYVLQTEELVANKQQR

SEQ ID NO: 49017 - protein, 25 aa, Homo sapiens
QGGSQSSYVLQTEELVANKQQRETK

SEQ ID NO: 49018 - protein, 14 aa, Homo sapiens
QITIPSQEQEHSQK

SEQ ID NO: 49019 - protein, 11 aa, Homo sapiens
RLHYGENGVQK

SEQ ID NO: 49020 - protein, 9 aa, Homo sapiens
RLWVHGLSK

SEQ ID NO: 49021 - protein, 8 aa, Homo sapiens
SIYSQTEK

SEQ ID NO: 49022 - protein, 7 aa, Homo sapiens
SKGHFHR

SEQ ID NO: 49023 - protein, 9 aa, Homo sapiens
SQIQAPNPK

SEQ ID NO: 49024 - protein, 11 aa, Homo sapiens
SQQYDLNALHK

SEQ ID NO: 49025 - protein, 15 aa, Homo sapiens
SQRHLGGSQQLLHNK

SEQ ID NO: 49026 - protein, 11 aa, Homo sapiens
VLQTEELVANK

SEQ ID NO: 49027 - protein, 10 aa, Homo sapiens
VLSLLLILEK

SEQ ID NO: 49028 - protein, 12 aa, Homo sapiens
VQTSLCPAHQDK

SEQ ID NO: 49029 - protein, 18 aa, Homo sapiens
VQTSLCPAHQDKLQHGSK

SEQ ID NO: 49030 - protein, 9 aa, Homo sapiens
VVIHHKGGK

SEQ ID NO: 49031 - protein, 18 aa, Homo sapiens
ATKSKQHLGGSQQLLNYK

SEQ ID NO: 49032 - protein, 17 aa, Homo sapiens
DHDKSKGHFHMIVIHHK

SEQ ID NO: 49033 - protein, 39 aa, Homo sapiens
DHDKSKGHFHMIVIHHKGGQAHHGTQNPSQDQGNSPSGK

SEQ ID NO: 49034 - protein, 14 aa, Homo sapiens
DIFTTQDELLVYNK

SEQ ID NO: 49035 - protein, 20 aa, Homo sapiens
DIFTTQDELLVYNKNQHQTK

SEQ ID NO: 49036 - protein, 8 aa, Homo sapiens
DQQHTKSK

SEQ ID NO: 49037 - protein, 28 aa, Homo sapiens
DQQHTKSKGSFSIQHTYHVDINDHDWTR

SEQ ID NO: 49038 - protein, 14 aa, Homo sapiens
DVSKGSISIQTEEK

SEQ ID NO: 49039 - protein, 13 aa, Homo sapiens
DVSQSSISFQIEK

SEQ ID NO: 49040 - protein, 10 aa, Homo sapiens
EQASASGAQK

SEQ ID NO: 49041 - protein, 12 aa, Homo sapiens
EQASASGAQKGR

SEQ ID NO: 49042 - protein, 22 aa, Homo sapiens
GGQAHHGTQNPSQDQGNSPSGK

SEQ ID NO: 49043 - protein, 19 aa, Homo sapiens
GGSKGQLPSGSSQFPHGQK

SEQ ID NO: 49044 - protein, 11 aa, Homo sapiens
GHFHMIVIHHK

SEQ ID NO: 49045 - protein, 10 aa, Homo sapiens
GHYQNVVDVR

SEQ ID NO: 49046 - protein, 16 aa, Homo sapiens
GHYQNVVDVREEHSSK

SEQ ID NO: 49047 - protein, 19 aa, Homo sapiens
GKSGQSADSKQDLLSHEQK

SEQ ID NO: 49048 - protein, 11 aa, Homo sapiens
GLSSQCSNTEK

SEQ ID NO: 49049 - protein, 12 aa, Homo sapiens
GLSSQCSNTEKR

SEQ ID NO: 49050 - protein, 8 aa, Homo sapiens
GQHYFGQK

SEQ ID NO: 49051 - protein, 14 aa, Homo sapiens
GQHYFGQKDQQHTK

SEQ ID NO: 49052 - protein, 15 aa, Homo sapiens
GQLPSGSSQFPHGQK

SEQ ID NO: 49053 - protein, 23 aa, Homo sapiens
GQLPSGSSQFPHGQKGQHYFGQK

SEQ ID NO: 49054 - protein, 22 aa, Homo sapiens
GRTQGGSQSSYVLQTEELVVNK

SEQ ID NO: 49055 - protein, 20 aa, Homo sapiens
GSFSIQHTYHVDINDHDWTR

SEQ ID NO: 49056 - protein, 21 aa, Homo sapiens
GSFSIQHTYHVDINDHDWTRK

SEQ ID NO: 49057 - protein, 10 aa, Homo sapiens
GSISIQTEEK

SEQ ID NO: 49058 - protein, 14 aa, Homo sapiens
GSISIQTEEKIHGK

SEQ ID NO: 49059 - protein, 14 aa, Homo sapiens
GSISIQTEEQIHGK

SEQ ID NO: 49060 - protein, 7 aa, Homo sapiens
HLNCGEK

SEQ ID NO: 49061 - protein, 31 aa, Homo sapiens
IHGKSQNQVTIHSQDQEHGHKENKISYQSSS

SEQ ID NO: 49062 - protein, 11 aa, Homo sapiens
IPSQAQEYGHK

SEQ ID NO: 49063 - protein, 14 aa, Homo sapiens
IPSQAQEYGHKENK

SEQ ID NO: 49064 - protein, 15 aa, Homo sapiens
KSQQYDLNALHKATK

SEQ ID NO: 49065 - protein, 10 aa, Homo sapiens
LNSGEKDVQK

SEQ ID NO: 49066 - protein, 12 aa, Homo sapiens
LQTSLHPAHQDR

SEQ ID NO: 49067 - protein, 18 aa, Homo sapiens
LWVHGLSKEQASASGAQK

SEQ ID NO: 49068 - protein, 11 aa, Homo sapiens
MSYQSSSTEER

SEQ ID NO: 49069 - protein, 10 aa, Homo sapiens
NLSQDQEHGR

SEQ ID NO: 49070 - protein, 11 aa, Homo sapiens
NLSQDQEHGRK

SEQ ID NO: 49071 - protein, 16 aa, Homo sapiens
NQHQTKNLSQDQEHGR

SEQ ID NO: 49072 - protein, 16 aa, Homo sapiens
NSHQNKGHYQNVVDVR

SEQ ID NO: 49073 - protein, 30 aa, Homo sapiens
QESSESHNIVITEHEVAQDDHLTQQYNEDR

SEQ ID NO: 49074 - protein, 13 aa, Homo sapiens
QHLGGSQQLLNYK

SEQ ID NO: 49075 - protein, 17 aa, Homo sapiens
QHLGGSQQLLNYKQEGR

SEQ ID NO: 49076 - protein, 11 aa, Homo sapiens
RLNSGEKDVQK

SEQ ID NO: 49077 - protein, 17 aa, Homo sapiens
SGQSADSKQDLLSHEQK

SEQ ID NO: 49078 - protein, 19 aa, Homo sapiens
SGQSADSKQDLLSHEQKGR

SEQ ID NO: 49079 - protein, 13 aa, Homo sapiens
SKGHFHMIVIHHK

SEQ ID NO: 49080 - protein, 22 aa, Homo sapiens
SKGSFSIQHTYHVDINDHDWTR

SEQ ID NO: 49081 - protein, 23 aa, Homo sapiens
SKGSFSIQHTYHVDINDHDWTRK

SEQ ID NO: 49082 - protein, 15 aa, Homo sapiens
SKQHLGGSQQLLNYK

SEQ ID NO: 49083 - protein, 19 aa, Homo sapiens
SKQHLGGSQQLLNYKQEGR

SEQ ID NO: 49084 - protein, 19 aa, Homo sapiens
SQIQTPNPNQDQWSGQNAK

SEQ ID NO: 49085 - protein, 17 aa, Homo sapiens
SQNQVTIHSQDQEHGHK

SEQ ID NO: 49086 - protein, 20 aa, Homo sapiens
SQNQVTIHSQDQEHGHKENK

SEQ ID NO: 49087 - protein, 17 aa, Homo sapiens
SQNQVTIPSQDQEHGHK

SEQ ID NO: 49088 - protein, 20 aa, Homo sapiens
SQNQVTIPSQDQEHGHKENK

SEQ ID NO: 49089 - protein, 14 aa, Homo sapiens
SQQYDLNALHKATK

SEQ ID NO: 49090 - protein, 17 aa, Homo sapiens
STQKDVSQSSISFQIEK

SEQ ID NO: 49091 - protein, 20 aa, Homo sapiens
TQGGSQSSYVLQTEELVVNK

SEQ ID NO: 49092 - protein, 23 aa, Homo sapiens
TQGGSQSSYVLQTEELVVNKQQR

SEQ ID NO: 49093 - protein, 32 aa, Homo sapiens
YKQESSESHNIVITEHEVAQDDHLTQQYNEDR

SEQ ID NO: 49094 - protein, 13 aa, Homo sapiens
ADTLTPEECQQFK

SEQ ID NO: 49095 - protein, 12 aa, Homo sapiens
DVTNNVHYENYR

SEQ ID NO: 49096 - protein, 36 aa, Homo sapiens
EGGVQLLLTIVDTPGFGDAVDNSNCWQPVIDYIDSK

SEQ ID NO: 49097 - protein, 18 aa, Homo sapiens
FIAPSGHGLKPLDIEFMK

SEQ ID NO: 49098 - protein, 19 aa, Homo sapiens
PWGVAEVENGEHCDFTILR

SEQ ID NO: 49099 - protein, 21 aa, Homo sapiens
QYPWGVAEVENGEHCDFTILR

SEQ ID NO: 49100 - protein, 23 aa, Homo sapiens
STLINSLFLTDLYSPEYPGPSHR

SEQ ID NO: 49101 - protein, 24 aa, Homo sapiens
VQCCLYFIAPSGHGLKPLDIEFMK

SEQ ID NO: 49102 - protein, 17 aa, Homo sapiens
KLQLWTNGSVAYSVARE

SEQ ID NO: 49103 - protein, 20 aa, Homo sapiens
KEEEIFSLFNSSDTNLQGGK

SEQ ID NO: 49104 - protein, 13 aa, Homo sapiens
LSEPDPSHTLEER

SEQ ID NO: 49105 - protein, 15 aa, Homo sapiens
SISVQELMGCLGVAK

SEQ ID NO: 49106 - protein, 20 aa, Homo sapiens
AAAAKPNNLSLVVHGPGDLR

SEQ ID NO: 49107 - protein, 14 aa, Homo sapiens
AKEIGADLVLQISK

SEQ ID NO: 49108 - protein, 9 aa, Homo sapiens
ALEAFETFK

SEQ ID NO: 49109 - protein, 10 aa, Homo sapiens
ALEAFETFKK

SEQ ID NO: 49110 - protein, 16 aa, Homo sapiens
AMGAAQVVVTDLSATR

SEQ ID NO: 49111 - protein, 12 aa, Homo sapiens
EIGADLVLQISK

SEQ ID NO: 49112 - protein, 8 aa, Homo sapiens
ESPQEIAR

SEQ ID NO: 49113 - protein, 8 aa, Homo sapiens
GGVTLGHK

SEQ ID NO: 49114 - protein, 7 aa, Homo sapiens
HLKPGDR

SEQ ID NO: 49115 - protein, 8 aa, Homo sapiens
HNAAFCYK

SEQ ID NO: 49116 - protein, 7 aa, Homo sapiens
IGNFIVK

SEQ ID NO: 49117 - protein, 15 aa, Homo sapiens
KPMVLGHEASGTVEK

SEQ ID NO: 49118 - protein, 17 aa, Homo sapiens
LENYPIPEPGPNEVLLR

SEQ ID NO: 49119 - protein, 21 aa, Homo sapiens
LPDNVTFEEGALIEPLSVGIH

SEQ ID NO: 49120 - protein, 24 aa, Homo sapiens
LPDNVTFEEGALIEPLSVGIHACR

SEQ ID NO: 49121 - protein, 18 aa, Homo sapiens
MHSVGICGSDVHYWEYGR

SEQ ID NO: 49122 - protein, 25 aa, Homo sapiens
SGGTLVLVGLGSEMTTVPLLHAAIR

SEQ ID NO: 49123 - protein, 11 aa, Homo sapiens
SVNVKPLVTHR

SEQ ID NO: 49124 - protein, 9 aa, Homo sapiens
VAIEPGAPR

SEQ ID NO: 49125 - protein, 18 aa, Homo sapiens
VLVCGAGPIGMVTLLVAK

SEQ ID NO: 49126 - protein, 15 aa, Homo sapiens
YCNTWPVAISMLASK

SEQ ID NO: 49127 - protein, 21 aa, Homo sapiens
YNLSPSIFFCATPPDDGNLCR

SEQ ID NO: 49128 - protein, 8 aa, Homo sapiens
EIENLPLR

SEQ ID NO: 49129 - protein, 16 aa, Homo sapiens
QLNFIPIDLGSLSSAR

SEQ ID NO: 49130 - protein, 19 aa, Homo sapiens
SQFLEEGIGGTIPHVSPER

SEQ ID NO: 49131 - protein, 10 aa, Homo sapiens
ILVDISNNLK

SEQ ID NO: 49132 - protein, 8 aa, Homo sapiens
MAISIPNR

SEQ ID NO: 49133 - protein, 16 aa, Homo sapiens
NLGLTPMDQGSLMAAK

SEQ ID NO: 49134 - protein, 18 aa, Homo sapiens
TTLLPSGAEVLSYSEAAK

SEQ ID NO: 49135 - protein, 32 aa, Homo sapiens
FDGQPINETDTPAQLEMEDEDTIDVFQQQTGG

SEQ ID NO: 49136 - protein, 12 aa, Homo sapiens
VAGQDGSVVQFK

SEQ ID NO: 49137 - protein, 9 aa, Homo sapiens
AAIDWFDGK

SEQ ID NO: 49138 - protein, 27 aa, Homo sapiens
QSSYSQQPYNNQGQQQNMESSGSQGGR

SEQ ID NO: 49139 - protein, 34 aa, Homo sapiens
TDADSESDNSDNNTIFVQGLGEGVSTDQVGEFFK

SEQ ID NO: 49140 - protein, 14 aa, Homo sapiens
DDGLFSGDPNWFPK

SEQ ID NO: 49141 - protein, 21 aa, Homo sapiens
DGTVLCELINALYPEGQAPVK

SEQ ID NO: 49142 - protein, 22 aa, Homo sapiens
DGTVLCELINALYPEGQAPVKK

SEQ ID NO: 49143 - protein, 22 aa, Homo sapiens
KDGTVLCELINALYPEGQAPVK

SEQ ID NO: 49144 - protein, 11 aa, Homo sapiens
NFSDNQLQEGK

SEQ ID NO: 49145 - protein, 14 aa, Homo sapiens
QMEQISQFLQAAER

SEQ ID NO: 49146 - protein, 19 aa, Homo sapiens
QYDADLEQILIQWITTQCR

SEQ ID NO: 49147 - protein, 12 aa, Homo sapiens
TLMNLGGLAVAR

SEQ ID NO: 49148 - protein, 18 aa, Homo sapiens
YGINTTDIFQTVDLWEGK

SEQ ID NO: 49149 - protein, 30 aa, Homo sapiens
FAPYKPQDILLKPLLFEVPSITTDSVFVGR

SEQ ID NO: 49150 - protein, 15 aa, Homo sapiens
LQCGENGPAHPLPSK

SEQ ID NO: 49151 - protein, 7 aa, Homo sapiens
ALGIPAR

SEQ ID NO: 49152 - protein, 10 aa, Homo sapiens
AMCAMMSFEK

SEQ ID NO: 49153 - protein, 7 aa, Homo sapiens
DITYEYK

SEQ ID NO: 49154 - protein, 16 aa, Homo sapiens
DITYEYKYPEGSSEER

SEQ ID NO: 49155 - protein, 16 aa, Homo sapiens
EVTVAVTSSPNAILGK

SEQ ID NO: 49156 - protein, 16 aa, Homo sapiens
EYILNDTGCHYVGAAR

SEQ ID NO: 49157 - protein, 30 aa, Homo sapiens
FSLESLGISSLQTSDHGTVQPGETIQSQIK

SEQ ID NO: 49158 - protein, 10 aa, Homo sapiens
FVFSEVNGDR

SEQ ID NO: 49159 - protein, 11 aa, Homo sapiens
GFIIAEIVESK

SEQ ID NO: 49160 - protein, 21 aa, Homo sapiens
GQGVLIGNWTGDYEGGTAPYK

SEQ ID NO: 49161 - protein, 7 aa, Homo sapiens
GQVFHLR

SEQ ID NO: 49162 - protein, 15 aa, Homo sapiens
GYDGWQAVDATPQER

SEQ ID NO: 49163 - protein, 9 aa, Homo sapiens
HTLVVLDPR

SEQ ID NO: 49164 - protein, 12 aa, Homo sapiens
IGQLLVCNCIFK

SEQ ID NO: 49165 - protein, 11 aa, Homo sapiens
KGDIFIVYDTR

SEQ ID NO: 49166 - protein, 13 aa, Homo sapiens
LEFSTGPNPSIAK

SEQ ID NO: 49167 - protein, 14 aa, Homo sapiens
LVLNQPLQSYHQLK

SEQ ID NO: 49168 - protein, 11 aa, Homo sapiens
NTLAIPLTDVK

SEQ ID NO: 49169 - protein, 20 aa, Homo sapiens
NVLDCCISLLTESSLKPTDR

SEQ ID NO: 49170 - protein, 14 aa, Homo sapiens
QVMDHAFLLLSSER

SEQ ID NO: 49171 - protein, 8 aa, Homo sapiens
RGQVFHLR

SEQ ID NO: 49172 - protein, 16 aa, Homo sapiens
SQGVFCCGPSPLTAIR

SEQ ID NO: 49173 - protein, 13 aa, Homo sapiens
SVTGFDSAHDTER

SEQ ID NO: 49174 - protein, 7 aa, Homo sapiens
TGNHILK

SEQ ID NO: 49175 - protein, 18 aa, Homo sapiens
TPSDHYNWQATLQNESGK

SEQ ID NO: 49176 - protein, 34 aa, Homo sapiens
TPSDHYNWQATLQNESGKEVTVAVTSSPNAILGK

SEQ ID NO: 49177 - protein, 18 aa, Homo sapiens
TSQIQGQVSEVTLTLDSK

SEQ ID NO: 49178 - protein, 16 aa, Homo sapiens
TYINSLAILDDEPVIR

SEQ ID NO: 49179 - protein, 15 aa, Homo sapiens
WTGSAPILQQYYNTK

SEQ ID NO: 49180 - protein, 9 aa, Homo sapiens
YPEGSSEER

SEQ ID NO: 49181 - protein, 10 aa, Homo sapiens
TPPEGPQAPR

SEQ ID NO: 49182 - protein, 28 aa, Homo sapiens
KFRNPPLVNGSLALAFQGTAPPPNWRRP

SEQ ID NO: 49183 - protein, 12 aa, Homo sapiens
RVNITYNYPVRA

SEQ ID NO: 49184 - protein, 20 aa, Homo sapiens
FACESIVEEYEDELIEFFSR

SEQ ID NO: 49185 - protein, 16 aa, Homo sapiens
RTDLCDHALHISHDEL

SEQ ID NO: 49186 - protein, 15 aa, Homo sapiens
SEAHLTELLEEICDR

SEQ ID NO: 49187 - protein, 15 aa, Homo sapiens
TDLCDHALHISHDEL

SEQ ID NO: 49188 - protein, 27 aa, Homo sapiens
RLMGVNSTAAAAAGQPNVSCTCNCKRS

SEQ ID NO: 49189 - protein, 11 aa, Homo sapiens
GKTSEVLNAAK

SEQ ID NO: 49190 - protein, 8 aa, Homo sapiens
NNDIALMK

SEQ ID NO: 49191 - protein, 20 aa, Homo sapiens
NNFYSSQGIVDDSGSTSFMK

SEQ ID NO: 49192 - protein, 14 aa, Homo sapiens
QSFMFYGAGYQVEK

SEQ ID NO: 49193 - protein, 10 aa, Homo sapiens
SPSGTVCTSK

SEQ ID NO: 49194 - protein, 16 aa, Homo sapiens
SWHPVCQDDWNENYGR

SEQ ID NO: 49195 - protein, 10 aa, Homo sapiens
TKNNDIALMK

SEQ ID NO: 49196 - protein, 9 aa, Homo sapiens
TSEVLNAAK

SEQ ID NO: 49197 - protein, 10 aa, Homo sapiens
VISHPNYDSK

SEQ ID NO: 49198 - protein, 8 aa, Homo sapiens
VLLIETQR

SEQ ID NO: 49199 - protein, 15 aa, Homo sapiens
VLTQASNPVVCTQPK

SEQ ID NO: 49200 - protein, 20 aa, Homo sapiens
KKKDSLHGSTGAVNATRPTL

SEQ ID NO: 49201 - protein, 11 aa, Homo sapiens
AGLNSLEAVKR

SEQ ID NO: 49202 - protein, 20 aa, Homo sapiens
EENVGLHQTLDQTLNELNCI

SEQ ID NO: 49203 - protein, 8 aa, Homo sapiens
TIDDLEEK

SEQ ID NO: 49204 - protein, 11 aa, Homo sapiens
YEEEIKLLSDK

SEQ ID NO: 49205 - protein, 16 aa, Homo sapiens
FCDTCLQEFLSEGVFK

SEQ ID NO: 49206 - protein, 12 aa, Homo sapiens
LLAQHATSECPK

SEQ ID NO: 49207 - protein, 43 aa, Homo sapiens
RKMAHPAMFPRRGSGSGSASALNAAGTGVGSNATSSEDFPPPS

SEQ ID NO: 49208 - protein, 15 aa, Homo sapiens
AVLVDLEPGTMDSVR

SEQ ID NO: 49209 - protein, 17 aa, Homo sapiens
EIVHLQAGQCGNQIGAK

SEQ ID NO: 49210 - protein, 27 aa, Homo sapiens
FWEVISDEHGIDPTGTYHGDSDLQLER

SEQ ID NO: 49211 - protein, 18 aa, Homo sapiens
RYLFPEVDMTSTNFTGLS

SEQ ID NO: 49212 - protein, 21 aa, Homo sapiens
PAPACALLLLFPLTAQHENFR

SEQ ID NO: 49213 - protein, 21 aa, Homo sapiens
VNFHFILFNNVDGHLYELDGR

SEQ ID NO: 49214 - protein, 32 aa, Homo sapiens
AAFVAESAVAGSAEANAFSVLQHVLGAGPHVK

SEQ ID NO: 49215 - protein, 21 aa, Homo sapiens
AVAFQNPQTHVIENLHAAAYR

SEQ ID NO: 49216 - protein, 39 aa, Homo sapiens
EQNGDSLVHAAFVAESAVAGSAEANAFSVLQHVLGAGPH

SEQ ID NO: 49217 - protein, 14 aa, Homo sapiens
GSNTTSHLHQAVAK

SEQ ID NO: 49218 - protein, 20 aa, Homo sapiens
KTIAQGNLSNTDVQAAKNKL

SEQ ID NO: 49219 - protein, 18 aa, Homo sapiens
LPNGLVIASLENYSPVSR

SEQ ID NO: 49220 - protein, 14 aa, Homo sapiens
MALIGLGVSHPVLK

SEQ ID NO: 49221 - protein, 13 aa, Homo sapiens
NALANPLYCPDYR

SEQ ID NO: 49222 - protein, 17 aa, Homo sapiens
SMAASGNLGHTPFVDEL

SEQ ID NO: 49223 - protein, 14 aa, Homo sapiens
SVLQHVLGAGPHVK

SEQ ID NO: 49224 - protein, 16 aa, Homo sapiens
TIAQGNLSNTDVQAAK

SEQ ID NO: 49225 - protein, 18 aa, Homo sapiens
VTSEELHYFVQNHFTSAR

SEQ ID NO: 49226 - protein, 14 aa, Homo sapiens
YEDFSNLGTTHLLR

SEQ ID NO: 49227 - protein, 9 aa, Homo sapiens
ALTVYNLNR

SEQ ID NO: 49228 - protein, 22 aa, Homo sapiens
GVENVYTQHQPFLHETLDHLIK

SEQ ID NO: 49229 - protein, 26 aa, Homo sapiens
NLLEVSEVEQELACQNDHSSALQNIK

SEQ ID NO: 49230 - protein, 8 aa, Homo sapiens
NLMEDFQK

SEQ ID NO: 49231 - protein, 9 aa, Homo sapiens
NLMEDFQKK

SEQ ID NO: 49232 - protein, 14 aa, Homo sapiens
SFLEEVLASGLHSR

SEQ ID NO: 49233 - protein, 8 aa, Homo sapiens
DGALLGDR

SEQ ID NO: 49234 - protein, 29 aa, Homo sapiens
ELPTEPPYTAYVGNLPFNTVQGDIDAIFK

SEQ ID NO: 49235 - protein, 14 aa, Homo sapiens
GFCYVEFDEVDSLK

SEQ ID NO: 49236 - protein, 18 aa, Homo sapiens
VGNLPFNTVQGDIDAIFK

SEQ ID NO: 49237 - protein, 11 aa, Homo sapiens
DSLIFLVDASK

SEQ ID NO: 49238 - protein, 12 aa, Homo sapiens
DTGIFLDLMHLK

SEQ ID NO: 49239 - protein, 18 aa, Homo sapiens
FDDPGLMLMGFKPLVLLK

SEQ ID NO: 49240 - protein, 18 aa, Homo sapiens
IISSDRDLLAVVFYGTEK

SEQ ID NO: 49241 - protein, 19 aa, Homo sapiens
IQVTPPGFQLVFLPFADDK

SEQ ID NO: 49242 - protein, 20 aa, Homo sapiens
IQVTPPGFQLVFLPFADDKR

SEQ ID NO: 49243 - protein, 12 aa, Homo sapiens
KPGGFDISLFYR

SEQ ID NO: 49244 - protein, 10 aa, Homo sapiens
KQELLEALTK

SEQ ID NO: 49245 - protein, 22 aa, Homo sapiens
MLFTNEDNPHGNDSAKASRART

SEQ ID NO: 49246 - protein, 20 aa, Homo sapiens
NIPPYFVALVPQEEELDDQK

SEQ ID NO: 49247 - protein, 14 aa, Homo sapiens
NIYVLQELDNPGAK

SEQ ID NO: 49248 - protein, 22 aa, Homo sapiens
NLEALALDLMEPEQAVDLTLPK

SEQ ID NO: 49249 - protein, 16 aa, Homo sapiens
PPGFQLVFLPFADDKR

SEQ ID NO: 49250 - protein, 18 aa, Homo sapiens
RTFNTSTGGLLLPSDTKR

SEQ ID NO: 49251 - protein, 14 aa, Homo sapiens
SDSFENPVLQQHFR

SEQ ID NO: 49252 - protein, 16 aa, Homo sapiens
TFNTSTGGLLLPSDTK

SEQ ID NO: 49253 - protein, 17 aa, Homo sapiens
TFNTSTGGLLLPSDTKR

SEQ ID NO: 49254 - protein, 11 aa, Homo sapiens
EDVFVHQTAIK

SEQ ID NO: 49255 - protein, 19 aa, Homo sapiens
GAEAANVTGPGGVPVQGSK

SEQ ID NO: 49256 - protein, 15 aa, Homo sapiens
NDTKEDVFVHQTAIK

SEQ ID NO: 49257 - protein, 8 aa, Homo sapiens
NGYGFINR

SEQ ID NO: 49258 - protein, 26 aa, Homo sapiens
PGTTGSGAGSGGPGGLTSAAPAGGDK

SEQ ID NO: 49259 - protein, 39 aa, Homo sapiens
PPAAPALSAADTKPGTTGSGAGSGGPGGLTSAAPAGGDK

SEQ ID NO: 49260 - protein, 43 aa, Homo sapiens
PPAAPPAAPALSAADTKPGTTGSGAGSGGPGGLTSAAPAGGDK

SEQ ID NO: 49261 - protein, 27 aa, Homo sapiens
RPQYSNPPVQGEVMEGADNQGAGEQGR

SEQ ID NO: 49262 - protein, 30 aa, Homo sapiens
RPQYSNPPVQGEVMEGADNQGAGEQGRPVR

SEQ ID NO: 49263 - protein, 17 aa, Homo sapiens
SVGDGETVEFDVVEGEK

SEQ ID NO: 49264 - protein, 18 aa, Homo sapiens
KDNNSCQKMANETDPENL

SEQ ID NO: 49265 - protein, 15 aa, Homo sapiens
ELETVCNDVLSLLDK

SEQ ID NO: 49266 - protein, 16 aa, Homo sapiens
LAEQAERYDDMASAMK

SEQ ID NO: 49267 - protein, 19 aa, Homo sapiens
QAFDDAIAELDTLNEDSYK

SEQ ID NO: 49268 - protein, 29 aa, Homo sapiens
QAFDDAIAELDTLNEDSYKDSTLIMQLLR

SEQ ID NO: 49269 - protein, 14 aa, Homo sapiens
KDNSTACSHPVTKH

SEQ ID NO: 49270 - protein, 18 aa, Homo sapiens
REAFFGGNGKINLTVFKL

SEQ ID NO: 49271 - protein, 15 aa, Homo sapiens
REQQNDTSSELQNRE

SEQ ID NO: 49272 - protein, 16 aa, Homo sapiens
KTPSVSPNITQLFQKQ

SEQ ID NO: 49273 - protein, 17 aa, Homo sapiens
MNVSGGPITREASKEIP

SEQ ID NO: 49274 - protein, 20 aa, Homo sapiens
MNYSVSAGLVVGIFIGFQKK

SEQ ID NO: 49275 - protein, 9 aa, Homo sapiens
AAALAHLDR

SEQ ID NO: 49276 - protein, 27 aa, Homo sapiens
MALYHNISGVGLFLHPVGLELLLDHRA

SEQ ID NO: 49277 - protein, 10 aa, Homo sapiens
YLDSSFGLGR

SEQ ID NO: 49278 - protein, 12 aa, Homo sapiens
ACNQLGQFLQHR

SEQ ID NO: 49279 - protein, 12 aa, Homo sapiens
EMAEAFAGEIPK

SEQ ID NO: 49280 - protein, 28 aa, Homo sapiens
IIGFGSALLEEVDPNPANFVGAGIIHTK

SEQ ID NO: 49281 - protein, 23 aa, Homo sapiens
NAVLFEAISLIIHHDSEPNLLVR

SEQ ID NO: 49282 - protein, 13 aa, Homo sapiens
SSPLIQFHLLHSK

SEQ ID NO: 49283 - protein, 18 aa, Homo sapiens
VGGYILGEFGNLIAGDPR

SEQ ID NO: 49284 - protein, 26 aa, Homo sapiens
VVHLLNDQHLGVVTAATSLITTLAQK

SEQ ID NO: 49285 - protein, 21 aa, Homo sapiens
YLALESMCTLASSEFSHEAVK

SEQ ID NO: 49286 - protein, 15 aa, Homo sapiens
DLILQCLDDKDESIR

SEQ ID NO: 49287 - protein, 27 aa, Homo sapiens
DLSSPSQYDTGVALTGLSCFVTPDLAR

SEQ ID NO: 49288 - protein, 22 aa, Homo sapiens
DVPVAEEVSALFAGELNPVAPK

SEQ ID NO: 49289 - protein, 23 aa, Homo sapiens
EKLEDPDPGVQSAAVNVICELAR

SEQ ID NO: 49290 - protein, 21 aa, Homo sapiens
LEDPDPGVQSAAVNVICELAR

SEQ ID NO: 49291 - protein, 12 aa, Homo sapiens
SIQGHHVCLLVK

SEQ ID NO: 49292 - protein, 14 aa, Homo sapiens
YISQCIDEIKQELK

SEQ ID NO: 49293 - protein, 21 aa, Homo sapiens
KQPVSPVIHPPVSYNDTAPRI

SEQ ID NO: 49294 - protein, 17 aa, Homo sapiens
RELKLNASLPALLLIRL

SEQ ID NO: 49295 - protein, 21 aa, Homo sapiens
KDNSSLNPLDRLISEDKKEKM

SEQ ID NO: 49296 - protein, 23 aa, Homo sapiens
KHMSQNQAVKRGYNSVMNESERF

SEQ ID NO: 49297 - protein, 27 aa, Homo sapiens
PHMLPEDGANLSSARGILSLIQSSTRR

SEQ ID NO: 49298 - protein, 10 aa, Homo sapiens
IDDAELKQEK

SEQ ID NO: 49299 - protein, 11 aa, Homo sapiens
MPHSFANLPLR

SEQ ID NO: 49300 - protein, 15 aa, Homo sapiens
RKMPSNQNVSPSQRD

SEQ ID NO: 49301 - protein, 22 aa, Homo sapiens
KYGNMTEDHVMHLLQNADPLKV

SEQ ID NO: 49302 - protein, 27 aa, Homo sapiens
RMATPLLMQALPMGALPQGPMQNATKY

SEQ ID NO: 49303 - protein, 13 aa, Homo sapiens
IHDINDNEPIFTK

SEQ ID NO: 49304 - protein, 23 aa, Homo sapiens
REDAQINTTIGSVTAQDPDAARN

SEQ ID NO: 49305 - protein, 13 aa, Homo sapiens
TPESSPPGTPIGR

SEQ ID NO: 49306 - protein, 17 aa, Homo sapiens
KLDFLMFNYSVPSYLKL

SEQ ID NO: 49307 - protein, 23 aa, Homo sapiens
FQPASAPAEDCISSSTEPKPDPK

SEQ ID NO: 49308 - protein, 17 aa, Homo sapiens
IRKEGLDEVAGIINDAK

SEQ ID NO: 49309 - protein, 38 aa, Homo sapiens
LEQQQSAGGDAEGGGDDGDEVPQIDAYELLEAVEILSK

SEQ ID NO: 49310 - protein, 20 aa, Homo sapiens
STPTDLILCVPHLYSCLEDR

SEQ ID NO: 49311 - protein, 8 aa, Homo sapiens
TLLHTLCK

SEQ ID NO: 49312 - protein, 17 aa, Homo sapiens
EVAYLGNEVSDEECLKR

SEQ ID NO: 49313 - protein, 15 aa, Homo sapiens
GVEKPPHLAALILAR

SEQ ID NO: 49314 - protein, 16 aa, Homo sapiens
VGLSGAPADACSTAQK

SEQ ID NO: 49315 - protein, 13 aa, Homo sapiens
GPIDIDGFAVLGK

SEQ ID NO: 49316 - protein, 17 aa, Homo sapiens
KENSSVEAKDSGLESKK

SEQ ID NO: 49317 - protein, 18 aa, Homo sapiens
MKTQEPAGSLEENNSDKN

SEQ ID NO: 49318 - protein, 21 aa, Homo sapiens
KVDSQEHKIILYENPNFTGKK

SEQ ID NO: 49319 - protein, 18 aa, Homo sapiens
ESTNYPGDYTLCVSCDGK

SEQ ID NO: 49320 - protein, 15 aa, Homo sapiens
YNFHGTAEQDLPFCK

SEQ ID NO: 49321 - protein, 31 aa, Homo sapiens
HLDLIYNFGCHLTDDYRPGVDPALSDPVLAR

SEQ ID NO: 49322 - protein, 23 aa, Homo sapiens
ICTLPSPPSPLASLAPVADSSTR

SEQ ID NO: 49323 - protein, 22 aa, Homo sapiens
DVPIGAIICITVGKPEDIEAFK

SEQ ID NO: 49324 - protein, 14 aa, Homo sapiens
DVPLGTPLCIIVEK

SEQ ID NO: 49325 - protein, 22 aa, Homo sapiens
LQPHEFQGGTFTISNLGMFGIK

SEQ ID NO: 49326 - protein, 22 aa, Homo sapiens
NFSAIINPPQACILAIGASEDK

SEQ ID NO: 49327 - protein, 12 aa, Homo sapiens
PLGTPLCIIVEK

SEQ ID NO: 49328 - protein, 17 aa, Homo sapiens
VPLPSLSPTMQAGTIAR

SEQ ID NO: 49329 - protein, 22 aa, Homo sapiens
AQHQDPGLGGTQEGARGEATKR

SEQ ID NO: 49330 - protein, 25 aa, Homo sapiens
EFFGSGDPFAELFDDLGPFSELQNR

SEQ ID NO: 49331 - protein, 14 aa, Homo sapiens
LNIKTGKLEMSYSK

SEQ ID NO: 49332 - protein, 17 aa, Homo sapiens
KSDVEDHSVHLLFSANR

SEQ ID NO: 49333 - protein, 11 aa, Homo sapiens
LVEALCAAGHR

SEQ ID NO: 49334 - protein, 24 aa, Homo sapiens
QPDVGLPKPDLVLFLQLQLADAAK

SEQ ID NO: 49335 - protein, 9 aa, Homo sapiens
ADQVCINLR

SEQ ID NO: 49336 - protein, 13 aa, Homo sapiens
CVNHYGGYLCLPK

SEQ ID NO: 49337 - protein, 13 aa, Homo sapiens
DIDECDIVPDACK

SEQ ID NO: 49338 - protein, 13 aa, Homo sapiens
GSFACQCPPGYQK

SEQ ID NO: 49339 - protein, 29 aa, Homo sapiens
IQCAAGYEQSEHNVCQDIDECTAGTHNCR

SEQ ID NO: 49340 - protein, 10 aa, Homo sapiens
LNCEDIDECR

SEQ ID NO: 49341 - protein, 15 aa, Homo sapiens
NPADPQRIPSNPSHR

SEQ ID NO: 49342 - protein, 14 aa, Homo sapiens
NPCQDPYILTPENR

SEQ ID NO: 49343 - protein, 14 aa, Homo sapiens
PADPQRIPSNPSHR

SEQ ID NO: 49344 - protein, 13 aa, Homo sapiens
QTSPVSAMLVLVK

SEQ ID NO: 49345 - protein, 11 aa, Homo sapiens
SGNENGEFYLR

SEQ ID NO: 49346 - protein, 17 aa, Homo sapiens
SVPSDIFQIQATTIYAN

SEQ ID NO: 49347 - protein, 14 aa, Homo sapiens
ALTNLPHTDFTLCK

SEQ ID NO: 49348 - protein, 15 aa, Homo sapiens
FICHVVGITYQHIDR

SEQ ID NO: 49349 - protein, 23 aa, Homo sapiens
YGWSADESGQIFICSQEESIKPK

SEQ ID NO: 49350 - protein, 19 aa, Homo sapiens
DFSWSPGGNIIAFWVPEDK

SEQ ID NO: 49351 - protein, 25 aa, Homo sapiens
DRPQEADGIDSVIVVDNVPQVGPDR

SEQ ID NO: 49352 - protein, 10 aa, Homo sapiens
FAVLHGEAPR

SEQ ID NO: 49353 - protein, 16 aa, Homo sapiens
FSHQGVQLIDFSPCER

SEQ ID NO: 49354 - protein, 14 aa, Homo sapiens
GFHCESSAHWPIFK

SEQ ID NO: 49355 - protein, 18 aa, Homo sapiens
GYIFLEYASPAHAVDAVK

SEQ ID NO: 49356 - protein, 8 aa, Homo sapiens
NGDYLCVK

SEQ ID NO: 49357 - protein, 9 aa, Homo sapiens
NLFNVVDCK

SEQ ID NO: 49358 - protein, 13 aa, Homo sapiens
PRPPTLLSQEQIK

SEQ ID NO: 49359 - protein, 17 aa, Homo sapiens
TSIFWNDVKDPVSIEER

SEQ ID NO: 49360 - protein, 28 aa, Homo sapiens
YLVTFSPLMDTQDDPQAIIIWDILTGHK

SEQ ID NO: 49361 - protein, 9 aa, Homo sapiens
YWLEEAECR

SEQ ID NO: 49362 - protein, 17 aa, Homo sapiens
AADIEQQAVFAVFDENK

SEQ ID NO: 49363 - protein, 13 aa, Homo sapiens
ADKPLSIHPQGIR

SEQ ID NO: 49364 - protein, 10 aa, Homo sapiens
AEVDDVIQVR

SEQ ID NO: 49365 - protein, 18 aa, Homo sapiens
ASKPGWWLLNTEVGENQR

SEQ ID NO: 49366 - protein, 12 aa, Homo sapiens
AWAYYSAVNPEK

SEQ ID NO: 49367 - protein, 23 aa, Homo sapiens
AWGESTPLANKPGKQSGHPKFPR

SEQ ID NO: 49368 - protein, 14 aa, Homo sapiens
DIASGLIGLLLICK

SEQ ID NO: 49369 - protein, 15 aa, Homo sapiens
DIHSGLIGPLLICQK

SEQ ID NO: 49370 - protein, 10 aa, Homo sapiens
EDGILGPIIR

SEQ ID NO: 49371 - protein, 12 aa, Homo sapiens
EFNPLVIVGLSK

SEQ ID NO: 49372 - protein, 24 aa, Homo sapiens
EKPQSTISGLLGPTLYAEVGDIIK

SEQ ID NO: 49373 - protein, 11 aa, Homo sapiens
ENQFDPPIVAR

SEQ ID NO: 49374 - protein, 17 aa, Homo sapiens
ETDIEDSDDIPEDTTYK

SEQ ID NO: 49375 - protein, 13 aa, Homo sapiens
EVIITGIQTQGAK

SEQ ID NO: 49376 - protein, 9 aa, Homo sapiens
FCENPDEVK

SEQ ID NO: 49377 - protein, 10 aa, Homo sapiens
FCENPDEVKR

SEQ ID NO: 49378 - protein, 20 aa, Homo sapiens
FKNLASRPYSLHAHGLSYEK

SEQ ID NO: 49379 - protein, 11 aa, Homo sapiens
FTVNNLAEPQK

SEQ ID NO: 49380 - protein, 24 aa, Homo sapiens
GESVTVTMDNVGTWMLTSMNSSPR

SEQ ID NO: 49381 - protein, 15 aa, Homo sapiens
GEYEEHLGILGPIIR

SEQ ID NO: 49382 - protein, 16 aa, Homo sapiens
GEYEEHLGILGPIIRA

SEQ ID NO: 49383 - protein, 11 aa, Homo sapiens
HEDTLTLFPMR

SEQ ID NO: 49384 - protein, 13 aa, Homo sapiens
IFEGNTNTKGHVK

SEQ ID NO: 49385 - protein, 10 aa, Homo sapiens
ITAIITQGCK

SEQ ID NO: 49386 - protein, 29 aa, Homo sapiens
KGSYEIIQDTDEDTAVNNWLISPQNASRA

SEQ ID NO: 49387 - protein, 11 aa, Homo sapiens
KITAIITQGCK

SEQ ID NO: 49388 - protein, 22 aa, Homo sapiens
KMHDRLEPEDEESDADYDYQNR

SEQ ID NO: 49389 - protein, 33 aa, Homo sapiens
KNMASRPYSIYPHGVTFSPYEDEVNSSFTSGRN

SEQ ID NO: 49390 - protein, 34 aa, Homo sapiens
KNSVLNSSTAEHSSPYSEDPIEDPLQPDVTGIRL

SEQ ID NO: 49391 - protein, 11 aa, Homo sapiens
KTWNQSIALRL

SEQ ID NO: 49392 - protein, 33 aa, Homo sapiens
KTYEDDSPEWFKEDNAVQPNSSYTYVWHATERS

SEQ ID NO: 49393 - protein, 25 aa, Homo sapiens
KVSAITLVSATSTTANMTVGPEGKW

SEQ ID NO: 49394 - protein, 8 aa, Homo sapiens
LAAEFASK

SEQ ID NO: 49395 - protein, 17 aa, Homo sapiens
LEPEDEESDADYDYQNR

SEQ ID NO: 49396 - protein, 14 aa, Homo sapiens
LNNGGSYNAWSVEK

SEQ ID NO: 49397 - protein, 16 aa, Homo sapiens
LSEGASYLDHTFPAEK

SEQ ID NO: 49398 - protein, 18 aa, Homo sapiens
MDNVGTWMLTSMNSSPRS

SEQ ID NO: 49399 - protein, 16 aa, Homo sapiens
MPMGLSTGIISDSQIK

SEQ ID NO: 49400 - protein, 8 aa, Homo sapiens
MYEQEWVR

SEQ ID NO: 49401 - protein, 10 aa, Homo sapiens
NFFNPPIISR

SEQ ID NO: 49402 - protein, 15 aa, Homo sapiens
NKADKPLSIHPQGIR

SEQ ID NO: 49403 - protein, 18 aa, Homo sapiens
NLSPDLSHTTLSPELIQR

SEQ ID NO: 49404 - protein, 31 aa, Homo sapiens
NMASRPYSIYPHGVTFSPYEDEVNSSFTSGR

SEQ ID NO: 49405 - protein, 18 aa, Homo sapiens
NSVLNSSTAEHSSPYSED

SEQ ID NO: 49406 - protein, 22 aa, Homo sapiens
NSVLNSSTAEHSSPYSEDPIED

SEQ ID NO: 49407 - protein, 32 aa, Homo sapiens
NSVLNSSTAEHSSPYSEDPIEDPLQPDVTGIR

SEQ ID NO: 49408 - protein, 19 aa, Homo sapiens
NYYIAAEEISWDYSEFVQR

SEQ ID NO: 49409 - protein, 15 aa, Homo sapiens
PGWWLLNTEVGENQR

SEQ ID NO: 49410 - protein, 14 aa, Homo sapiens
PIEDPLQPDVTGIR

SEQ ID NO: 49411 - protein, 10 aa, Homo sapiens
PLQPDVTGIR

SEQ ID NO: 49412 - protein, 9 aa, Homo sapiens
PWIQVDMQK

SEQ ID NO: 49413 - protein, 26 aa, Homo sapiens
PYSIYPHGVTFSPYEDEVNSSFTSGR

SEQ ID NO: 49414 - protein, 13 aa, Homo sapiens
PYSLHAHGLSYEK

SEQ ID NO: 49415 - protein, 39 aa, Homo sapiens
RNLSPALGQMPISPDLSHTTLSPDLSHTTLSLDLSQTNL

SEQ ID NO: 49416 - protein, 28 aa, Homo sapiens
RPYSIYPHGVTFSPYEDEVNSSFTSGRN

SEQ ID NO: 49417 - protein, 32 aa, Homo sapiens
RQFYVAAQGISWSYRPEPTNSSLNLSVTSFKK

SEQ ID NO: 49418 - protein, 20 aa, Homo sapiens
RTNINSSRDPDNIAAWYLRS

SEQ ID NO: 49419 - protein, 16 aa, Homo sapiens
SATSTTANMTVGPEGK

SEQ ID NO: 49420 - protein, 10 aa, Homo sapiens
SEAYNTFSER

SEQ ID NO: 49421 - protein, 11 aa, Homo sapiens
SGPESPGSACR

SEQ ID NO: 49422 - protein, 18 aa, Homo sapiens
SHEFHAINGMIYSLPGLK

SEQ ID NO: 49423 - protein, 11 aa, Homo sapiens
SLHAHGLSYEK

SEQ ID NO: 49424 - protein, 10 aa, Homo sapiens
SLQVRQDGGK

SEQ ID NO: 49425 - protein, 13 aa, Homo sapiens
SQHLDNFSNQIGK

SEQ ID NO: 49426 - protein, 15 aa, Homo sapiens
SSMVDKIFEGNTNTK

SEQ ID NO: 49427 - protein, 11 aa, Homo sapiens
STGIISDSQIK

SEQ ID NO: 49428 - protein, 25 aa, Homo sapiens
SVTVTMDNVGTWMLTSMNSSPRSKK

SEQ ID NO: 49429 - protein, 11 aa, Homo sapiens
SWWGDYWEPFR

SEQ ID NO: 49430 - protein, 10 aa, Homo sapiens
SWYLEDNINK

SEQ ID NO: 49431 - protein, 14 aa, Homo sapiens
SYTIHYSEQGVEWK

SEQ ID NO: 49432 - protein, 17 aa, Homo sapiens
SYTIHYSEQGVEWKPYR

SEQ ID NO: 49433 - protein, 16 aa, Homo sapiens
TFHPLRSEAYNTFSER

SEQ ID NO: 49434 - protein, 18 aa, Homo sapiens
TNINSSRDPDNIAAWYLR

SEQ ID NO: 49435 - protein, 9 aa, Homo sapiens
TWNQSIALR

SEQ ID NO: 49436 - protein, 11 aa, Homo sapiens
TYEDDSPEWFK

SEQ ID NO: 49437 - protein, 13 aa, Homo sapiens
VMYTQYEDESFTK

SEQ ID NO: 49438 - protein, 23 aa, Homo sapiens
VSAITLVSATSTTANMTVGPEGK

SEQ ID NO: 49439 - protein, 7 aa, Homo sapiens
WHLASEK

SEQ ID NO: 49440 - protein, 9 aa, Homo sapiens
WIISSLTPK

SEQ ID NO: 49441 - protein, 29 aa, Homo sapiens
WNILEFDEPTENDAQCLTRPYYSDVDIMR

SEQ ID NO: 49442 - protein, 8 aa, Homo sapiens
YLDSTFTK

SEQ ID NO: 49443 - protein, 17 aa, Homo sapiens
RAAYNVTLLNFMDPQKM

SEQ ID NO: 49444 - protein, 14 aa, Homo sapiens
MAGAIIENMSTKKL

SEQ ID NO: 49445 - protein, 28 aa, Homo sapiens
AVSQNWTFHGPGASGQAAANWLAGFGRG

SEQ ID NO: 49446 - protein, 27 aa, Homo sapiens
RSAICFPFVFNSVKNGSTWTYGTLTCK

SEQ ID NO: 49447 - protein, 26 aa, Homo sapiens
VSQNWTFHGPGASGQAAANWLAGFGR

SEQ ID NO: 49448 - protein, 23 aa, Homo sapiens
KVWKKIGIWNSNSGLNMTDSNKD

SEQ ID NO: 49449 - protein, 9 aa, Homo sapiens
ELDGLWSFR

SEQ ID NO: 49450 - protein, 9 aa, Homo sapiens
GFDWPLLVK

SEQ ID NO: 49451 - protein, 15 aa, Homo sapiens
KVVANGTGTQGQLKV

SEQ ID NO: 49452 - protein, 20 aa, Homo sapiens
SLDPSRPVTFVSNSNYAADK

SEQ ID NO: 49453 - protein, 13 aa, Homo sapiens
SLLEQYHLGLDQK

SEQ ID NO: 49454 - protein, 8 aa, Homo sapiens
WLGANAFR

SEQ ID NO: 49455 - protein, 14 aa, Homo sapiens
DISTTLNADEAVAR

SEQ ID NO: 49456 - protein, 32 aa, Homo sapiens
EFSVTDAVPFPISLIWNHDSEDTEGVHEVFSR

SEQ ID NO: 49457 - protein, 16 aa, Homo sapiens
ELNNTCEPVVTQPKPK

SEQ ID NO: 49458 - protein, 12 aa, Homo sapiens
FICEQDHQNFLR

SEQ ID NO: 49459 - protein, 21 aa, Homo sapiens
GPFELEAFYSDPQGVPYPEAK

SEQ ID NO: 49460 - protein, 15 aa, Homo sapiens
IEVPLYSLLEQTHLK

SEQ ID NO: 49461 - protein, 18 aa, Homo sapiens
KNQQITHANNTVSNFKRF

SEQ ID NO: 49462 - protein, 19 aa, Homo sapiens
KPVTDCVISVPSFFTDAER

SEQ ID NO: 49463 - protein, 18 aa, Homo sapiens
LLTETEDWLYEEGEDQAK

SEQ ID NO: 49464 - protein, 10 aa, Homo sapiens
LVEHFCAEFK

SEQ ID NO: 49465 - protein, 17 aa, Homo sapiens
MNRSQFEELCAELLQKI

SEQ ID NO: 49466 - protein, 15 aa, Homo sapiens
NQQITHANNTVSNFK

SEQ ID NO: 49467 - protein, 22 aa, Homo sapiens
RGPFELEAFYSDPQGVPYPEAK

SEQ ID NO: 49468 - protein, 13 aa, Homo sapiens
SQFEELCAELLQK

SEQ ID NO: 49469 - protein, 17 aa, Homo sapiens
VNTHGIFTISTASMVEK

SEQ ID NO: 49470 - protein, 18 aa, Homo sapiens
VVNVELPIEANLVWQLGK

SEQ ID NO: 49471 - protein, 30 aa, Homo sapiens
KEIRVLEFRSPKENDSGVDVYYAVTFNGEA

SEQ ID NO: 49472 - protein, 11 aa, Homo sapiens
FYNMSLDVNRK

SEQ ID NO: 49473 - protein, 12 aa, Homo sapiens
KIGFLKPHENKT

SEQ ID NO: 49474 - protein, 36 aa, Homo sapiens
KMNLTFHVINTGNSMAPNVSVEIMVPNSFSPQTDKL

SEQ ID NO: 49475 - protein, 25 aa, Homo sapiens
KTLMLNVSLFNAGDDAYETTLHVKL

SEQ ID NO: 49476 - protein, 18 aa, Homo sapiens
RFCAHENCSADLQVSAKI

SEQ ID NO: 49477 - protein, 23 aa, Homo sapiens
RFYFSSNGTSDVITGSIQVSSRE

SEQ ID NO: 49478 - protein, 21 aa, Homo sapiens
RTRPVVIVDASLSHPESVNRT

SEQ ID NO: 49479 - protein, 16 aa, Homo sapiens
WLANASVINPGAIYRC

SEQ ID NO: 49480 - protein, 21 aa, Homo sapiens
DLALSEGDIHTLGCGVAQCLK

SEQ ID NO: 49481 - protein, 13 aa, Homo sapiens
EPVGTCFLQDGTK

SEQ ID NO: 49482 - protein, 30 aa, Homo sapiens
FGSAIAPLGDLDQDGFNDIAIAAPYGGEDK

SEQ ID NO: 49483 - protein, 18 aa, Homo sapiens
GVSSPDHIFLPIPNWEHK

SEQ ID NO: 49484 - protein, 11 aa, Homo sapiens
ILACAPLYHWR

SEQ ID NO: 49485 - protein, 14 aa, Homo sapiens
ILLDCGEDNVCKPK

SEQ ID NO: 49486 - protein, 18 aa, Homo sapiens
KANTTQPGIVEGGQVLKC

SEQ ID NO: 49487 - protein, 21 aa, Homo sapiens
KISSLQTTEKNDTVAGQGERD

SEQ ID NO: 49488 - protein, 15 aa, Homo sapiens
NGYPDLIVGAFGVDR

SEQ ID NO: 49489 - protein, 17 aa, Homo sapiens
QAHILLDCGEDNVCKPK

SEQ ID NO: 49490 - protein, 24 aa, Homo sapiens
RTAADTTGLQPILNQFTPANISRQ

SEQ ID NO: 49491 - protein, 17 aa, Homo sapiens
RMCQAGNATVKQSRYRI

SEQ ID NO: 49492 - protein, 14 aa, Homo sapiens
FAEWCLEYGEHGCR

SEQ ID NO: 49493 - protein, 13 aa, Homo sapiens
IDPHAPNEMLYGR

SEQ ID NO: 49494 - protein, 22 aa, Homo sapiens
IPQSHIQQICETILTSGENLAR

SEQ ID NO: 49495 - protein, 16 aa, Homo sapiens
LHSLVKPSVDYVCQLK

SEQ ID NO: 49496 - protein, 9 aa, Homo sapiens
LHLGFIEIR

SEQ ID NO: 49497 - protein, 16 aa, Homo sapiens
SHLLNCCPHDVLSGTR

SEQ ID NO: 49498 - protein, 16 aa, Homo sapiens
VCEVCSAYLGLHDNDR

SEQ ID NO: 49499 - protein, 7 aa, Homo sapiens
VHDLALR

SEQ ID NO: 49500 - protein, 22 aa, Homo sapiens
KGELITYNLTELIKPEAYEVRL

SEQ ID NO: 49501 - protein, 24 aa, Homo sapiens
ELEAIFGRPVVDGEEGEPHSISPR

SEQ ID NO: 49502 - protein, 11 aa, Homo sapiens
LIHLEIKPAIR

SEQ ID NO: 49503 - protein, 19 aa, Homo sapiens
PAMAIFELLDYIVNEPPPK

SEQ ID NO: 49504 - protein, 14 aa, Homo sapiens
SEVEEVDFAGWLCK

SEQ ID NO: 49505 - protein, 12 aa, Homo sapiens
RSANLTDQPSWN

SEQ ID NO: 49506 - protein, 8 aa, Homo sapiens
ALVATPGK

SEQ ID NO: 49507 - protein, 18 aa, Homo sapiens
DSKKERDARTLLAKNLPY

SEQ ID NO: 49508 - protein, 14 aa, Homo sapiens
FGYVDFESAEDLEK

SEQ ID NO: 49509 - protein, 14 aa, Homo sapiens
GFGFVDFNSEEDAK

SEQ ID NO: 49510 - protein, 10 aa, Homo sapiens
GGFGGRGGFR

SEQ ID NO: 49511 - protein, 14 aa, Homo sapiens
GYAFIEFASFEDAK

SEQ ID NO: 49512 - protein, 15 aa, Homo sapiens
KFGYVDFESAEDLEK

SEQ ID NO: 49513 - protein, 24 aa, Homo sapiens
KTLVLSNLSYSATEETLQEVFEKA

SEQ ID NO: 49514 - protein, 14 aa, Homo sapiens
KTVTPAKAVTTPGK

SEQ ID NO: 49515 - protein, 9 aa, Homo sapiens
KVAVATPAK

SEQ ID NO: 49516 - protein, 8 aa, Homo sapiens
KVVVSPTK

SEQ ID NO: 49517 - protein, 23 aa, Homo sapiens
QKVEGTEPTTAFNLFVGNLNFNK

SEQ ID NO: 49518 - protein, 22 aa, Homo sapiens
TLVLSNLSYSATEETLQEVFEK

SEQ ID NO: 49519 - protein, 8 aa, Homo sapiens
VAVATPAK

SEQ ID NO: 49520 - protein, 21 aa, Homo sapiens
VEGTEPTTAFNLFVGNLNFNK

SEQ ID NO: 49521 - protein, 9 aa, Homo sapiens
VTLDWAKPK

SEQ ID NO: 49522 - protein, 17 aa, Homo sapiens
AYGLADPSTTGQMSGAR

SEQ ID NO: 49523 - protein, 12 aa, Homo sapiens
NTDATGLEEIDR

SEQ ID NO: 49524 - protein, 24 aa, Homo sapiens
ASLLIQQALTMFPGVLLPLLESCS

SEQ ID NO: 49525 - protein, 19 aa, Homo sapiens
FELINIDDLEDDPVVNGER

SEQ ID NO: 49526 - protein, 39 aa, Homo sapiens
VNNRFELINIDDLEDDPVVNGERSGCALTDAVAPGNKGR

SEQ ID NO: 49527 - protein, 16 aa, Homo sapiens
KINFENANLSALNLKI

SEQ ID NO: 49528 - protein, 32 aa, Homo sapiens
RDYKQTGDNLSSMLLENLTDNESENTNLKKKV

SEQ ID NO: 49529 - protein, 11 aa, Homo sapiens
AKNTGVSVGQK

SEQ ID NO: 49530 - protein, 21 aa, Homo sapiens
DQSGEYECSALNDVAAPDVRK

SEQ ID NO: 49531 - protein, 11 aa, Homo sapiens
ITVNYPPYISK

SEQ ID NO: 49532 - protein, 14 aa, Homo sapiens
RMSTLTFFNVSEKD

SEQ ID NO: 49533 - protein, 15 aa, Homo sapiens
STILYAGNDKWSIDP

SEQ ID NO: 49534 - protein, 22 aa, Homo sapiens
KEKPPNENCNNNSPESSLLPRA

SEQ ID NO: 49535 - protein, 19 aa, Homo sapiens
AAVGRPLDKHEGALETLLR

SEQ ID NO: 49536 - protein, 18 aa, Homo sapiens
CKPEPELNAAIPSANPAK

SEQ ID NO: 49537 - protein, 8 aa, Homo sapiens
CSDIVFAR

SEQ ID NO: 49538 - protein, 14 aa, Homo sapiens
DAFDKGSLFGGSVK

SEQ ID NO: 49539 - protein, 8 aa, Homo sapiens
DLQQSIAR

SEQ ID NO: 49540 - protein, 9 aa, Homo sapiens
DNDFIYHDR

SEQ ID NO: 49541 - protein, 24 aa, Homo sapiens
DTIVLLCKPEPELNAAIPSANPAK

SEQ ID NO: 49542 - protein, 34 aa, Homo sapiens
EATTLANGVLASLNLPAAIEDVSGDTVPQSILTK

SEQ ID NO: 49543 - protein, 8 aa, Homo sapiens
EGLENDLK

SEQ ID NO: 49544 - protein, 8 aa, Homo sapiens
EILDESLR

SEQ ID NO: 49545 - protein, 8 aa, Homo sapiens
ELPELLQR

SEQ ID NO: 49546 - protein, 30 aa, Homo sapiens
EPSAPSIPTPAYQSSPAGGHAPTPPTPAPR

SEQ ID NO: 49547 - protein, 9 aa, Homo sapiens
ETVLSALSR

SEQ ID NO: 49548 - protein, 18 aa, Homo sapiens
FIQQTYPSGGEEQAQYCR

SEQ ID NO: 49549 - protein, 23 aa, Homo sapiens
FLTALAQDGVINEEALSVTELDR

SEQ ID NO: 49550 - protein, 11 aa, Homo sapiens
FYNELTEILVR

SEQ ID NO: 49551 - protein, 10 aa, Homo sapiens
HEGALETLLR

SEQ ID NO: 49552 - protein, 10 aa, Homo sapiens
KDNDFIYHDR

SEQ ID NO: 49553 - protein, 8 aa, Homo sapiens
KFGEEIAR

SEQ ID NO: 49554 - protein, 7 aa, Homo sapiens
KQEGLLK

SEQ ID NO: 49555 - protein, 9 aa, Homo sapiens
KTERDELLK

SEQ ID NO: 49556 - protein, 13 aa, Homo sapiens
KTSEVDLAKPLVK

SEQ ID NO: 49557 - protein, 10 aa, Homo sapiens
LALASLGYEK

SEQ ID NO: 49558 - protein, 14 aa, Homo sapiens
LANQAADYFGDAFK

SEQ ID NO: 49559 - protein, 13 aa, Homo sapiens
LLDEEEATDNDLR

SEQ ID NO: 49560 - protein, 9 aa, Homo sapiens
LQHAAELIK

SEQ ID NO: 49561 - protein, 8 aa, Homo sapiens
MKDAIIAK

SEQ ID NO: 49562 - protein, 16 aa, Homo sapiens
MVPVSVQQSLAAYNQR

SEQ ID NO: 49563 - protein, 11 aa, Homo sapiens
NIQVSHQEFSK

SEQ ID NO: 49564 - protein, 17 aa, Homo sapiens
NLATAYDNFVELVANLK

SEQ ID NO: 49565 - protein, 10 aa, Homo sapiens
NREILDESLR

SEQ ID NO: 49566 - protein, 14 aa, Homo sapiens
QSNNEANLREEVLK

SEQ ID NO: 49567 - protein, 11 aa, Homo sapiens
SLLSNLDEVKK

SEQ ID NO: 49568 - protein, 11 aa, Homo sapiens
STPVNVPISQK

SEQ ID NO: 49569 - protein, 16 aa, Homo sapiens
SVIEQGGIQTVDQLIK

SEQ ID NO: 49570 - protein, 9 aa, Homo sapiens
SVNFDMTSK

SEQ ID NO: 49571 - protein, 12 aa, Homo sapiens
TMQGSEVVNVLK

SEQ ID NO: 49572 - protein, 11 aa, Homo sapiens
TPSNELYKPLR

SEQ ID NO: 49573 - protein, 12 aa, Homo sapiens
TSEVDLAKPLVK

SEQ ID NO: 49574 - protein, 12 aa, Homo sapiens
VPDLKDLDPIGK

SEQ ID NO: 49575 - protein, 8 aa, Homo sapiens
YDEYVNVK

SEQ ID NO: 49576 - protein, 13 aa, Homo sapiens
YDEYVNVKDFSDK

SEQ ID NO: 49577 - protein, 13 aa, Homo sapiens
LTRYLNWIGVPTK

SEQ ID NO: 49578 - protein, 14 aa, Homo sapiens
IVGPEENLSQAEAR

SEQ ID NO: 49579 - protein, 13 aa, Homo sapiens
GAATPKPVPEPEK

SEQ ID NO: 49580 - protein, 13 aa, Homo sapiens
GFGPPATNQFTTK

SEQ ID NO: 49581 - protein, 24 aa, Homo sapiens
ITNLSPYTNVSVKLILMNPEGRKE

SEQ ID NO: 49582 - protein, 8 aa, Homo sapiens
IYFQAASR

SEQ ID NO: 49583 - protein, 19 aa, Homo sapiens
KAVSSFDPEIDLSNQSGRV

SEQ ID NO: 49584 - protein, 21 aa, Homo sapiens
KVNNGPLGNPIWNISGDPTRT

SEQ ID NO: 49585 - protein, 33 aa, Homo sapiens
SVSSPSSFTMKTNTLSTSVPNSYYPDETHTMAS

SEQ ID NO: 49586 - protein, 14 aa, Homo sapiens
TYNGYWNTPLLPYK

SEQ ID NO: 49587 - protein, 21 aa, Homo sapiens
KQAALDPFILLNLLPNSTDKY

SEQ ID NO: 49588 - protein, 13 aa, Homo sapiens
KTVEINLTNDYRV

SEQ ID NO: 49589 - protein, 14 aa, Homo sapiens
RESFLQTNYTEIRV

SEQ ID NO: 49590 - protein, 14 aa, Homo sapiens
AILPDGEVVGDSEK

SEQ ID NO: 49591 - protein, 15 aa, Homo sapiens
ALSFPVESDVAPIAR

SEQ ID NO: 49592 - protein, 12 aa, Homo sapiens
ASPAFLASQNTK

SEQ ID NO: 49593 - protein, 27 aa, Homo sapiens
AVDQSVLLMKPEAELSVSSVYNLLTVK

SEQ ID NO: 49594 - protein, 11 aa, Homo sapiens
AVGYLITGYQR

SEQ ID NO: 49595 - protein, 9 aa, Homo sapiens
CVYLQTSMK

SEQ ID NO: 49596 - protein, 12 aa, Homo sapiens
DLFHCVSFTLPR

SEQ ID NO: 49597 - protein, 9 aa, Homo sapiens
EDNLVHWER

SEQ ID NO: 49598 - protein, 12 aa, Homo sapiens
EEGTDLEVTANR

SEQ ID NO: 49599 - protein, 10 aa, Homo sapiens
FAQVLLVDGK

SEQ ID NO: 49600 - protein, 10 aa, Homo sapiens
FEIENCLANK

SEQ ID NO: 49601 - protein, 23 aa, Homo sapiens
FIHNGAIYVPLSSNEADIYSFLK

SEQ ID NO: 49602 - protein, 13 aa, Homo sapiens
FSINTTSISVNKL

SEQ ID NO: 49603 - protein, 25 aa, Homo sapiens
GCVLLSHLNETVTVSASLESGRENR

SEQ ID NO: 49604 - protein, 12 aa, Homo sapiens
GEESYCICGSER

SEQ ID NO: 49605 - protein, 7 aa, Homo sapiens
GEVFTLK

SEQ ID NO: 49606 - protein, 7 aa, Homo sapiens
GPTQDFR

SEQ ID NO: 49607 - protein, 18 aa, Homo sapiens
GSFALSFPVESDVAPIAR

SEQ ID NO: 49608 - protein, 12 aa, Homo sapiens
HQDGSYSTFGER

SEQ ID NO: 49609 - protein, 8 aa, Homo sapiens
IAQWQSLK

SEQ ID NO: 49610 - protein, 8 aa, Homo sapiens
IISIMDEK

SEQ ID NO: 49611 - protein, 14 aa, Homo sapiens
IQHPFTVEEFVLPK

SEQ ID NO: 49612 - protein, 18 aa, Homo sapiens
IQHPFTVEEFVLPKFEVK

SEQ ID NO: 49613 - protein, 14 aa, Homo sapiens
IREEGTDLEVTANR

SEQ ID NO: 49614 - protein, 15 aa, Homo sapiens
ISASSEVAFLSIQIK

SEQ ID NO: 49615 - protein, 10 aa, Homo sapiens
ISEITNIVSK

SEQ ID NO: 49616 - protein, 23 aa, Homo sapiens
KGCVLLSHLNETVTVSASLESGR

SEQ ID NO: 49617 - protein, 24 aa, Homo sapiens
KGCVLLSHLNETVTVSASLESGRE

SEQ ID NO: 49618 - protein, 27 aa, Homo sapiens
KGCVLLSHLNETVTVSASLESGRENRS

SEQ ID NO: 49619 - protein, 22 aa, Homo sapiens
KTFSSMTCASGANVSEQLSLKL

SEQ ID NO: 49620 - protein, 22 aa, Homo sapiens
LEAGINQLSFPLSSEPIQGSYR

SEQ ID NO: 49621 - protein, 11 aa, Homo sapiens
LKFVKVDSHFR

SEQ ID NO: 49622 - protein, 7 aa, Homo sapiens
LPSNVVK

SEQ ID NO: 49623 - protein, 20 aa, Homo sapiens
LTAQPAPTSGDLTSATNIVK

SEQ ID NO: 49624 - protein, 18 aa, Homo sapiens
MFIFAILPDGEVVGDSEK

SEQ ID NO: 49625 - protein, 12 aa, Homo sapiens
MLQITNTGFEMK

SEQ ID NO: 49626 - protein, 17 aa, Homo sapiens
MVLQDIPVGDLKPAIVK

SEQ ID NO: 49627 - protein, 14 aa, Homo sapiens
NALFCLESAWNVAK

SEQ ID NO: 49628 - protein, 13 aa, Homo sapiens
NELIPLIYLENPR

SEQ ID NO: 49629 - protein, 15 aa, Homo sapiens
NYLNETQQLTQEIKA

SEQ ID NO: 49630 - protein, 12 aa, Homo sapiens
PVPGLATVSLCR

SEQ ID NO: 49631 - protein, 28 aa, Homo sapiens
PYVPQLGTYNVIPLNNEQSSGPVPETVR

SEQ ID NO: 49632 - protein, 24 aa, Homo sapiens
QEVCEEFSQQLNSNGCITQQVHTK

SEQ ID NO: 49633 - protein, 15 aa, Homo sapiens
QGIPFFAQVLLVDGK

SEQ ID NO: 49634 - protein, 22 aa, Homo sapiens
QGIPFFAQVLLVDGKGVPIPNK

SEQ ID NO: 49635 - protein, 23 aa, Homo sapiens
QQNAQGGFSSTQDTVVALHALSR

SEQ ID NO: 49636 - protein, 10 aa, Homo sapiens
QTLSWTVTPK

SEQ ID NO: 49637 - protein, 43 aa, Homo sapiens
RTEVSNNHVLIYVEQVTNQTLSFSFMVLQDIPVGDLKPAIVKV

SEQ ID NO: 49638 - protein, 27 aa, Homo sapiens
SCSVIPSVSAGAVGQGYYGAGLGVVER

SEQ ID NO: 49639 - protein, 14 aa, Homo sapiens
SFPLSSEPIQGSYR

SEQ ID NO: 49640 - protein, 14 aa, Homo sapiens
SGTHTLPVESGDMK

SEQ ID NO: 49641 - protein, 10 aa, Homo sapiens
SLFTDLVAEK

SEQ ID NO: 49642 - protein, 12 aa, Homo sapiens
SSNEADIYSFLK

SEQ ID NO: 49643 - protein, 22 aa, Homo sapiens
SYIFIDEAHITQSLTWLSQMQK

SEQ ID NO: 49644 - protein, 12 aa, Homo sapiens
TAQVTVQDSQTF

SEQ ID NO: 49645 - protein, 19 aa, Homo sapiens
TEPQYMVLVPSLLHTEAPK

SEQ ID NO: 49646 - protein, 20 aa, Homo sapiens
TFSSMTCASGANVSEQLSLK

SEQ ID NO: 49647 - protein, 13 aa, Homo sapiens
TLLVEAEGIEQEK

SEQ ID NO: 49648 - protein, 17 aa, Homo sapiens
VDLSFSPAQSPPASHAH

SEQ ID NO: 49649 - protein, 27 aa, Homo sapiens
VDLSFSPAQSPPASHAHLQVAAAPQSL

SEQ ID NO: 49650 - protein, 31 aa, Homo sapiens
VDLSFSPAQSPPASHAHLQVAAAPQSLCALR

SEQ ID NO: 49651 - protein, 12 aa, Homo sapiens
VQTVPQTCDGHK

SEQ ID NO: 49652 - protein, 6 aa, Homo sapiens
VSVQLK

SEQ ID NO: 49653 - protein, 10 aa, Homo sapiens
VVVQTESGGR

SEQ ID NO: 49654 - protein, 13 aa, Homo sapiens
YLNETQQLTQEIK

SEQ ID NO: 49655 - protein, 15 aa, Homo sapiens
YNILPEKEDSPFALK

SEQ ID NO: 49656 - protein, 11 aa, Homo sapiens
AQIWDTAGQER

SEQ ID NO: 49657 - protein, 9 aa, Homo sapiens
DDEYDYLFK

SEQ ID NO: 49658 - protein, 15 aa, Homo sapiens
DHADSNIVIMLVGNK

SEQ ID NO: 49659 - protein, 13 aa, Homo sapiens
GAVGALLVYDIAK

SEQ ID NO: 49660 - protein, 12 aa, Homo sapiens
GTRDDEYDYLFK

SEQ ID NO: 49661 - protein, 9 aa, Homo sapiens
HLTYENVER

SEQ ID NO: 49662 - protein, 29 aa, Homo sapiens
NGLSFIETSALDSTNVEAAFQTILTEIYR

SEQ ID NO: 49663 - protein, 11 aa, Homo sapiens
VVLIGDSGVGK

SEQ ID NO: 49664 - protein, 21 aa, Homo sapiens
NNLSFIETSALDSTNVEEAFK

SEQ ID NO: 49665 - protein, 17 aa, Homo sapiens
AENPQCLLGDFVTEFFK

SEQ ID NO: 49666 - protein, 18 aa, Homo sapiens
FVSCLLEQPEVLVTGAGR

SEQ ID NO: 49667 - protein, 13 aa, Homo sapiens
HLLPCVIHAAVLK

SEQ ID NO: 49668 - protein, 18 aa, Homo sapiens
KAENPQCLLGDFVTEFFK

SEQ ID NO: 49669 - protein, 18 aa, Homo sapiens
KLEEIIHQITNVEALIAR

SEQ ID NO: 49670 - protein, 17 aa, Homo sapiens
KVPNQYTHLSGLLDIFK

SEQ ID NO: 49671 - protein, 13 aa, Homo sapiens
LFIGGLNTETNEK

SEQ ID NO: 49672 - protein, 13 aa, Homo sapiens
VEQATKPSFESGR

SEQ ID NO: 49673 - protein, 30 aa, Homo sapiens
MNNSESHFVPNSLIGMGVLSCVFNSLAGKI

SEQ ID NO: 49674 - protein, 34 aa, Homo sapiens
RDNLSETASTMALAGASITGSLSGSAMVNCFNRL

SEQ ID NO: 49675 - protein, 13 aa, Homo sapiens
RKKGNMKINETRE

SEQ ID NO: 49676 - protein, 11 aa, Homo sapiens
DLEEFFSTVGK

SEQ ID NO: 49677 - protein, 14 aa, Homo sapiens
GYGFITFSDSECAK

SEQ ID NO: 49678 - protein, 17 aa, Homo sapiens
TDASSASSFLDSDELER

SEQ ID NO: 49679 - protein, 9 aa, Homo sapiens
AASAISVAR

SEQ ID NO: 49680 - protein, 23 aa, Homo sapiens
AFSPFSIASLLTQVLLGAGENTK

SEQ ID NO: 49681 - protein, 10 aa, Homo sapiens
AIMEKLEMSK

SEQ ID NO: 49682 - protein, 20 aa, Homo sapiens
AIMEKLEMSKFQPTLLTLPR

SEQ ID NO: 49683 - protein, 23 aa, Homo sapiens
AKVGQLQLSHNLSLVILVPQNLK

SEQ ID NO: 49684 - protein, 12 aa, Homo sapiens
ANLELINTWVAK

SEQ ID NO: 49685 - protein, 21 aa, Homo sapiens
ASSNPNATSSSSQDPESLQDR

SEQ ID NO: 49686 - protein, 23 aa, Homo sapiens
CSDLESHSTEAVLGDALVDFSLK

SEQ ID NO: 49687 - protein, 10 aa, Homo sapiens
DFTCVHQALK

SEQ ID NO: 49688 - protein, 15 aa, Homo sapiens
DFTCVHQALKGFTTK

SEQ ID NO: 49689 - protein, 8 aa, Homo sapiens
DTFVNASR

SEQ ID NO: 49690 - protein, 19 aa, Homo sapiens
ELTETGVEAAAASAISVAR

SEQ ID NO: 49691 - protein, 17 aa, Homo sapiens
FHSPDLAIRDTFVNASR

SEQ ID NO: 49692 - protein, 7 aa, Homo sapiens
FPVFMGR

SEQ ID NO: 49693 - protein, 10 aa, Homo sapiens
FQPTLLTLPR

SEQ ID NO: 49694 - protein, 22 aa, Homo sapiens
GFTTKGVTSVSQIFHSPDLAIR

SEQ ID NO: 49695 - protein, 17 aa, Homo sapiens
GVTSVSQIFHSPDLAIR

SEQ ID NO: 49696 - protein, 25 aa, Homo sapiens
GVTSVSQIFHSPDLAIRDTFVNASR

SEQ ID NO: 49697 - protein, 16 aa, Homo sapiens
HRLEDMEQALSPSVFK

SEQ ID NO: 49698 - protein, 15 aa, Homo sapiens
IKVTTSQDMLSIMEK

SEQ ID NO: 49699 - protein, 27 aa, Homo sapiens
KMLFVEPILEVSSLPTTNSTTNSATKI

SEQ ID NO: 49700 - protein, 11 aa, Homo sapiens
KVETNMAFSPF

SEQ ID NO: 49701 - protein, 29 aa, Homo sapiens
KVETNMAFSPFSIASLLTQVLLGAGENTK

SEQ ID NO: 49702 - protein, 23 aa, Homo sapiens
KVGQLQLSHNLSLVILVPQNLKH

SEQ ID NO: 49703 - protein, 13 aa, Homo sapiens
KYPVAHFIDQTLK

SEQ ID NO: 49704 - protein, 15 aa, Homo sapiens
KYPVAHFIDQTLKAK

SEQ ID NO: 49705 - protein, 12 aa, Homo sapiens
LAIRDTFVNASR

SEQ ID NO: 49706 - protein, 14 aa, Homo sapiens
LEDMEQALSPSVFK

SEQ ID NO: 49707 - protein, 11 aa, Homo sapiens
LEFFDFSYDLN

SEQ ID NO: 49708 - protein, 15 aa, Homo sapiens
LEMSKFQPTLLTLPR

SEQ ID NO: 49709 - protein, 10 aa, Homo sapiens
LLDSLPSDTR

SEQ ID NO: 49710 - protein, 22 aa, Homo sapiens
LLDSLPSDTRLVLLNAIYLSAK

SEQ ID NO: 49711 - protein, 14 aa, Homo sapiens
LLTQVLLGAGENTK

SEQ ID NO: 49712 - protein, 18 aa, Homo sapiens
LQLSHNLSLVILVPQNLK

SEQ ID NO: 49713 - protein, 13 aa, Homo sapiens
LTQVLLGAGENTK

SEQ ID NO: 49714 - protein, 12 aa, Homo sapiens
LVLLNAIYLSAK

SEQ ID NO: 49715 - protein, 9 aa, Homo sapiens
LYHAFSAMK

SEQ ID NO: 49716 - protein, 7 aa, Homo sapiens
MEPFHFK

SEQ ID NO: 49717 - protein, 11 aa, Homo sapiens
MLFVEPILEVS

SEQ ID NO: 49718 - protein, 25 aa, Homo sapiens
MLFVEPILEVSSLPTTNSTTNSATK

SEQ ID NO: 49719 - protein, 16 aa, Homo sapiens
NATSSSSQDPESLQDR

SEQ ID NO: 49720 - protein, 20 aa, Homo sapiens
NATSSSSQDPESLQDRGEGK

SEQ ID NO: 49721 - protein, 18 aa, Homo sapiens
NPNATSSSSQDPESLQDR

SEQ ID NO: 49722 - protein, 22 aa, Homo sapiens
NPNATSSSSQDPESLQDRGEGK

SEQ ID NO: 49723 - protein, 12 aa, Homo sapiens
NSVIKVPMMNSK

SEQ ID NO: 49724 - protein, 33 aa, Homo sapiens
PDLQVSAMQHQTVLELTETGVEAAAASAISVAR

SEQ ID NO: 49725 - protein, 20 aa, Homo sapiens
PFSIASLLTQVLLGAGENTK

SEQ ID NO: 49726 - protein, 17 aa, Homo sapiens
PNATSSSSQDPESLQDR

SEQ ID NO: 49727 - protein, 21 aa, Homo sapiens
PNATSSSSQDPESLQDRGEGK

SEQ ID NO: 49728 - protein, 17 aa, Homo sapiens
PSDTRLVLLNAIYLSAK

SEQ ID NO: 49729 - protein, 11 aa, Homo sapiens
PVAHFIDQTLK

SEQ ID NO: 49730 - protein, 13 aa, Homo sapiens
PVAHFIDQTLKAK

SEQ ID NO: 49731 - protein, 25 aa, Homo sapiens
QHQTVLELTETGVEAAAASAISVAR

SEQ ID NO: 49732 - protein, 23 aa, Homo sapiens
QTVLELTETGVEAAAASAISVAR

SEQ ID NO: 49733 - protein, 23 aa, Homo sapiens
RASSNPNATSSSSQDPESLQDRG

SEQ ID NO: 49734 - protein, 10 aa, Homo sapiens
RDTFVNASRT

SEQ ID NO: 49735 - protein, 28 aa, Homo sapiens
RTLYSSSPRVLSNNSDANLELINTWVAK

SEQ ID NO: 49736 - protein, 21 aa, Homo sapiens
RVLSNNSDANLELINTWVAKN

SEQ ID NO: 49737 - protein, 14 aa, Homo sapiens
SDANLELINTWVAK

SEQ ID NO: 49738 - protein, 22 aa, Homo sapiens
SDLESHSTEAVLGDALVDFSLK

SEQ ID NO: 49739 - protein, 15 aa, Homo sapiens
SHNLSLVILVPQNLK

SEQ ID NO: 49740 - protein, 18 aa, Homo sapiens
SIASLLTQVLLGAGENTK

SEQ ID NO: 49741 - protein, 17 aa, Homo sapiens
SNNSDANLELINTWVAK

SEQ ID NO: 49742 - protein, 21 aa, Homo sapiens
SPFSIASLLTQVLLGAGENTK

SEQ ID NO: 49743 - protein, 12 aa, Homo sapiens
SQIFHSPDLAIR

SEQ ID NO: 49744 - protein, 20 aa, Homo sapiens
SQIFHSPDLAIRDTFVNASR

SEQ ID NO: 49745 - protein, 13 aa, Homo sapiens
SSSSQDPESLQDR

SEQ ID NO: 49746 - protein, 16 aa, Homo sapiens
STEAVLGDALVDFSLK

SEQ ID NO: 49747 - protein, 14 aa, Homo sapiens
SVSQIFHSPDLAIR

SEQ ID NO: 49748 - protein, 22 aa, Homo sapiens
SVSQIFHSPDLAIRDTFVNASR

SEQ ID NO: 49749 - protein, 11 aa, Homo sapiens
TLLVFEVQQPF

SEQ ID NO: 49750 - protein, 13 aa, Homo sapiens
TLLVFEVQQPFLF

SEQ ID NO: 49751 - protein, 21 aa, Homo sapiens
TLLVFEVQQPFLFVLWDQQHK

SEQ ID NO: 49752 - protein, 28 aa, Homo sapiens
TLLVFEVQQPFLFVLWDQQHKFPVFMGR

SEQ ID NO: 49753 - protein, 8 aa, Homo sapiens
TLYSSSPR

SEQ ID NO: 49754 - protein, 11 aa, Homo sapiens
TNLESILSYPK

SEQ ID NO: 49755 - protein, 21 aa, Homo sapiens
TNLESILSYPKDFTCVHQALK

SEQ ID NO: 49756 - protein, 12 aa, Homo sapiens
TQVLLGAGENTK

SEQ ID NO: 49757 - protein, 9 aa, Homo sapiens
TRMEPFHFK

SEQ ID NO: 49758 - protein, 14 aa, Homo sapiens
TSSSSQDPESLQDR

SEQ ID NO: 49759 - protein, 15 aa, Homo sapiens
TSVSQIFHSPDLAIR

SEQ ID NO: 49760 - protein, 23 aa, Homo sapiens
TSVSQIFHSPDLAIRDTFVNASR

SEQ ID NO: 49761 - protein, 6 aa, Homo sapiens
TTFDPK

SEQ ID NO: 49762 - protein, 7 aa, Homo sapiens
TTFDPKK

SEQ ID NO: 49763 - protein, 22 aa, Homo sapiens
TVLELTETGVEAAAASAISVAR

SEQ ID NO: 49764 - protein, 10 aa, Homo sapiens
VETNMAFSPF

SEQ ID NO: 49765 - protein, 28 aa, Homo sapiens
VETNMAFSPFSIASLLTQVLLGAGENTK

SEQ ID NO: 49766 - protein, 8 aa, Homo sapiens
VGQLQLSH

SEQ ID NO: 49767 - protein, 11 aa, Homo sapiens
VGQLQLSHNLS

SEQ ID NO: 49768 - protein, 13 aa, Homo sapiens
VGQLQLSHNLSLV

SEQ ID NO: 49769 - protein, 21 aa, Homo sapiens
VGQLQLSHNLSLVILVPQNLK

SEQ ID NO: 49770 - protein, 21 aa, Homo sapiens
VLELTETGVEAAAASAISVAR

SEQ ID NO: 49771 - protein, 10 aa, Homo sapiens
VLLGAGENTK

SEQ ID NO: 49772 - protein, 16 aa, Homo sapiens
VLSNNSDANLELINTW

SEQ ID NO: 49773 - protein, 19 aa, Homo sapiens
VLSNNSDANLELINTWVAK

SEQ ID NO: 49774 - protein, 7 aa, Homo sapiens
VPMMNSK

SEQ ID NO: 49775 - protein, 13 aa, Homo sapiens
VSQIFHSPDLAIR

SEQ ID NO: 49776 - protein, 13 aa, Homo sapiens
VTTSQDMLSIMEK

SEQ ID NO: 49777 - protein, 12 aa, Homo sapiens
YPVAHFIDQTLK

SEQ ID NO: 49778 - protein, 14 aa, Homo sapiens
YPVAHFIDQTLKAK

SEQ ID NO: 49779 - protein, 23 aa, Homo sapiens
ASKPLPPAPAPDEYLVSPITGEK

SEQ ID NO: 49780 - protein, 24 aa, Homo sapiens
EPPPEFEFIADPPSISAFDLDVVK

SEQ ID NO: 49781 - protein, 9 aa, Homo sapiens
EVLDQVCYR

SEQ ID NO: 49782 - protein, 15 aa, Homo sapiens
FNFLNPNDPYHAYYR

SEQ ID NO: 49783 - protein, 11 aa, Homo sapiens
IHEATGMPAGK

SEQ ID NO: 49784 - protein, 19 aa, Homo sapiens
NYQFDFLRPQHSLFNYFTK

SEQ ID NO: 49785 - protein, 19 aa, Homo sapiens
PAGPVQAVPPPPPVPTEPK

SEQ ID NO: 49786 - protein, 20 aa, Homo sapiens
TQQAAQANITLQEQIEAIHK

SEQ ID NO: 49787 - protein, 16 aa, Homo sapiens
VMQQQQQTTQQQLPQK

SEQ ID NO: 49788 - protein, 9 aa, Homo sapiens
DAEDAVYGR

SEQ ID NO: 49789 - protein, 12 aa, Homo sapiens
EAGDVCYADVYR

SEQ ID NO: 49790 - protein, 23 aa, Homo sapiens
GGPPFAFVEFEDPRDAEDAVYGR

SEQ ID NO: 49791 - protein, 18 aa, Homo sapiens
AESLIGVYPEQGDCVISK

SEQ ID NO: 49792 - protein, 19 aa, Homo sapiens
ALQYACGNALVCDNVEDAR

SEQ ID NO: 49793 - protein, 9 aa, Homo sapiens
HLALNLQEK

SEQ ID NO: 49794 - protein, 23 aa, Homo sapiens
LGPENPEEPYLDGINYNCVAPGK

SEQ ID NO: 49795 - protein, 20 aa, Homo sapiens
EQANAVSEAVVSSVNTVATK

SEQ ID NO: 49796 - protein, 17 aa, Homo sapiens
KEDLRPSAPQQEGVASK

SEQ ID NO: 49797 - protein, 15 aa, Homo sapiens
TKENVVQSVTSVAEK

SEQ ID NO: 49798 - protein, 32 aa, Homo sapiens
RAAAQVLGSSGLFNNHGLQVQQQQQRNLSLHE

SEQ ID NO: 49799 - protein, 32 aa, Homo sapiens
KILRQLSNPGLVIAVILVMVLAIYYLNATAKG

SEQ ID NO: 49800 - protein, 20 aa, Homo sapiens
KNIGDDGGGDDNTFNFSWKV

SEQ ID NO: 49801 - protein, 20 aa, Homo sapiens
KGTNVSAPDQLSLALAWNRV

SEQ ID NO: 49802 - protein, 24 aa, Homo sapiens
RFVRLGTASMLTSPDGPFINLSRL

SEQ ID NO: 49803 - protein, 35 aa, Homo sapiens
QLEDILSTYCVDNNQGGPGEDGAQGEPAEPEDAEK

SEQ ID NO: 49804 - protein, 28 aa, Homo sapiens
VTEAPCYPGAPSTEASGQTGPQEPTSAR

SEQ ID NO: 49805 - protein, 34 aa, Homo sapiens
MNGTMSQVQGSANDPIFLLHHAFVDSIFEQWLRR

SEQ ID NO: 49806 - protein, 18 aa, Homo sapiens
KINMNGINNSSGMVDARS

SEQ ID NO: 49807 - protein, 26 aa, Homo sapiens
CFYNLELGDMSLSDNASMCLMSIIKK

SEQ ID NO: 49808 - protein, 20 aa, Homo sapiens
EHFGTFFECLQESLLDLHTK

SEQ ID NO: 49809 - protein, 22 aa, Homo sapiens
FLAGTQPEEIQIFLDLLFEPVR

SEQ ID NO: 49810 - protein, 20 aa, Homo sapiens
GNIAEDTEVDILVTVQNLLK

SEQ ID NO: 49811 - protein, 30 aa, Homo sapiens
GNLFVLCQAVNTLLSLEESSELLHLVPVER

SEQ ID NO: 49812 - protein, 14 aa, Homo sapiens
HCVDPTSFLKPIAK

SEQ ID NO: 49813 - protein, 17 aa, Homo sapiens
LLCTVFETLSDFESGLK

SEQ ID NO: 49814 - protein, 13 aa, Homo sapiens
SISLASCHQLHSK

SEQ ID NO: 49815 - protein, 28 aa, Homo sapiens
SQTESIQQDYTTILSCLIQTFPNQLEFK

SEQ ID NO: 49816 - protein, 18 aa, Homo sapiens
SETQPCTPSSSDYSDLQR

SEQ ID NO: 49817 - protein, 25 aa, Homo sapiens
SSSSVTTSETQPCTPSSSDYSDLQR

SEQ ID NO: 49818 - protein, 14 aa, Homo sapiens
VKEEIIEAFVQELR

SEQ ID NO: 49819 - protein, 11 aa, Homo sapiens
VKQELLEEVKK

SEQ ID NO: 49820 - protein, 13 aa, Homo sapiens
VQIYHNPTANSFR

SEQ ID NO: 49821 - protein, 11 aa, Homo sapiens
APEPPPALIVR

SEQ ID NO: 49822 - protein, 21 aa, Homo sapiens
STDSSSYPSPCASPSPPSSGK

SEQ ID NO: 49823 - protein, 26 aa, Homo sapiens
TVLNVTDEYDLLDDGGDAVFSQLTEK

SEQ ID NO: 49824 - protein, 24 aa, Homo sapiens
KEGKENTRITNLTVNTGLDCSEKT

SEQ ID NO: 49825 - protein, 16 aa, Homo sapiens
RMTRNKANTMANQSKQ

SEQ ID NO: 49826 - protein, 14 aa, Homo sapiens
GEGGSCYHFAMSGK

SEQ ID NO: 49827 - protein, 22 aa, Homo sapiens
KKEIYMHTGNSSTPRGEGGSCY

SEQ ID NO: 49828 - protein, 17 aa, Homo sapiens
LVCGPNAIEVEIQPIWK

SEQ ID NO: 49829 - protein, 9 aa, Homo sapiens
IEEILDYLR

SEQ ID NO: 49830 - protein, 9 aa, Homo sapiens
LENSLLDHR

SEQ ID NO: 49831 - protein, 8 aa, Homo sapiens
QSPINLQR

SEQ ID NO: 49832 - protein, 14 aa, Homo sapiens
TTLTGLDVQDMLPR

SEQ ID NO: 49833 - protein, 6 aa, Homo sapiens
YNPSLK

SEQ ID NO: 49834 - protein, 23 aa, Homo sapiens
AFSAVDTDGNGTINAQELGAALK

SEQ ID NO: 49835 - protein, 11 aa, Homo sapiens
AGLEDLQVAFR

SEQ ID NO: 49836 - protein, 19 aa, Homo sapiens
AMAGLGQPLPQEELDAMIR

SEQ ID NO: 49837 - protein, 11 aa, Homo sapiens
ALHFAISEYNK

SEQ ID NO: 49838 - protein, 18 aa, Homo sapiens
IIPGGIYNADLNDEWVQR

SEQ ID NO: 49839 - protein, 15 aa, Homo sapiens
QLCSFEIYEVPWENR

SEQ ID NO: 49840 - protein, 8 aa, Homo sapiens
ATEDEYYR

SEQ ID NO: 49841 - protein, 18 aa, Homo sapiens
IIPGGIYDADLNDEWVQR

SEQ ID NO: 49842 - protein, 7 aa, Homo sapiens
MSLVNSR

SEQ ID NO: 49843 - protein, 7 aa, Homo sapiens
RPLQVLR

SEQ ID NO: 49844 - protein, 29 aa, Homo sapiens
RTLQQLYEAYASKSNNTAYLIYNDGVPKP

SEQ ID NO: 49845 - protein, 34 aa, Homo sapiens
RGLNIALVNGTTGAVLGQKAFDMYSGDVMHLVKF

SEQ ID NO: 49846 - protein, 12 aa, Homo sapiens
IQEPNTFPAILR

SEQ ID NO: 49847 - protein, 18 aa, Homo sapiens
KTPMTNSSIQFLDNAFRK

SEQ ID NO: 49848 - protein, 21 aa, Homo sapiens
KYPHNHHVVNNTLEGNCSSKS

SEQ ID NO: 49849 - protein, 13 aa, Homo sapiens
KYYNYTLSINGKA

SEQ ID NO: 49850 - protein, 9 aa, Homo sapiens
NFNIHGTNK

SEQ ID NO: 49851 - protein, 10 aa, Homo sapiens
RGASNLTWRS

SEQ ID NO: 49852 - protein, 13 aa, Homo sapiens
RKHGENYSVDYLT

SEQ ID NO: 49853 - protein, 24 aa, Homo sapiens
RPNVVLLLTDDQDEVLGGMTPLKK

SEQ ID NO: 49854 - protein, 12 aa, Homo sapiens
SDVLVEYQGEGR

SEQ ID NO: 49855 - protein, 12 aa, Homo sapiens
SMCGYQTFFAGK

SEQ ID NO: 49856 - protein, 9 aa, Homo sapiens
TIDPELLGK

SEQ ID NO: 49857 - protein, 10 aa, Homo sapiens
TPGVFDPGYR

SEQ ID NO: 49858 - protein, 13 aa, Homo sapiens
TQMDGMSLLPILR

SEQ ID NO: 49859 - protein, 13 aa, Homo sapiens
WQTLLSVDDLVEK

SEQ ID NO: 49860 - protein, 22 aa, Homo sapiens
ANLLEIAPHLSAPLPIMLPVYK

SEQ ID NO: 49861 - protein, 15 aa, Homo sapiens
LAFLNVQAAEEALPR

SEQ ID NO: 49862 - protein, 16 aa, Homo sapiens
LVGAIVYYDGQHNDAR

SEQ ID NO: 49863 - protein, 22 aa, Homo sapiens
LVQDYGLESEVAQHLAATYGDK

SEQ ID NO: 49864 - protein, 12 aa, Homo sapiens
LYDLVAGSNCLK

SEQ ID NO: 49865 - protein, 18 aa, Homo sapiens
NGQVELNEFLQLMSAIQK

SEQ ID NO: 49866 - protein, 21 aa, Homo sapiens
VLESINVQMDENTLHEILNEV

SEQ ID NO: 49867 - protein, 25 aa, Homo sapiens
VLESINVQMDENTLHEILNEVDLNK

SEQ ID NO: 49868 - protein, 7 aa, Homo sapiens
AAVEFNK

SEQ ID NO: 49869 - protein, 14 aa, Homo sapiens
DEHLQQYQEVCAQR

SEQ ID NO: 49870 - protein, 11 aa, Homo sapiens
KIMNQVFQSLR

SEQ ID NO: 49871 - protein, 6 aa, Homo sapiens
KNLSER

SEQ ID NO: 49872 - protein, 24 aa, Homo sapiens
KQNEQHIKELEKNKSQMSGVEAAA

SEQ ID NO: 49873 - protein, 14 aa, Homo sapiens
NQRYVEQSNLMMEK

SEQ ID NO: 49874 - protein, 26 aa, Homo sapiens
PPEPLGPVSMDSECEESLAASPMAAK

SEQ ID NO: 49875 - protein, 16 aa, Homo sapiens
QEKCLALQAQITALTK

SEQ ID NO: 49876 - protein, 22 aa, Homo sapiens
RTKSNSLSEQLAINTSPDAVKA

SEQ ID NO: 49877 - protein, 20 aa, Homo sapiens
TKSNSLSEQLAINTSPDAVK

SEQ ID NO: 49878 - protein, 21 aa, Homo sapiens
LGALGGNTQEVTLQPGEYITK

SEQ ID NO: 49879 - protein, 8 aa, Homo sapiens
LGDSWDVK

SEQ ID NO: 49880 - protein, 10 aa, Homo sapiens
VFVAFQAFLR

SEQ ID NO: 49881 - protein, 9 aa, Homo sapiens
VSVGLLLVK

SEQ ID NO: 49882 - protein, 16 aa, Homo sapiens
YFSTTEDYDHEITGLR

SEQ ID NO: 49883 - protein, 18 aa, Homo sapiens
KISLDNLSEDGAQLLYKT

SEQ ID NO: 49884 - protein, 8 aa, Homo sapiens
LEEQNGSK

SEQ ID NO: 49885 - protein, 10 aa, Homo sapiens
SEPFFPNIDF

SEQ ID NO: 49886 - protein, 35 aa, Homo sapiens
KEVDIEGTTVIEVGLDPSNNMTLAVDCVGILKLRN

SEQ ID NO: 49887 - protein, 16 aa, Homo sapiens
KGNSKAGNGTLENQKG

SEQ ID NO: 49888 - protein, 26 aa, Homo sapiens
ANLTNFPENGTFVVNIAQLSQDDSGR

SEQ ID NO: 49889 - protein, 18 aa, Homo sapiens
FAEEKAVADTRDQADGSR

SEQ ID NO: 49890 - protein, 15 aa, Homo sapiens
IDSSGYVNPNYTGRI

SEQ ID NO: 49891 - protein, 9 aa, Homo sapiens
IIEGEPNLK

SEQ ID NO: 49892 - protein, 20 aa, Homo sapiens
ILLNPQDKDGSFSVVITGLR

SEQ ID NO: 49893 - protein, 16 aa, Homo sapiens
KVPGNVTAVLGETLKV

SEQ ID NO: 49894 - protein, 20 aa, Homo sapiens
KWNNTGCQALPSQDEGPSKA

SEQ ID NO: 49895 - protein, 20 aa, Homo sapiens
LSDAGQYLCQAGDDSNSNKK

SEQ ID NO: 49896 - protein, 22 aa, Homo sapiens
LSLLEEPGNGTFTVILNQLTSR

SEQ ID NO: 49897 - protein, 11 aa, Homo sapiens
LVSLTLNLVTR

SEQ ID NO: 49898 - protein, 19 aa, Homo sapiens
NADLQVLKPEPELVYEDLR

SEQ ID NO: 49899 - protein, 28 aa, Homo sapiens
RANLTNFPENGTFVVNIAQLSQDDSGRY

SEQ ID NO: 49900 - protein, 8 aa, Homo sapiens
RAPAFEGR

SEQ ID NO: 49901 - protein, 24 aa, Homo sapiens
RLSLLEEPGNGTFTVILNQLTSRD

SEQ ID NO: 49902 - protein, 14 aa, Homo sapiens
VPGNVTAVLGETLK

SEQ ID NO: 49903 - protein, 8 aa, Homo sapiens
VYTVDLGR

SEQ ID NO: 49904 - protein, 18 aa, Homo sapiens
WNNTGCQALPSQDEGPSK

SEQ ID NO: 49905 - protein, 32 aa, Homo sapiens
YLCGAHSDGQLQEGSPIQAWQLFVNEESTIPR

SEQ ID NO: 49906 - protein, 13 aa, Homo sapiens
YLCQAGDDSNSNK

SEQ ID NO: 49907 - protein, 15 aa, Homo sapiens
ELGICPDDAAVIPIK

SEQ ID NO: 49908 - protein, 18 aa, Homo sapiens
ELGICPDDAAVIPIKNNR

SEQ ID NO: 49909 - protein, 8 aa, Homo sapiens
FYTIEILK

SEQ ID NO: 49910 - protein, 10 aa, Homo sapiens
FYTIEILKVE

SEQ ID NO: 49911 - protein, 10 aa, Homo sapiens
IIIKNFDIPK

SEQ ID NO: 49912 - protein, 11 aa, Homo sapiens
KIIIKNFDIPK

SEQ ID NO: 49913 - protein, 19 aa, Homo sapiens
SVRPNDEVTAVLAVQTELK

SEQ ID NO: 49914 - protein, 25 aa, Homo sapiens
SVRPNDEVTAVLAVQTELKECMVVK

SEQ ID NO: 49915 - protein, 10 aa, Homo sapiens
TFYWDFYTNR

SEQ ID NO: 49916 - protein, 12 aa, Homo sapiens
TVQIAAVVDVIR

SEQ ID NO: 49917 - protein, 16 aa, Homo sapiens
TYLISSIPLQGAFNYK

SEQ ID NO: 49918 - protein, 11 aa, Homo sapiens
YTACLCDDNPK

SEQ ID NO: 49919 - protein, 13 aa, Homo sapiens
APPGKPQGPPQQE

SEQ ID NO: 49920 - protein, 18 aa, Homo sapiens
APPGKPQGPPQQEGNNPQ

SEQ ID NO: 49921 - protein, 12 aa, Homo sapiens
SPPGKPQGPPPQ

SEQ ID NO: 49922 - protein, 18 aa, Homo sapiens
SPPGKPQGPPPQGGNQPQ

SEQ ID NO: 49923 - protein, 28 aa, Homo sapiens
SPPGKPQGPPPQGGNQPQGPPPPPGKPQ

SEQ ID NO: 49924 - protein, 25 aa, Homo sapiens
MNQNTTEPVAATETLAEVPEHVLRG

SEQ ID NO: 49925 - protein, 8 aa, Homo sapiens
AIHSWLTR

SEQ ID NO: 49926 - protein, 20 aa, Homo sapiens
FEGGVVIAADMLGSYGSLAR

SEQ ID NO: 49927 - protein, 9 aa, Homo sapiens
FQIATVTEK

SEQ ID NO: 49928 - protein, 24 aa, Homo sapiens
GVEIEGPLSTETNWDIAHMISGFE

SEQ ID NO: 49929 - protein, 23 aa, Homo sapiens
MRVNNSTMLGASGDYADFQYLKQ

SEQ ID NO: 49930 - protein, 10 aa, Homo sapiens
QPVLSQTEAR

SEQ ID NO: 49931 - protein, 22 aa, Homo sapiens
QVLGQMVIDEELLGDGHSYSPR

SEQ ID NO: 49932 - protein, 15 aa, Homo sapiens
TQNPMVTGTSVLGVK

SEQ ID NO: 49933 - protein, 20 aa, Homo sapiens
VNNSTMLGASGDYADFQYLK

SEQ ID NO: 49934 - protein, 30 aa, Homo sapiens
AFEDDDITHVEGSVDPIRDIEIIHEELQLK

SEQ ID NO: 49935 - protein, 17 aa, Homo sapiens
AFLSHISACDGIFHLTR

SEQ ID NO: 49936 - protein, 13 aa, Homo sapiens
FDFLCQYHKPASK

SEQ ID NO: 49937 - protein, 15 aa, Homo sapiens
FYHDWNDKEIEVLNK

SEQ ID NO: 49938 - protein, 27 aa, Homo sapiens
GAHNGQGLGNAFLSHISACDGIFHLTR

SEQ ID NO: 49939 - protein, 15 aa, Homo sapiens
IPAFLNVVDIAGLVK

SEQ ID NO: 49940 - protein, 12 aa, Homo sapiens
ISACDGIFHLTR

SEQ ID NO: 49941 - protein, 14 aa, Homo sapiens
KGGDGIKPPPIIGR

SEQ ID NO: 49942 - protein, 15 aa, Homo sapiens
LSHISACDGIFHLTR

SEQ ID NO: 49943 - protein, 13 aa, Homo sapiens
NYIVEDGDIIFFK

SEQ ID NO: 49944 - protein, 28 aa, Homo sapiens
STFFNVLTNSQASAENFPFCTIDPNESR

SEQ ID NO: 49945 - protein, 37 aa, Homo sapiens
AHSSPASLQLGAVSPGTLTPTGVVSGPAATPTAQHLR

SEQ ID NO: 49946 - protein, 17 aa, Homo sapiens
DESTDSGLSMSSYSVPR

SEQ ID NO: 49947 - protein, 13 aa, Homo sapiens
KLPDSFFKPPEPK

SEQ ID NO: 49948 - protein, 23 aa, Homo sapiens
NHTNMGNLAVLSQGNTSSSRRKT

SEQ ID NO: 49949 - protein, 14 aa, Homo sapiens
CTTDHISAAGPWLK

SEQ ID NO: 49950 - protein, 25 aa, Homo sapiens
DHLVPDPGCHYDQLIEINLSELKPH

SEQ ID NO: 49951 - protein, 16 aa, Homo sapiens
DINQEVYNFLATAGAK

SEQ ID NO: 49952 - protein, 20 aa, Homo sapiens
DLGGIVLANACGPCIGQWDR

SEQ ID NO: 49953 - protein, 15 aa, Homo sapiens
FNPETDYLTGTDGKK

SEQ ID NO: 49954 - protein, 21 aa, Homo sapiens
GHLDNISNNLLIGAINIENGK

SEQ ID NO: 49955 - protein, 24 aa, Homo sapiens
HPNGTQETILLNHTFNETQIEWFR

SEQ ID NO: 49956 - protein, 16 aa, Homo sapiens
ISNNLLIGAINIENGK

SEQ ID NO: 49957 - protein, 16 aa, Homo sapiens
IVYGHLDDPASQEIER

SEQ ID NO: 49958 - protein, 13 aa, Homo sapiens
LQLLEPFDKWDGK

SEQ ID NO: 49959 - protein, 23 aa, Homo sapiens
LQLLEPFDKWDGKDLEDLQILIK

SEQ ID NO: 49960 - protein, 27 aa, Homo sapiens
NDANPETHAFVTSPEIVTALAIAGTLK

SEQ ID NO: 49961 - protein, 18 aa, Homo sapiens
PSTIHCDHLIEAQVGGEK

SEQ ID NO: 49962 - protein, 16 aa, Homo sapiens
TIHCDHLIEAQVGGEK

SEQ ID NO: 49963 - protein, 19 aa, Homo sapiens
VAMSHFEPNEYIHYDLLEK

SEQ ID NO: 49964 - protein, 21 aa, Homo sapiens
VAVPSTIHCDHLIEAQVGGEK

SEQ ID NO: 49965 - protein, 15 aa, Homo sapiens
WVVIGDENYGEGSSR

SEQ ID NO: 49966 - protein, 9 aa, Homo sapiens
GYFTHHHQR

SEQ ID NO: 49967 - protein, 15 aa, Homo sapiens
HLLGPDYTETLYSPR

SEQ ID NO: 49968 - protein, 24 aa, Homo sapiens
KEHAVFTSNQEEQDPANHTCGVKS

SEQ ID NO: 49969 - protein, 12 aa, Homo sapiens
KNYNENLTLIRS

SEQ ID NO: 49970 - protein, 22 aa, Homo sapiens
YEPEVQYQMILNGEEIILSLQK

SEQ ID NO: 49971 - protein, 26 aa, Homo sapiens
RGQGTASSGNVSDLAQTVKTFDNLKT

SEQ ID NO: 49972 - protein, 9 aa, Homo sapiens
DQIIFMVGR

SEQ ID NO: 49973 - protein, 21 aa, Homo sapiens
TQHCDPEHFPFPAPANAPLQR

SEQ ID NO: 49974 - protein, 6 aa, Homo sapiens
FCLPYR

SEQ ID NO: 49975 - protein, 13 aa, Homo sapiens
FCLPYRMDVEKGK

SEQ ID NO: 49976 - protein, 36 aa, Homo sapiens
RRFIPPARMMSTESANSFTLIGEASDGGTMENLSRR

SEQ ID NO: 49977 - protein, 29 aa, Homo sapiens
KSSSTPFPFRTGLTSGNVTENLQTYIDKS

SEQ ID NO: 49978 - protein, 24 aa, Homo sapiens
KASAKGGNLPPVSPNDSGAKIASN

SEQ ID NO: 49979 - protein, 15 aa, Homo sapiens
DGAPQVCPIPPEQSK

SEQ ID NO: 49980 - protein, 9 aa, Homo sapiens
EASHVLEVK

SEQ ID NO: 49981 - protein, 12 aa, Homo sapiens
ELLEEMEILKKK

SEQ ID NO: 49982 - protein, 10 aa, Homo sapiens
ERAMLFDENK

SEQ ID NO: 49983 - protein, 19 aa, Homo sapiens
IRPLNSEGTLNLLNCEPPR

SEQ ID NO: 49984 - protein, 24 aa, Homo sapiens
LPDFQDSIFEYFNTAPLAHDLTFR

SEQ ID NO: 49985 - protein, 16 aa, Homo sapiens
LQESTQTVQSLHGSSR

SEQ ID NO: 49986 - protein, 27 aa, Homo sapiens
NLEAPYIPDVSSPSDTSNFDVDDDVLR

SEQ ID NO: 49987 - protein, 12 aa, Homo sapiens
DNRDNTAGVYAR

SEQ ID NO: 49988 - protein, 14 aa, Homo sapiens
VHAKDPDAANSPIR

SEQ ID NO: 49989 - protein, 16 aa, Homo sapiens
DGVPGLVGVPGRPGVR

SEQ ID NO: 49990 - protein, 12 aa, Homo sapiens
FIQVGVVQYSDY

SEQ ID NO: 49991 - protein, 26 aa, Homo sapiens
KGAPGMPGLMGSNGSPGQPGTPGSKG

SEQ ID NO: 49992 - protein, 21 aa, Homo sapiens
GAHGMPGKPGPMGPLGIPGSS

SEQ ID NO: 49993 - protein, 15 aa, Homo sapiens
SPDNKPVWYGLDMNR

SEQ ID NO: 49994 - protein, 16 aa, Homo sapiens
TQGPPGATGFPGSAGR

SEQ ID NO: 49995 - protein, 12 aa, Homo sapiens
LQEEIDAVLPNK

SEQ ID NO: 49996 - protein, 11 aa, Homo sapiens
MKESRLKDKQK

SEQ ID NO: 49997 - protein, 19 aa, Homo sapiens
VCKKDIEINGVFIPKGLAV

SEQ ID NO: 49998 - protein, 7 aa, Homo sapiens
YWTEPEK

SEQ ID NO: 49999 - protein, 14 aa, Homo sapiens
KELLLNTSEVTVRF

SEQ ID NO: 50000 - protein, 26 aa, Homo sapiens
ASRRMLDDEMTVSLSLPSDSSMFNNN

SEQ ID NO: 50001 - protein, 17 aa, Homo sapiens
DFALDVSANQPVLVAVK

SEQ ID NO: 50002 - protein, 23 aa, Homo sapiens
ELNQLEDKYDKDYLSGELGDNLK

SEQ ID NO: 50003 - protein, 13 aa, Homo sapiens
GFMTNGADIDECK

SEQ ID NO: 50004 - protein, 20 aa, Homo sapiens
KAWGTPCEMCPAVNTSEYKI

SEQ ID NO: 50005 - protein, 19 aa, Homo sapiens
KKPVAGTYSLQISSTPLYK

SEQ ID NO: 50006 - protein, 27 aa, Homo sapiens
KTNDDQTMCLDINECERDACGNGTCRN

SEQ ID NO: 50007 - protein, 23 aa, Homo sapiens
RCDSGFALDSEERNCTDIDECRI

SEQ ID NO: 50008 - protein, 21 aa, Homo sapiens
RNYYADNQTCDGELLFNMTKK

SEQ ID NO: 50009 - protein, 20 aa, Homo sapiens
RSGGNCTDVNECLDPTTCIS

SEQ ID NO: 50010 - protein, 16 aa, Homo sapiens
RVLPVNVTDYCQLVRY

SEQ ID NO: 50011 - protein, 27 aa, Homo sapiens
KEKVENGSETGPLPPELQPLLEGEVKG

SEQ ID NO: 50012 - protein, 9 aa, Homo sapiens
AVTKYTSSK

SEQ ID NO: 50013 - protein, 13 aa, Homo sapiens
GIMNSFVNDIFER

SEQ ID NO: 50014 - protein, 16 aa, Homo sapiens
HAVSEGTKAVTKYTSS

SEQ ID NO: 50015 - protein, 17 aa, Homo sapiens
HAVSEGTKAVTKYTSSK

SEQ ID NO: 50016 - protein, 10 aa, Homo sapiens
KESYSIYVYK

SEQ ID NO: 50017 - protein, 26 aa, Homo sapiens
LLLPGELAKHAVSEGTKAVTKYTSSK

SEQ ID NO: 50018 - protein, 11 aa, Homo sapiens
MNSFVNDIFER

SEQ ID NO: 50019 - protein, 15 aa, Homo sapiens
PEPAKSAPAPKKGSK

SEQ ID NO: 50020 - protein, 11 aa, Homo sapiens
QVHPDTGISSK

SEQ ID NO: 50021 - protein, 10 aa, Homo sapiens
RLLLPGELAK

SEQ ID NO: 50022 - protein, 13 aa, Homo sapiens
STITSREIQTAVR

SEQ ID NO: 50023 - protein, 22 aa, Homo sapiens
STITSREIQTAVRLLLPGELAK

SEQ ID NO: 50024 - protein, 14 aa, Homo sapiens
VLKQVHPDTGISSK

SEQ ID NO: 50025 - protein, 18 aa, Homo sapiens
KFNQNSNSTYCVFMVNKP

SEQ ID NO: 50026 - protein, 25 aa, Homo sapiens
FLDYLSDLCVSNHIAIPVTQELICK

SEQ ID NO: 50027 - protein, 24 aa, Homo sapiens
GDLPDPIGTGLDPDWSAIAATQCR

SEQ ID NO: 50028 - protein, 24 aa, Homo sapiens
ILQDKLNSTMKLVSHLTAQLNELK

SEQ ID NO: 50029 - protein, 12 aa, Homo sapiens
LFENFTLDMARV

SEQ ID NO: 50030 - protein, 26 aa, Homo sapiens
VILNPVNAGQPLHASNYELSDNAGCK

SEQ ID NO: 50031 - protein, 25 aa, Homo sapiens
YCLVAVPHGNDIASLFELDPTTLQK

SEQ ID NO: 50032 - protein, 16 aa, Homo sapiens
IFKNATFTFTWAFQRT

SEQ ID NO: 50033 - protein, 33 aa, Homo sapiens
AVGNIVTGDDIQTQVILNCSALQSLLHLLSSPK

SEQ ID NO: 50034 - protein, 15 aa, Homo sapiens
IEFLQSHENQEIYQK

SEQ ID NO: 50035 - protein, 20 aa, Homo sapiens
NGTGINPYCALIEEAYGLDK

SEQ ID NO: 50036 - protein, 21 aa, Homo sapiens
YLVELGCIKPLCDLLTVMDSK

SEQ ID NO: 50037 - protein, 9 aa, Homo sapiens
AQYEDIANR

SEQ ID NO: 50038 - protein, 9 aa, Homo sapiens
DVDEAYMNK

SEQ ID NO: 50039 - protein, 16 aa, Homo sapiens
LEAELGNMQGLVEDFK

SEQ ID NO: 50040 - protein, 12 aa, Homo sapiens
LEGLTDEINFLR

SEQ ID NO: 50041 - protein, 18 aa, Homo sapiens
LKLEAELGNMQGLVEDFK

SEQ ID NO: 50042 - protein, 16 aa, Homo sapiens
LSPLVLEVDPNIQAVR

SEQ ID NO: 50043 - protein, 15 aa, Homo sapiens
SNMDNMFESYINNLR

SEQ ID NO: 50044 - protein, 11 aa, Homo sapiens
TEMENEFVLIK

SEQ ID NO: 50045 - protein, 10 aa, Homo sapiens
YEELQSLAGK

SEQ ID NO: 50046 - protein, 17 aa, Homo sapiens
RGYYNQSEDGSHTIQRM

SEQ ID NO: 50047 - protein, 37 aa, Homo sapiens
ADKASDTSSETVFGKRGHVLGNGSQVTQAANSGCSKA

SEQ ID NO: 50048 - protein, 10 aa, Homo sapiens
LQQLATLIQK

SEQ ID NO: 50049 - protein, 16 aa, Homo sapiens
VADEFQASGIPASGIR

SEQ ID NO: 50050 - protein, 9 aa, Homo sapiens
YMDIEFDFK

SEQ ID NO: 50051 - protein, 11 aa, Homo sapiens
EYVQLISVYEK

SEQ ID NO: 50052 - protein, 11 aa, Homo sapiens
GFSYLYGAWGR

SEQ ID NO: 50053 - protein, 13 aa, Homo sapiens
GLYWVAPLNTDGR

SEQ ID NO: 50054 - protein, 18 aa, Homo sapiens
GTCQCSVSLPDTTFPVDR

SEQ ID NO: 50055 - protein, 17 aa, Homo sapiens
KLNDTTLQVLNTWYTKQ

SEQ ID NO: 50056 - protein, 11 aa, Homo sapiens
LEFTAHVLSQK

SEQ ID NO: 50057 - protein, 13 aa, Homo sapiens
LETLDKNNVLAIR

SEQ ID NO: 50058 - protein, 24 aa, Homo sapiens
RVNLTTNTIAVTQTLPNAAYNNRF

SEQ ID NO: 50059 - protein, 14 aa, Homo sapiens
TEEIFYYYDTNTGK

SEQ ID NO: 50060 - protein, 12 aa, Homo sapiens
VQSINYNPFDQK

SEQ ID NO: 50061 - protein, 18 aa, Homo sapiens
FHGLYEEKNLSPGFNFRF

SEQ ID NO: 50062 - protein, 10 aa, Homo sapiens
ILTNATLDRE

SEQ ID NO: 50063 - protein, 23 aa, Homo sapiens
MTRDQNGTWEMESNENFEGYMKA

SEQ ID NO: 50064 - protein, 14 aa, Homo sapiens
AYGSPCYALFLSPK

SEQ ID NO: 50065 - protein, 18 aa, Homo sapiens
LVSVLSGAEGSFVSSLVR

SEQ ID NO: 50066 - protein, 16 aa, Homo sapiens
NPSTILNPGHCGSLSR

SEQ ID NO: 50067 - protein, 11 aa, Homo sapiens
SWMDADLACQK

SEQ ID NO: 50068 - protein, 30 aa, Homo sapiens
AQLNIGNVLPVGTMPEGTIVCCLEEKPGDR

SEQ ID NO: 50069 - protein, 16 aa, Homo sapiens
ASGNYATVISHNPETK

SEQ ID NO: 50070 - protein, 11 aa, Homo sapiens
AVVGVVAGGGR

SEQ ID NO: 50071 - protein, 16 aa, Homo sapiens
IAAEGIHTGQFVYCGK

SEQ ID NO: 50072 - protein, 31 aa, Homo sapiens
KAQLNIGNVLPVGTMPEGTIVCCLEEKPGDR

SEQ ID NO: 50073 - protein, 23 aa, Homo sapiens
KRTELFIAAEGIHTGQFVYCGKK

SEQ ID NO: 50074 - protein, 16 aa, Homo sapiens
PEGTIVCCLEEKPGDR

SEQ ID NO: 50075 - protein, 20 aa, Homo sapiens
TELFIAAEGIHTGQFVYCGK

SEQ ID NO: 50076 - protein, 11 aa, Homo sapiens
EIAVEYNTMGK

SEQ ID NO: 50077 - protein, 24 aa, Homo sapiens
KIAVDTAAGPYQNHTVVFLGSEKG

SEQ ID NO: 50078 - protein, 16 aa, Homo sapiens
MDTLEPFGDEFSGMAR

SEQ ID NO: 50079 - protein, 15 aa, Homo sapiens
MIMIMNGTLYIAARD

SEQ ID NO: 50080 - protein, 13 aa, Homo sapiens
SPDSTWTPVPDER

SEQ ID NO: 50081 - protein, 20 aa, Homo sapiens
KKNITYYDSMGGINNEACRI

SEQ ID NO: 50082 - protein, 15 aa, Homo sapiens
EFTGPTVSDTLYDVK

SEQ ID NO: 50083 - protein, 12 aa, Homo sapiens
ILGLTDSVTEVR

SEQ ID NO: 50084 - protein, 16 aa, Homo sapiens
FNETSLAFIVPHETKS

SEQ ID NO: 50085 - protein, 17 aa, Homo sapiens
RLNFTQSYSLQLSNLKM

SEQ ID NO: 50086 - protein, 36 aa, Homo sapiens
RNIQVTNHSQLFQNMTCELHLTCSVEDADDNVSFRW

SEQ ID NO: 50087 - protein, 23 aa, Homo sapiens
RWEALGNTLSSQPNLTVSWDPRI

SEQ ID NO: 50088 - protein, 7 aa, Homo sapiens
AGVCPPK

SEQ ID NO: 50089 - protein, 8 aa, Homo sapiens
AGVCPPKK

SEQ ID NO: 50090 - protein, 12 aa, Homo sapiens
CLDPVDTPNPTR

SEQ ID NO: 50091 - protein, 13 aa, Homo sapiens
CLDPVDTPNPTRR

SEQ ID NO: 50092 - protein, 24 aa, Homo sapiens
CPVTYGQCLMLNPPNFCEMDGQCK

SEQ ID NO: 50093 - protein, 13 aa, Homo sapiens
KPECQSDWQCPGK

SEQ ID NO: 50094 - protein, 7 aa, Homo sapiens
KSAQCLR

SEQ ID NO: 50095 - protein, 10 aa, Homo sapiens
RCCPDTCGIK

SEQ ID NO: 50096 - protein, 7 aa, Homo sapiens
SCVSPVK

SEQ ID NO: 50097 - protein, 8 aa, Homo sapiens
SCVSPVKA

SEQ ID NO: 50098 - protein, 15 aa, Homo sapiens
YKKPECQSDWQCPGK

SEQ ID NO: 50099 - protein, 16 aa, Homo sapiens
YKKPECQSDWQCPGKK

SEQ ID NO: 50100 - protein, 7 aa, Homo sapiens
IPFLECR

SEQ ID NO: 50101 - protein, 10 aa, Homo sapiens
NHFTVALNEK

SEQ ID NO: 50102 - protein, 17 aa, Homo sapiens
DLEEALEAGGCDLETLR

SEQ ID NO: 50103 - protein, 27 aa, Homo sapiens
FLENTPSSLNIEDIEDLFSLAQYYCSK

SEQ ID NO: 50104 - protein, 17 aa, Homo sapiens
LLIQYHEPELCSYLDTK

SEQ ID NO: 50105 - protein, 19 aa, Homo sapiens
RSSINSVDGESPNGSSDRG

SEQ ID NO: 50106 - protein, 26 aa, Homo sapiens
KTGEDEDEEDNDALLKENESPDVRRD

SEQ ID NO: 50107 - protein, 20 aa, Homo sapiens
AITTGLQEYVEAVSFQHFIK

SEQ ID NO: 50108 - protein, 18 aa, Homo sapiens
IFQVAQELSGEDMHQFHR

SEQ ID NO: 50109 - protein, 17 aa, Homo sapiens
ITSAPDMEDILTESEIK

SEQ ID NO: 50110 - protein, 19 aa, Homo sapiens
VTPVDYLLGVADLTGELMR

SEQ ID NO: 50111 - protein, 13 aa, Homo sapiens
AQLFALTGVQPAR

SEQ ID NO: 50112 - protein, 15 aa, Homo sapiens
ENQLQLSCFINQEVK

SEQ ID NO: 50113 - protein, 16 aa, Homo sapiens
FDDDKVSIVTPEDILR

SEQ ID NO: 50114 - protein, 18 aa, Homo sapiens
FPLMLDMYELCTPELQEK

SEQ ID NO: 50115 - protein, 13 aa, Homo sapiens
GGTLKDDDWGNIK

SEQ ID NO: 50116 - protein, 17 aa, Homo sapiens
GKENQLQLSCFINQEVK

SEQ ID NO: 50117 - protein, 18 aa, Homo sapiens
LSGGGDWHIAYVLLYGPR

SEQ ID NO: 50118 - protein, 12 aa, Homo sapiens
SSSSGHYVSWVK

SEQ ID NO: 50119 - protein, 29 aa, Homo sapiens
YEPFSFADDIGSNNCGYYDLQAVLTHQGR

SEQ ID NO: 50120 - protein, 23 aa, Homo sapiens
RRLSIGLDNGTISEFILSEDYNK

SEQ ID NO: 50121 - protein, 12 aa, Homo sapiens
KNTNSSNNFSRS

SEQ ID NO: 50122 - protein, 16 aa, Homo sapiens
KSDPHWESMLNATTRR

SEQ ID NO: 50123 - protein, 15 aa, Homo sapiens
RVLLELANVSTHIVA

SEQ ID NO: 50124 - protein, 20 aa, Homo sapiens
RYKPDTLAVAVENGTGTDRQ

SEQ ID NO: 50125 - protein, 9 aa, Homo sapiens
ATYIHNCLK

SEQ ID NO: 50126 - protein, 24 aa, Homo sapiens
QLGDNEAITQEIVGCAHLENYALK

SEQ ID NO: 50127 - protein, 15 aa, Homo sapiens
KRRPLNNNSEIALSL

SEQ ID NO: 50128 - protein, 6 aa, Homo sapiens
ALQEYR

SEQ ID NO: 50129 - protein, 7 aa, Homo sapiens
ALQEYRK

SEQ ID NO: 50130 - protein, 8 aa, Homo sapiens
AMDIHFHS

SEQ ID NO: 50131 - protein, 13 aa, Homo sapiens
ANLTQGEDQYYLR

SEQ ID NO: 50132 - protein, 19 aa, Homo sapiens
ASHTSDSDVPSGVTEVVVK

SEQ ID NO: 50133 - protein, 12 aa, Homo sapiens
ASSIIDELFQDR

SEQ ID NO: 50134 - protein, 18 aa, Homo sapiens
CREILSVDCSTNNPSQAK

SEQ ID NO: 50135 - protein, 18 aa, Homo sapiens
DIHFHSPAFQHPPTEFIR

SEQ ID NO: 50136 - protein, 23 aa, Homo sapiens
DQCDKCREILSVDCSTNNPSQAK

SEQ ID NO: 50137 - protein, 18 aa, Homo sapiens
DQTVSDNELQEMSNQGSK

SEQ ID NO: 50138 - protein, 22 aa, Homo sapiens
DQTVSDNELQEMSNQGSKYVNK

SEQ ID NO: 50139 - protein, 32 aa, Homo sapiens
DQTVSDNELQEMSNQGSKYVNKEIQNAVNGVK

SEQ ID NO: 50140 - protein, 8 aa, Homo sapiens
EDALNETR

SEQ ID NO: 50141 - protein, 13 aa, Homo sapiens
EDALNETRESETK

SEQ ID NO: 50142 - protein, 10 aa, Homo sapiens
EGDDDRTVCR

SEQ ID NO: 50143 - protein, 16 aa, Homo sapiens
EILSVDCSTNNPSQAK

SEQ ID NO: 50144 - protein, 18 aa, Homo sapiens
EILSVDCSTNNPSQAKLR

SEQ ID NO: 50145 - protein, 10 aa, Homo sapiens
EIQNAVNGVK

SEQ ID NO: 50146 - protein, 13 aa, Homo sapiens
EIQNAVNGVKQIK

SEQ ID NO: 50147 - protein, 11 aa, Homo sapiens
ELDESLQVAER

SEQ ID NO: 50148 - protein, 22 aa, Homo sapiens
ELPGVCNETMMALWEECKPCLK

SEQ ID NO: 50149 - protein, 24 aa, Homo sapiens
ELPGVCNETMMALWEECKPCLKQT

SEQ ID NO: 50150 - protein, 27 aa, Homo sapiens
ELPGVCNETMMALWEECKPCLKQTCMK

SEQ ID NO: 50151 - protein, 11 aa, Homo sapiens
EPQDTYHYLPF

SEQ ID NO: 50152 - protein, 16 aa, Homo sapiens
EPQDTYHYLPFSLPHR

SEQ ID NO: 50153 - protein, 12 aa, Homo sapiens
EQLNEQFNWVSR

SEQ ID NO: 50154 - protein, 12 aa, Homo sapiens
ETVAEKALQEYR

SEQ ID NO: 50155 - protein, 20 aa, Homo sapiens
FFTREPQDTYHYLPFSLPHR

SEQ ID NO: 50156 - protein, 15 aa, Homo sapiens
FHSPAFQHPPTEFIR

SEQ ID NO: 50157 - protein, 8 aa, Homo sapiens
FMETVAEK

SEQ ID NO: 50158 - protein, 13 aa, Homo sapiens
FMETVAEKALQEY

SEQ ID NO: 50159 - protein, 14 aa, Homo sapiens
FMETVAEKALQEYR

SEQ ID NO: 50160 - protein, 15 aa, Homo sapiens
FMETVAEKALQEYRK

SEQ ID NO: 50161 - protein, 16 aa, Homo sapiens
FMETVAEKALQEYRKK

SEQ ID NO: 50162 - protein, 20 aa, Homo sapiens
FMETVAEKALQEYRKKHREE

SEQ ID NO: 50163 - protein, 19 aa, Homo sapiens
GDQTVSDNELQEMSNQGSK

SEQ ID NO: 50164 - protein, 8 aa, Homo sapiens
HNSTGCLR

SEQ ID NO: 50165 - protein, 14 aa, Homo sapiens
HSPAFQHPPTEFIR

SEQ ID NO: 50166 - protein, 17 aa, Homo sapiens
HTSDSDVPSGVTEVVVK

SEQ ID NO: 50167 - protein, 9 aa, Homo sapiens
IDSLLENDR

SEQ ID NO: 50168 - protein, 24 aa, Homo sapiens
IDSLLENDRQQTHMLDVMQDHFSR

SEQ ID NO: 50169 - protein, 9 aa, Homo sapiens
KEDALNETR

SEQ ID NO: 50170 - protein, 10 aa, Homo sapiens
KEDALNETRE

SEQ ID NO: 50171 - protein, 24 aa, Homo sapiens
KELPGVCNETMMALWEECKPCLKQ

SEQ ID NO: 50172 - protein, 10 aa, Homo sapiens
KKEDALNETR

SEQ ID NO: 50173 - protein, 15 aa, Homo sapiens
KKEDALNETRESETK

SEQ ID NO: 50174 - protein, 11 aa, Homo sapiens
KKKEDALNETR

SEQ ID NO: 50175 - protein, 16 aa, Homo sapiens
KKKEDALNETRESETK

SEQ ID NO: 50176 - protein, 22 aa, Homo sapiens
KMLNTSSLLEQLNEQFNWVSRL

SEQ ID NO: 50177 - protein, 12 aa, Homo sapiens
KNPKFMETVAEK

SEQ ID NO: 50178 - protein, 18 aa, Homo sapiens
KNPKFMETVAEKALQEYR

SEQ ID NO: 50179 - protein, 11 aa, Homo sapiens
KTLLSNLEEAK

SEQ ID NO: 50180 - protein, 12 aa, Homo sapiens
KTLLSNLEEAKK

SEQ ID NO: 50181 - protein, 13 aa, Homo sapiens
KTLLSNLEEAKKK

SEQ ID NO: 50182 - protein, 7 aa, Homo sapiens
KYNELLK

SEQ ID NO: 50183 - protein, 12 aa, Homo sapiens
KYNELLKSYQWK

SEQ ID NO: 50184 - protein, 14 aa, Homo sapiens
LANLTQGEDQYYLR

SEQ ID NO: 50185 - protein, 13 aa, Homo sapiens
LEQLNEQFNWVSR

SEQ ID NO: 50186 - protein, 17 aa, Homo sapiens
LFDSDPITVTVPVEVSR

SEQ ID NO: 50187 - protein, 18 aa, Homo sapiens
LFDSDPITVTVPVEVSRK

SEQ ID NO: 50188 - protein, 21 aa, Homo sapiens
LFDSDPITVTVPVEVSRKNPK

SEQ ID NO: 50189 - protein, 21 aa, Homo sapiens
LKELPGVCNETMMALWEECKP

SEQ ID NO: 50190 - protein, 24 aa, Homo sapiens
LKELPGVCNETMMALWEECKPCLK

SEQ ID NO: 50191 - protein, 14 aa, Homo sapiens
LRRELDESLQVAER

SEQ ID NO: 50192 - protein, 11 aa, Homo sapiens
LTQGEDQYYLR

SEQ ID NO: 50193 - protein, 13 aa, Homo sapiens
METVAEKALQEYR

SEQ ID NO: 50194 - protein, 11 aa, Homo sapiens
MLDVMQDHFSR

SEQ ID NO: 50195 - protein, 20 aa, Homo sapiens
MLNTSSLLEQLNEQFNWVSR

SEQ ID NO: 50196 - protein, 9 aa, Homo sapiens
NEQFNWVSR

SEQ ID NO: 50197 - protein, 12 aa, Homo sapiens
NLTQGEDQYYLR

SEQ ID NO: 50198 - protein, 20 aa, Homo sapiens
PGVCNETMMALWEECKPCLK

SEQ ID NO: 50199 - protein, 12 aa, Homo sapiens
PITVTVPVEVSR

SEQ ID NO: 50200 - protein, 16 aa, Homo sapiens
PKFMETVAEKALQEYR

SEQ ID NO: 50201 - protein, 10 aa, Homo sapiens
PSGVTEVVVK

SEQ ID NO: 50202 - protein, 14 aa, Homo sapiens
QIKTLIEKTNEERK

SEQ ID NO: 50203 - protein, 20 aa, Homo sapiens
QLEEFLNQSSPFYFWMNGDR

SEQ ID NO: 50204 - protein, 29 aa, Homo sapiens
QLEEFLNQSSPFYFWMNGDRIDSLLENDR

SEQ ID NO: 50205 - protein, 15 aa, Homo sapiens
QQTHMLDVMQDHFSR

SEQ ID NO: 50206 - protein, 12 aa, Homo sapiens
RELDESLQVAER

SEQ ID NO: 50207 - protein, 10 aa, Homo sapiens
RHNSTGCLRM

SEQ ID NO: 50208 - protein, 15 aa, Homo sapiens
RLANLTQGEDQYYLR

SEQ ID NO: 50209 - protein, 16 aa, Homo sapiens
RLANLTQGEDQYYLRV

SEQ ID NO: 50210 - protein, 8 aa, Homo sapiens
RPHFFFPK

SEQ ID NO: 50211 - protein, 9 aa, Homo sapiens
RPHFFFPKS

SEQ ID NO: 50212 - protein, 22 aa, Homo sapiens
RQLEEFLNQSSPFYFWMNGDRI

SEQ ID NO: 50213 - protein, 28 aa, Homo sapiens
SDNELQEMSNQGSKYVNKEIQNAVNGVK

SEQ ID NO: 50214 - protein, 14 aa, Homo sapiens
SDPITVTVPVEVSR

SEQ ID NO: 50215 - protein, 8 aa, Homo sapiens
SGSGLVGR

SEQ ID NO: 50216 - protein, 18 aa, Homo sapiens
SHTSDSDVPSGVTEVVVK

SEQ ID NO: 50217 - protein, 10 aa, Homo sapiens
SIIDELFQDR

SEQ ID NO: 50218 - protein, 15 aa, Homo sapiens
SLLEQLNEQFNWVSR

SEQ ID NO: 50219 - protein, 14 aa, Homo sapiens
SLMPFSPYEPLNFH

SEQ ID NO: 50220 - protein, 13 aa, Homo sapiens
SPAFQHPPTEFIR

SEQ ID NO: 50221 - protein, 11 aa, Homo sapiens
SSIIDELFQDR

SEQ ID NO: 50222 - protein, 25 aa, Homo sapiens
SYQWKMLNTSSLLEQLNEQFNWVSR

SEQ ID NO: 50223 - protein, 10 aa, Homo sapiens
TLIEKTNEER

SEQ ID NO: 50224 - protein, 11 aa, Homo sapiens
TLIEKTNEERK

SEQ ID NO: 50225 - protein, 21 aa, Homo sapiens
TLIEKTNEERKTLLSNLEEAK

SEQ ID NO: 50226 - protein, 22 aa, Homo sapiens
TLIEKTNEERKTLLSNLEEAKK

SEQ ID NO: 50227 - protein, 23 aa, Homo sapiens
TLIEKTNEERKTLLSNLEEAKKK

SEQ ID NO: 50228 - protein, 24 aa, Homo sapiens
TLIEKTNEERKTLLSNLEEAKKKK

SEQ ID NO: 50229 - protein, 10 aa, Homo sapiens
TLLSNLEEAK

SEQ ID NO: 50230 - protein, 11 aa, Homo sapiens
TLLSNLEEAKK

SEQ ID NO: 50231 - protein, 12 aa, Homo sapiens
TLLSNLEEAKKK

SEQ ID NO: 50232 - protein, 13 aa, Homo sapiens
TLLSNLEEAKKKK

SEQ ID NO: 50233 - protein, 14 aa, Homo sapiens
TMMALWEECKPCLK

SEQ ID NO: 50234 - protein, 16 aa, Homo sapiens
TNEERKTLLSNLEEAK

SEQ ID NO: 50235 - protein, 17 aa, Homo sapiens
TNEERKTLLSNLEEAKK

SEQ ID NO: 50236 - protein, 16 aa, Homo sapiens
TSDSDVPSGVTEVVVK

SEQ ID NO: 50237 - protein, 17 aa, Homo sapiens
TSSLLEQLNEQFNWVSR

SEQ ID NO: 50238 - protein, 11 aa, Homo sapiens
VPSGVTEVVVK

SEQ ID NO: 50239 - protein, 23 aa, Homo sapiens
VTTVASHTSDSDVPSGVTEVVVK

SEQ ID NO: 50240 - protein, 9 aa, Homo sapiens
WEECKPCLK

SEQ ID NO: 50241 - protein, 6 aa, Homo sapiens
YNELLK

SEQ ID NO: 50242 - protein, 11 aa, Homo sapiens
YNELLKSYQWK

SEQ ID NO: 50243 - protein, 14 aa, Homo sapiens
YVNKEIQNAVNGVK

SEQ ID NO: 50244 - protein, 16 aa, Homo sapiens
YVNKEIQNAVNGVKQI

SEQ ID NO: 50245 - protein, 17 aa, Homo sapiens
YVNKEIQNAVNGVKQIK

SEQ ID NO: 50246 - protein, 24 aa, Homo sapiens
SWPCNSSDCIVVDTVMCPNMPNKS

SEQ ID NO: 50247 - protein, 30 aa, Homo sapiens
KLPSTSTLVNLTLGSLLDDQHWHSVLIQRL

SEQ ID NO: 50248 - protein, 12 aa, Homo sapiens
KQVNFTVDEHRH

SEQ ID NO: 50249 - protein, 17 aa, Homo sapiens
MGAAVTLKNLTGLNQRR

SEQ ID NO: 50250 - protein, 26 aa, Homo sapiens
RAMLAAIYNTTELVMMQDSSPDFEDT

SEQ ID NO: 50251 - protein, 19 aa, Homo sapiens
EDTVQSVKPWLTEIMNNYK

SEQ ID NO: 50252 - protein, 14 aa, Homo sapiens
ELSLVGPFPGLNMK

SEQ ID NO: 50253 - protein, 20 aa, Homo sapiens
FGLFVEHGPYVVTSNMTLRD

SEQ ID NO: 50254 - protein, 8 aa, Homo sapiens
FLSLPEVR

SEQ ID NO: 50255 - protein, 17 aa, Homo sapiens
GDSGQPLFLTPYIEAGK

SEQ ID NO: 50256 - protein, 13 aa, Homo sapiens
GGGHILPYDQPLR

SEQ ID NO: 50257 - protein, 29 aa, Homo sapiens
KLLDGDLTSDPSYFQNVTGCSNYYNFLRC

SEQ ID NO: 50258 - protein, 12 aa, Homo sapiens
KSYAGFLTVNKT

SEQ ID NO: 50259 - protein, 14 aa, Homo sapiens
NNDFYVTGESYAGK

SEQ ID NO: 50260 - protein, 12 aa, Homo sapiens
QNWFEAFEILDK

SEQ ID NO: 50261 - protein, 20 aa, Homo sapiens
RQAIHVGNQTFNDGTIVEKY

SEQ ID NO: 50262 - protein, 10 aa, Homo sapiens
SDSEVAGYIR

SEQ ID NO: 50263 - protein, 15 aa, Homo sapiens
SSMFGLFVEHGPYVV

SEQ ID NO: 50264 - protein, 16 aa, Homo sapiens
YVPAIAHLIHSLNPVR

SEQ ID NO: 50265 - protein, 14 aa, Homo sapiens
HELLSLASSNHLGK

SEQ ID NO: 50266 - protein, 12 aa, Homo sapiens
LFMAQALQEYNN

SEQ ID NO: 50267 - protein, 14 aa, Homo sapiens
NSHLINVLMWELEK

SEQ ID NO: 50268 - protein, 15 aa, Homo sapiens
QGSLSLKAYRLTPKL

SEQ ID NO: 50269 - protein, 20 aa, Homo sapiens
SAVADKHELLSLASSNHLGK

SEQ ID NO: 50270 - protein, 24 aa, Homo sapiens
ACETARTPRDKLAACLEGNCAEGL

SEQ ID NO: 50271 - protein, 19 aa, Homo sapiens
CLLYPPWDKNFTENDLLVR

SEQ ID NO: 50272 - protein, 12 aa, Homo sapiens
DGKYGFYTHVFR

SEQ ID NO: 50273 - protein, 6 aa, Homo sapiens
DIALMK

SEQ ID NO: 50274 - protein, 20 aa, Homo sapiens
DKLAACLEGNCAEGLGTNYR

SEQ ID NO: 50275 - protein, 27 aa, Homo sapiens
DKLAACLEGNCAEGLGTNYRGHVNITR

SEQ ID NO: 50276 - protein, 12 aa, Homo sapiens
DKNFTENDLLVR

SEQ ID NO: 50277 - protein, 10 aa, Homo sapiens
ELLESYIDGR

SEQ ID NO: 50278 - protein, 11 aa, Homo sapiens
ENLDRDIALMK

SEQ ID NO: 50279 - protein, 12 aa, Homo sapiens
ETAASLLQAGYK

SEQ ID NO: 50280 - protein, 9 aa, Homo sapiens
ETWTANVGK

SEQ ID NO: 50281 - protein, 15 aa, Homo sapiens
GDACEGDSGGPFVMK

SEQ ID NO: 50282 - protein, 21 aa, Homo sapiens
GDACEGDSGGPFVMKSPFNNR

SEQ ID NO: 50283 - protein, 8 aa, Homo sapiens
GFYTHVFR

SEQ ID NO: 50284 - protein, 16 aa, Homo sapiens
GQPSVLQVVNLPIVER

SEQ ID NO: 50285 - protein, 20 aa, Homo sapiens
GQPSVLQVVNLPIVERPVCK

SEQ ID NO: 50286 - protein, 15 aa, Homo sapiens
GSGEADCGLRPLFEK

SEQ ID NO: 50287 - protein, 16 aa, Homo sapiens
GSGEADCGLRPLFEKK

SEQ ID NO: 50288 - protein, 21 aa, Homo sapiens
HKPEINSTTHPGADLQENFCR

SEQ ID NO: 50289 - protein, 16 aa, Homo sapiens
HQDFNSAVQLVENFCR

SEQ ID NO: 50290 - protein, 12 aa, Homo sapiens
ISMLEKIYIHPR

SEQ ID NO: 50291 - protein, 11 aa, Homo sapiens
ITDNMFCAGYK

SEQ ID NO: 50292 - protein, 16 aa, Homo sapiens
ITDNMFCAGYKPDEGK

SEQ ID NO: 50293 - protein, 17 aa, Homo sapiens
ITDNMFCAGYKPDEGKR

SEQ ID NO: 50294 - protein, 20 aa, Homo sapiens
IVEGSDAEIGMSPWQVMLFR

SEQ ID NO: 50295 - protein, 6 aa, Homo sapiens
IYIHPR

SEQ ID NO: 50296 - protein, 19 aa, Homo sapiens
KLAACLEGNCAEGLGTNYR

SEQ ID NO: 50297 - protein, 12 aa, Homo sapiens
KNFTENDLLVRI

SEQ ID NO: 50298 - protein, 12 aa, Homo sapiens
KPVAFSDYIHPV

SEQ ID NO: 50299 - protein, 17 aa, Homo sapiens
KPVAFSDYIHPVCLPDR

SEQ ID NO: 50300 - protein, 29 aa, Homo sapiens
KPVAFSDYIHPVCLPDRETAASLLQAGYK

SEQ ID NO: 50301 - protein, 9 aa, Homo sapiens
KSLEDKTER

SEQ ID NO: 50302 - protein, 19 aa, Homo sapiens
KSLEDKTERELLESYIDGR

SEQ ID NO: 50303 - protein, 16 aa, Homo sapiens
KSPQELLCGASLISDR

SEQ ID NO: 50304 - protein, 18 aa, Homo sapiens
LAACLEGNCAEGLGTNYR

SEQ ID NO: 50305 - protein, 19 aa, Homo sapiens
LAVTTHGLPCLAWASAQAK

SEQ ID NO: 50306 - protein, 23 aa, Homo sapiens
LAVTTHGLPCLAWASAQAKALSK

SEQ ID NO: 50307 - protein, 9 aa, Homo sapiens
LAWASAQAK

SEQ ID NO: 50308 - protein, 19 aa, Homo sapiens
LKKPVAFSDYIHPVCLPDR

SEQ ID NO: 50309 - protein, 31 aa, Homo sapiens
LKKPVAFSDYIHPVCLPDRETAASLLQAGYK

SEQ ID NO: 50310 - protein, 24 aa, Homo sapiens
LTAAHCLLYPPWDKNFTENDLLVR

SEQ ID NO: 50311 - protein, 10 aa, Homo sapiens
NFTENDLLVR

SEQ ID NO: 50312 - protein, 10 aa, Homo sapiens
NIEKISMLEK

SEQ ID NO: 50313 - protein, 16 aa, Homo sapiens
NIEKISMLEKIYIHPR

SEQ ID NO: 50314 - protein, 16 aa, Homo sapiens
NPDGDEEGVWCYVAGK

SEQ ID NO: 50315 - protein, 19 aa, Homo sapiens
NPDSSTTGPWCYTTDPTVR

SEQ ID NO: 50316 - protein, 16 aa, Homo sapiens
NSTTHPGADLQENFCR

SEQ ID NO: 50317 - protein, 19 aa, Homo sapiens
PEINSTTHPGADLQENFCR

SEQ ID NO: 50318 - protein, 11 aa, Homo sapiens
PGADLQENFCR

SEQ ID NO: 50319 - protein, 30 aa, Homo sapiens
PGDFGYCDLNYCEEAVEEETGDGLDEDSDR

SEQ ID NO: 50320 - protein, 15 aa, Homo sapiens
PPWDKNFTENDLLVR

SEQ ID NO: 50321 - protein, 18 aa, Homo sapiens
PSVLQVVNLPIVERPVCK

SEQ ID NO: 50322 - protein, 16 aa, Homo sapiens
PVAFSDYIHPVCLPDR

SEQ ID NO: 50323 - protein, 14 aa, Homo sapiens
PWDKNFTENDLLVR

SEQ ID NO: 50324 - protein, 20 aa, Homo sapiens
QECSIPVCGQDQVTVAMTPR

SEQ ID NO: 50325 - protein, 16 aa, Homo sapiens
RGDACEGDSGGPFVMK

SEQ ID NO: 50326 - protein, 9 aa, Homo sapiens
RGHVNITRS

SEQ ID NO: 50327 - protein, 21 aa, Homo sapiens
RQECSIPVCGQDQVTVAMTPR

SEQ ID NO: 50328 - protein, 21 aa, Homo sapiens
RSEGSSVNLSPPLEQCVPDRG

SEQ ID NO: 50329 - protein, 27 aa, Homo sapiens
RSRYPHKPEINSTTHPGADLQENFCRN

SEQ ID NO: 50330 - protein, 25 aa, Homo sapiens
RYPHKPEINSTTHPGADLQENFCRN

SEQ ID NO: 50331 - protein, 19 aa, Homo sapiens
SEGSSVNLSPPLEQCVPDR

SEQ ID NO: 50332 - protein, 26 aa, Homo sapiens
SEGSSVNLSPPLEQCVPDRGQQYQGR

SEQ ID NO: 50333 - protein, 10 aa, Homo sapiens
SEYQTFFNPR

SEQ ID NO: 50334 - protein, 9 aa, Homo sapiens
SGIECQLWR

SEQ ID NO: 50335 - protein, 17 aa, Homo sapiens
SIPVCGQDQVTVAMTPR

SEQ ID NO: 50336 - protein, 8 aa, Homo sapiens
SLEDKTER

SEQ ID NO: 50337 - protein, 18 aa, Homo sapiens
SLEDKTERELLESYIDGR

SEQ ID NO: 50338 - protein, 6 aa, Homo sapiens
SPFNNR

SEQ ID NO: 50339 - protein, 18 aa, Homo sapiens
SPPLEQCVPDRGQQYQGR

SEQ ID NO: 50340 - protein, 15 aa, Homo sapiens
SPQELLCGASLISDR

SEQ ID NO: 50341 - protein, 23 aa, Homo sapiens
SRYPHKPEINSTTHPGADLQENF

SEQ ID NO: 50342 - protein, 25 aa, Homo sapiens
SRYPHKPEINSTTHPGADLQENFCR

SEQ ID NO: 50343 - protein, 11 aa, Homo sapiens
TAASLLQAGYK

SEQ ID NO: 50344 - protein, 26 aa, Homo sapiens
TARTPRDKLAACLEGNCAEGLGTNYR

SEQ ID NO: 50345 - protein, 13 aa, Homo sapiens
TATSEYQTFFNPR

SEQ ID NO: 50346 - protein, 12 aa, Homo sapiens
TFGSGEADCGLR

SEQ ID NO: 50347 - protein, 17 aa, Homo sapiens
TFGSGEADCGLRPLFEK

SEQ ID NO: 50348 - protein, 18 aa, Homo sapiens
TFGSGEADCGLRPLFEKK

SEQ ID NO: 50349 - protein, 7 aa, Homo sapiens
VIDQFGE

SEQ ID NO: 50350 - protein, 25 aa, Homo sapiens
VLTAAHCLLYPPWDKNFTENDLLVR

SEQ ID NO: 50351 - protein, 8 aa, Homo sapiens
VTGWGNLK

SEQ ID NO: 50352 - protein, 17 aa, Homo sapiens
VTGWGNLKETWTANVGK

SEQ ID NO: 50353 - protein, 13 aa, Homo sapiens
VVNLPIVERPVCK

SEQ ID NO: 50354 - protein, 11 aa, Homo sapiens
WIQKVIDQFGE

SEQ ID NO: 50355 - protein, 16 aa, Homo sapiens
WVLTAAHCLLYPPWDK

SEQ ID NO: 50356 - protein, 23 aa, Homo sapiens
WVLTAAHCLLYPPWDKNFTENDL

SEQ ID NO: 50357 - protein, 26 aa, Homo sapiens
WVLTAAHCLLYPPWDKNFTENDLLVR

SEQ ID NO: 50358 - protein, 15 aa, Homo sapiens
WYQMGIVSWGEGCDR

SEQ ID NO: 50359 - protein, 18 aa, Homo sapiens
WYQMGIVSWGEGCDRDGK

SEQ ID NO: 50360 - protein, 7 aa, Homo sapiens
YERNIEK

SEQ ID NO: 50361 - protein, 6 aa, Homo sapiens
YGFYTH

SEQ ID NO: 50362 - protein, 9 aa, Homo sapiens
YGFYTHVFR

SEQ ID NO: 50363 - protein, 15 aa, Homo sapiens
YNWRENLDRDIALMK

SEQ ID NO: 50364 - protein, 23 aa, Homo sapiens
YPHKPEINSTTHPGADLQENFCR

SEQ ID NO: 50365 - protein, 8 aa, Homo sapiens
YTACETAR

SEQ ID NO: 50366 - protein, 14 aa, Homo sapiens
FGQHLIKPSVVFLK

SEQ ID NO: 50367 - protein, 18 aa, Homo sapiens
KPVVPGHVLVCPLRPVER

SEQ ID NO: 50368 - protein, 24 aa, Homo sapiens
KFLYNFTQIPHLAGTEQNFQLAKQ

SEQ ID NO: 50369 - protein, 19 aa, Homo sapiens
KVPYNVGPGFTGNFSTQKV

SEQ ID NO: 50370 - protein, 15 aa, Homo sapiens
AFIDPLGLPDRPFYR

SEQ ID NO: 50371 - protein, 7 aa, Homo sapiens
AFLDELK

SEQ ID NO: 50372 - protein, 12 aa, Homo sapiens
AFLDELKAENIK

SEQ ID NO: 50373 - protein, 13 aa, Homo sapiens
AFLDELKAENIKK

SEQ ID NO: 50374 - protein, 22 aa, Homo sapiens
DSWVFGGIDPQSGAAVVHEIVR

SEQ ID NO: 50375 - protein, 7 aa, Homo sapiens
DYAVVLR

SEQ ID NO: 50376 - protein, 19 aa, Homo sapiens
FSGYPLYHSVYETYELVEK

SEQ ID NO: 50377 - protein, 7 aa, Homo sapiens
FYDPMFK

SEQ ID NO: 50378 - protein, 15 aa, Homo sapiens
GAVEPDRYVILGGHR

SEQ ID NO: 50379 - protein, 23 aa, Homo sapiens
GIAEAVGLPSIPVHPIGYYDAQK

SEQ ID NO: 50380 - protein, 25 aa, Homo sapiens
GNILNLNGAGDPLTPGYPANEYAYR

SEQ ID NO: 50381 - protein, 17 aa, Homo sapiens
GVILYSDPADYFAPGVK

SEQ ID NO: 50382 - protein, 11 aa, Homo sapiens
HVIYAPSSHNK

SEQ ID NO: 50383 - protein, 9 aa, Homo sapiens
IYNVIGTLR

SEQ ID NO: 50384 - protein, 7 aa, Homo sapiens
IYSISMK

SEQ ID NO: 50385 - protein, 12 aa, Homo sapiens
KSPSPEFSGMPR

SEQ ID NO: 50386 - protein, 7 aa, Homo sapiens
LGIASGR

SEQ ID NO: 50387 - protein, 13 aa, Homo sapiens
LGSGNDFEVFFQR

SEQ ID NO: 50388 - protein, 13 aa, Homo sapiens
LQDFDKSNPIVLR

SEQ ID NO: 50389 - protein, 12 aa, Homo sapiens
MGGSAPPDSSWR

SEQ ID NO: 50390 - protein, 11 aa, Homo sapiens
MHIHSTNEVTR

SEQ ID NO: 50391 - protein, 11 aa, Homo sapiens
MMNDQLMFLER

SEQ ID NO: 50392 - protein, 16 aa, Homo sapiens
MWNLLHETDSAVATAR

SEQ ID NO: 50393 - protein, 8 aa, Homo sapiens
NAQLAGAK

SEQ ID NO: 50394 - protein, 9 aa, Homo sapiens
SPDEGFEGK

SEQ ID NO: 50395 - protein, 11 aa, Homo sapiens
SPSPEFSGMPR

SEQ ID NO: 50396 - protein, 11 aa, Homo sapiens
SSNEATNITPK

SEQ ID NO: 50397 - protein, 15 aa, Homo sapiens
SYPDGWNLPGGGVQR

SEQ ID NO: 50398 - protein, 9 aa, Homo sapiens
TEDFFKLER

SEQ ID NO: 50399 - protein, 14 aa, Homo sapiens
TYSVSFDSLFSAVK

SEQ ID NO: 50400 - protein, 11 aa, Homo sapiens
YADKIYSISMK

SEQ ID NO: 50401 - protein, 8 aa, Homo sapiens
YVILGGHR

SEQ ID NO: 50402 - protein, 7 aa, Homo sapiens
ALFQDIK

SEQ ID NO: 50403 - protein, 7 aa, Homo sapiens
ELAEEKR

SEQ ID NO: 50404 - protein, 15 aa, Homo sapiens
LGGPEAGLGEYLFER

SEQ ID NO: 50405 - protein, 19 aa, Homo sapiens
TDPHLCDFLETHFLDEEVK

SEQ ID NO: 50406 - protein, 19 aa, Homo sapiens
ADLVISHAGAGSCLETLEK

SEQ ID NO: 50407 - protein, 7 aa, Homo sapiens
FSAFLDK

SEQ ID NO: 50408 - protein, 16 aa, Homo sapiens
ERPGLGSNPCIPFFYR

SEQ ID NO: 50409 - protein, 10 aa, Homo sapiens
LAHLLASAQK

SEQ ID NO: 50410 - protein, 26 aa, Homo sapiens
RYQQLAVALDSSYVTNKQLNITIEKL

SEQ ID NO: 50411 - protein, 18 aa, Homo sapiens
KLFPATGNSTNLADDGKR

SEQ ID NO: 50412 - protein, 33 aa, Homo sapiens
MIHNCSLIASALTISNIQAGSTGNWGCHVQTKR

SEQ ID NO: 50413 - protein, 18 aa, Homo sapiens
RVLYMFNQMPLNLTNAVA

SEQ ID NO: 50414 - protein, 22 aa, Homo sapiens
RVLYMFNQMPLNLTNAVATARQ

SEQ ID NO: 50415 - protein, 11 aa, Homo sapiens
AFSMDEPVAAK

SEQ ID NO: 50416 - protein, 16 aa, Homo sapiens
TANSQVMGSANSTLRA

SEQ ID NO: 50417 - protein, 12 aa, Homo sapiens
AALKTASDFITK

SEQ ID NO: 50418 - protein, 15 aa, Homo sapiens
AAYLWVGTGASEAEK

SEQ ID NO: 50419 - protein, 13 aa, Homo sapiens
AGALNSNDAFVLK

SEQ ID NO: 50420 - protein, 31 aa, Homo sapiens
AGALNSNDAFVLKTPSAAYLWVGTGASEAEK

SEQ ID NO: 50421 - protein, 11 aa, Homo sapiens
AGKEPGLQIWR

SEQ ID NO: 50422 - protein, 19 aa, Homo sapiens
AILTAQLDEELGGTPVQSR

SEQ ID NO: 50423 - protein, 22 aa, Homo sapiens
AQPVQVAEGSEPDGFWEALGGK

SEQ ID NO: 50424 - protein, 26 aa, Homo sapiens
AQPVQVAEGSEPDGFWEALGGKAAYR

SEQ ID NO: 50425 - protein, 16 aa, Homo sapiens
ATASRGASQAGAPQGR

SEQ ID NO: 50426 - protein, 35 aa, Homo sapiens
ATEVPVSWESFNNGDCFILDLGNNIHQWCGSNSNR

SEQ ID NO: 50427 - protein, 13 aa, Homo sapiens
ATQVSKGIRDNER

SEQ ID NO: 50428 - protein, 7 aa, Homo sapiens
AVEVLPK

SEQ ID NO: 50429 - protein, 16 aa, Homo sapiens
DPDQTDGLGLSYLSSH

SEQ ID NO: 50430 - protein, 22 aa, Homo sapiens
DPDQTDGLGLSYLSSHIANVER

SEQ ID NO: 50431 - protein, 15 aa, Homo sapiens
DSQEEEKTEALTSAK

SEQ ID NO: 50432 - protein, 16 aa, Homo sapiens
DSQEEEKTEALTSAKR

SEQ ID NO: 50433 - protein, 11 aa, Homo sapiens
EGGQTAPASTR

SEQ ID NO: 50434 - protein, 16 aa, Homo sapiens
EGGQTAPASTRLFQVR

SEQ ID NO: 50435 - protein, 18 aa, Homo sapiens
EPAHLMSLFGGKPMIIYK

SEQ ID NO: 50436 - protein, 8 aa, Homo sapiens
EPGLQIWR

SEQ ID NO: 50437 - protein, 15 aa, Homo sapiens
EVQGFESATFLGYFK

SEQ ID NO: 50438 - protein, 20 aa, Homo sapiens
FDLVPVPTNLYGDFFTGDAY

SEQ ID NO: 50439 - protein, 24 aa, Homo sapiens
FDLVPVPTNLYGDFFTGDAYVILK

SEQ ID NO: 50440 - protein, 16 aa, Homo sapiens
FVIEEVPGELMQEDLA

SEQ ID NO: 50441 - protein, 11 aa, Homo sapiens
GASQAGAPQGR

SEQ ID NO: 50442 - protein, 8 aa, Homo sapiens
GGVASGFK

SEQ ID NO: 50443 - protein, 19 aa, Homo sapiens
GGVASGFKHVVPNEVVVQR

SEQ ID NO: 50444 - protein, 22 aa, Homo sapiens
GKQANTEERKAALKTASDFITK

SEQ ID NO: 50445 - protein, 16 aa, Homo sapiens
GLGLSYLSSHIANVER

SEQ ID NO: 50446 - protein, 11 aa, Homo sapiens
HVVPNEVVVQR

SEQ ID NO: 50447 - protein, 30 aa, Homo sapiens
IEGSNKVPVDPATYGQFYGGDSYIILYNYR

SEQ ID NO: 50448 - protein, 13 aa, Homo sapiens
KAALKTASDFITK

SEQ ID NO: 50449 - protein, 9 aa, Homo sapiens
KGGVASGFK

SEQ ID NO: 50450 - protein, 20 aa, Homo sapiens
KGGVASGFKHVVPNEVVVQR

SEQ ID NO: 50451 - protein, 8 aa, Homo sapiens
KMDAHPPR

SEQ ID NO: 50452 - protein, 7 aa, Homo sapiens
LFACSNK

SEQ ID NO: 50453 - protein, 15 aa, Homo sapiens
LGWDDDYWSVDPLDR

SEQ ID NO: 50454 - protein, 15 aa, Homo sapiens
LKATQVSKGIRDNER

SEQ ID NO: 50455 - protein, 18 aa, Homo sapiens
LKATQVSKGIRDNERSGR

SEQ ID NO: 50456 - protein, 12 aa, Homo sapiens
LWVGTGASEAEK

SEQ ID NO: 50457 - protein, 7 aa, Homo sapiens
MDAHPPR

SEQ ID NO: 50458 - protein, 22 aa, Homo sapiens
MDYPKQTQVSVLPEGGETPLFK

SEQ ID NO: 50459 - protein, 26 aa, Homo sapiens
MDYPKQTQVSVLPEGGETPLFKQFFK

SEQ ID NO: 50460 - protein, 9 aa, Homo sapiens
NGNLQYDLH

SEQ ID NO: 50461 - protein, 16 aa, Homo sapiens
NLYGDFFTGDAYVILK

SEQ ID NO: 50462 - protein, 34 aa, Homo sapiens
NWQGAQSTQDEVAASAILTAQLDEELGGTPVQSR

SEQ ID NO: 50463 - protein, 25 aa, Homo sapiens
NWRDPDQTDGLGLSYLSSHIANVER

SEQ ID NO: 50464 - protein, 12 aa, Homo sapiens
PALPAGTEDTAK

SEQ ID NO: 50465 - protein, 18 aa, Homo sapiens
PALPAGTEDTAKEDAANR

SEQ ID NO: 50466 - protein, 19 aa, Homo sapiens
PALPAGTEDTAKEDAANRK

SEQ ID NO: 50467 - protein, 20 aa, Homo sapiens
PATYGQFYGGDSYIILYNYR

SEQ ID NO: 50468 - protein, 30 aa, Homo sapiens
PEAMLQVLGPKPALPAGTEDTAKEDAANRK

SEQ ID NO: 50469 - protein, 17 aa, Homo sapiens
PEARPNSMVVEHPEFLK

SEQ ID NO: 50470 - protein, 6 aa, Homo sapiens
PMIIYK

SEQ ID NO: 50471 - protein, 12 aa, Homo sapiens
PNSMVVEHPEFL

SEQ ID NO: 50472 - protein, 13 aa, Homo sapiens
PNSMVVEHPEFLK

SEQ ID NO: 50473 - protein, 20 aa, Homo sapiens
PVPTNLYGDFFTGDAYVILK

SEQ ID NO: 50474 - protein, 31 aa, Homo sapiens
PVSWESFNNGDCFILDLGNNIHQWCGSNSNR

SEQ ID NO: 50475 - protein, 27 aa, Homo sapiens
QGFEPPSFVGWFLGWDDDYWSVDPLDR

SEQ ID NO: 50476 - protein, 12 aa, Homo sapiens
QGQIIYNWQGAQ

SEQ ID NO: 50477 - protein, 17 aa, Homo sapiens
QTQVSVLPEGGETPLFK

SEQ ID NO: 50478 - protein, 21 aa, Homo sapiens
QTQVSVLPEGGETPLFKQFFK

SEQ ID NO: 50479 - protein, 8 aa, Homo sapiens
RTPITVVK

SEQ ID NO: 50480 - protein, 10 aa, Homo sapiens
RYIETDPANR

SEQ ID NO: 50481 - protein, 10 aa, Homo sapiens
SEDCFILDHG

SEQ ID NO: 50482 - protein, 11 aa, Homo sapiens
SEDCFILDHGK

SEQ ID NO: 50483 - protein, 14 aa, Homo sapiens
SEDCFILDHGKDGK

SEQ ID NO: 50484 - protein, 11 aa, Homo sapiens
SMVVEHPEFLK

SEQ ID NO: 50485 - protein, 17 aa, Homo sapiens
SVSLVADENPFAQGALK

SEQ ID NO: 50486 - protein, 8 aa, Homo sapiens
TASDFITK

SEQ ID NO: 50487 - protein, 13 aa, Homo sapiens
TASDFITKMDYPK

SEQ ID NO: 50488 - protein, 18 aa, Homo sapiens
TDGLGLSYLSSHIANVER

SEQ ID NO: 50489 - protein, 8 aa, Homo sapiens
TEALTSAK

SEQ ID NO: 50490 - protein, 8 aa, Homo sapiens
TGAQELLR

SEQ ID NO: 50491 - protein, 19 aa, Homo sapiens
TMSVSLVADENPFAQGALK

SEQ ID NO: 50492 - protein, 7 aa, Homo sapiens
TPITVVK

SEQ ID NO: 50493 - protein, 18 aa, Homo sapiens
TPSAAYLWVGTGASEAEK

SEQ ID NO: 50494 - protein, 26 aa, Homo sapiens
TPSAAYLWVGTGASEAEKTGAQELLR

SEQ ID NO: 50495 - protein, 11 aa, Homo sapiens
TVQLDDYLNGR

SEQ ID NO: 50496 - protein, 22 aa, Homo sapiens
VDPATYGQFYGGDSYIILYNYR

SEQ ID NO: 50497 - protein, 27 aa, Homo sapiens
VEKFDLVPVPTNLYGDFFTGDAYVILK

SEQ ID NO: 50498 - protein, 13 aa, Homo sapiens
VHVSEEGTEPEAM

SEQ ID NO: 50499 - protein, 20 aa, Homo sapiens
VHVSEEGTEPEAMLQVLGPK

SEQ ID NO: 50500 - protein, 32 aa, Homo sapiens
VHVSEEGTEPEAMLQVLGPKPALPAGTEDTAK

SEQ ID NO: 50501 - protein, 18 aa, Homo sapiens
VPEARPNSMVVEHPEFLK

SEQ ID NO: 50502 - protein, 9 aa, Homo sapiens
VPFDAATLH

SEQ ID NO: 50503 - protein, 13 aa, Homo sapiens
VPFDAATLHTSTA

SEQ ID NO: 50504 - protein, 14 aa, Homo sapiens
VPFDAATLHTSTAM

SEQ ID NO: 50505 - protein, 24 aa, Homo sapiens
VPFDAATLHTSTAMAAQHGMDDDG

SEQ ID NO: 50506 - protein, 28 aa, Homo sapiens
VPFDAATLHTSTAMAAQHGMDDDGTGQK

SEQ ID NO: 50507 - protein, 17 aa, Homo sapiens
VPVDPATYGQFYGGDSY

SEQ ID NO: 50508 - protein, 21 aa, Homo sapiens
VPVDPATYGQFYGGDSYIILY

SEQ ID NO: 50509 - protein, 24 aa, Homo sapiens
VPVDPATYGQFYGGDSYIILYNYR

SEQ ID NO: 50510 - protein, 25 aa, Homo sapiens
VSNGAGTMSVSLVADENPFAQGALK

SEQ ID NO: 50511 - protein, 23 aa, Homo sapiens
VVQGKEPAHLMSLFGGKPMIIYK

SEQ ID NO: 50512 - protein, 13 aa, Homo sapiens
YGGDSYIILYNYR

SEQ ID NO: 50513 - protein, 9 aa, Homo sapiens
YIETDPANR

SEQ ID NO: 50514 - protein, 11 aa, Homo sapiens
YIETDPANRDR

SEQ ID NO: 50515 - protein, 11 aa, Homo sapiens
FILLACDGLFK

SEQ ID NO: 50516 - protein, 19 aa, Homo sapiens
VFTPEEAVNFILSCLEDEK

SEQ ID NO: 50517 - protein, 23 aa, Homo sapiens
VFTPEEAVNFILSCLEDEKIQTR

SEQ ID NO: 50518 - protein, 15 aa, Homo sapiens
AAHEALGQFCCALHK

SEQ ID NO: 50519 - protein, 20 aa, Homo sapiens
ACQSCPSEPNTAALQAALAR

SEQ ID NO: 50520 - protein, 15 aa, Homo sapiens
ACYALENFVENLGPK

SEQ ID NO: 50521 - protein, 18 aa, Homo sapiens
AGLLVLAVLSDGAGDHIR

SEQ ID NO: 50522 - protein, 21 aa, Homo sapiens
APAALPALCDLLASAADPQIR

SEQ ID NO: 50523 - protein, 30 aa, Homo sapiens
ELAVSALGAIATAAQASLLPYFPAIMEHLR

SEQ ID NO: 50524 - protein, 11 aa, Homo sapiens
EVMPLLLAYLK

SEQ ID NO: 50525 - protein, 17 aa, Homo sapiens
KPEPQVLAALLHALPLK

SEQ ID NO: 50526 - protein, 22 aa, Homo sapiens
LFSFLYQSSPDQVIDVAPELLR

SEQ ID NO: 50527 - protein, 10 aa, Homo sapiens
LLECPHLNVR

SEQ ID NO: 50528 - protein, 11 aa, Homo sapiens
LLPPLLQIVCK

SEQ ID NO: 50529 - protein, 12 aa, Homo sapiens
SCGTLTLKPPGR

SEQ ID NO: 50530 - protein, 12 aa, Homo sapiens
SVPLGHTHHLAK

SEQ ID NO: 50531 - protein, 17 aa, Homo sapiens
VQPYLPELMECMLQLLR

SEQ ID NO: 50532 - protein, 19 aa, Homo sapiens
KHFDCPVLEGMELENQGGV

SEQ ID NO: 50533 - protein, 22 aa, Homo sapiens
RFADGLPPFNYSLGLYQWSDKV

SEQ ID NO: 50534 - protein, 32 aa, Homo sapiens
KSSSGNENDEQDSDNANMSTQSPVSSEEYDRT

SEQ ID NO: 50535 - protein, 18 aa, Homo sapiens
DCVDIEVFPAGENTEDQK

SEQ ID NO: 50536 - protein, 14 aa, Homo sapiens
HAHSILQFQFAEVK

SEQ ID NO: 50537 - protein, 35 aa, Homo sapiens
LDQEGDDVQTAAEEVLADGDTLDFEDDTVQSSGPR

SEQ ID NO: 50538 - protein, 18 aa, Homo sapiens
GSEYDDFLDEFMEAVSSK

SEQ ID NO: 50539 - protein, 18 aa, Homo sapiens
ILGLGDLGCNGMGIPVGK

SEQ ID NO: 50540 - protein, 30 aa, Homo sapiens
NLEAIVQEIKPTALIGVAAIGGAFSEQILK

SEQ ID NO: 50541 - protein, 21 aa, Homo sapiens
QITDNIFLTTAEVIAQQVSDK

SEQ ID NO: 50542 - protein, 9 aa, Homo sapiens
EAEPLVDIR

SEQ ID NO: 50543 - protein, 19 aa, Homo sapiens
FGNFQGLMEANVSLDLGKL

SEQ ID NO: 50544 - protein, 20 aa, Homo sapiens
FNTTYINIGSSYFPEHGYFR

SEQ ID NO: 50545 - protein, 22 aa, Homo sapiens
KFNTTYINIGSSYFPEHGYFRA

SEQ ID NO: 50546 - protein, 9 aa, Homo sapiens
LVTLLALCK

SEQ ID NO: 50547 - protein, 16 aa, Homo sapiens
RSFNQSLHSLTQAIRN

SEQ ID NO: 50548 - protein, 14 aa, Homo sapiens
SLSGTAFGGFLMFK

SEQ ID NO: 50549 - protein, 12 aa, Homo sapiens
VWFELTQGSITK

SEQ ID NO: 50550 - protein, 15 aa, Homo sapiens
YASFSEGTAALQTVK

SEQ ID NO: 50551 - protein, 20 aa, Homo sapiens
KREEAAAVPAAAPDDLALLK

SEQ ID NO: 50552 - protein, 30 aa, Homo sapiens
KSGKGDSTLQVSSGLNENLTVNGGGWNEKS

SEQ ID NO: 50553 - protein, 15 aa, Homo sapiens
NKGDSHLNVQVSNFK

SEQ ID NO: 50554 - protein, 23 aa, Homo sapiens
RVLYCCPEIFTMRQQDINDTVRL

SEQ ID NO: 50555 - protein, 25 aa, Homo sapiens
KMITNEKIDAYNEAAVSILNSSTRN

SEQ ID NO: 50556 - protein, 32 aa, Homo sapiens
GDFLASLENDIKPAFGTNQEDYASYIMNGIIK

SEQ ID NO: 50557 - protein, 20 aa, Homo sapiens
LGANSGLHIIIFDEIDAICK

SEQ ID NO: 50558 - protein, 12 aa, Homo sapiens
AGALQLLLVGDK

SEQ ID NO: 50559 - protein, 6 aa, Homo sapiens
ALELVK

SEQ ID NO: 50560 - protein, 11 aa, Homo sapiens
ALELVKQEGLR

SEQ ID NO: 50561 - protein, 20 aa, Homo sapiens
ATYFGSIVLLSPAVIDSPLK

SEQ ID NO: 50562 - protein, 11 aa, Homo sapiens
AVEPQLQEEER

SEQ ID NO: 50563 - protein, 42 aa, Homo sapiens
CTIKPSGTTISVTASVTIALVPPDQPEVQLSSMTMDARLSAK

SEQ ID NO: 50564 - protein, 14 aa, Homo sapiens
DPVASTSNLDMDFR

SEQ ID NO: 50565 - protein, 12 aa, Homo sapiens
EGHFYYNISEVK

SEQ ID NO: 50566 - protein, 15 aa, Homo sapiens
FLEQELETITIPDLR

SEQ ID NO: 50567 - protein, 29 aa, Homo sapiens
FLLNQQICPVLYHAGTVLLNSLLDTVPVR

SEQ ID NO: 50568 - protein, 23 aa, Homo sapiens
FRIYSNHSALESLALIPLQAPLK

SEQ ID NO: 50569 - protein, 9 aa, Homo sapiens
GAFFPLTER

SEQ ID NO: 50570 - protein, 14 aa, Homo sapiens
GKEGHFYYNISEVK

SEQ ID NO: 50571 - protein, 17 aa, Homo sapiens
GVQIPLPEGINFVHEVV

SEQ ID NO: 50572 - protein, 17 aa, Homo sapiens
HAGTVLLNSLLDTVPVR

SEQ ID NO: 50573 - protein, 21 aa, Homo sapiens
IYSNHSALESLALIPLQAPLK

SEQ ID NO: 50574 - protein, 35 aa, Homo sapiens
IYSNHSALESLALIPLQAPLKTMLQIGVMPMLNER

SEQ ID NO: 50575 - protein, 14 aa, Homo sapiens
KEGHFYYNISEVKV

SEQ ID NO: 50576 - protein, 14 aa, Homo sapiens
KVSNVSCQASVSRM

SEQ ID NO: 50577 - protein, 33 aa, Homo sapiens
KVTELQLTSSELDFQPQQELMLQITNASLGLRF

SEQ ID NO: 50578 - protein, 10 aa, Homo sapiens
MHAAFGGTFK

SEQ ID NO: 50579 - protein, 14 aa, Homo sapiens
MKVSNVSCQASVSR

SEQ ID NO: 50580 - protein, 18 aa, Homo sapiens
RGAFFPLTERNWSLPNRA

SEQ ID NO: 50581 - protein, 23 aa, Homo sapiens
RIYSNHSALESLALIPLQAPLKT

SEQ ID NO: 50582 - protein, 14 aa, Homo sapiens
SEFFFDSAMESYFR

SEQ ID NO: 50583 - protein, 15 aa, Homo sapiens
SSVDELVGIDYSLMK

SEQ ID NO: 50584 - protein, 7 aa, Homo sapiens
TGLELSR

SEQ ID NO: 50585 - protein, 14 aa, Homo sapiens
TMLQIGVMPMLNER

SEQ ID NO: 50586 - protein, 6 aa, Homo sapiens
TQLDLR

SEQ ID NO: 50587 - protein, 12 aa, Homo sapiens
VSNVSCQASVSR

SEQ ID NO: 50588 - protein, 31 aa, Homo sapiens
VTELQLTSSELDFQPQQELMLQITNASLGLR

SEQ ID NO: 50589 - protein, 33 aa, Homo sapiens
VTELQLTSSELDFQPQQELMLQITNASLGLRFR

SEQ ID NO: 50590 - protein, 14 aa, Homo sapiens
VYDFLSTFITSGMR

SEQ ID NO: 50591 - protein, 37 aa, Homo sapiens
DTSPGSAYQEGGGLYALGLIHANHGGDIIDYLLNQLK

SEQ ID NO: 50592 - protein, 32 aa, Homo sapiens
IYMNLEKPDFINVCQCLIFLDDPQAVSDILEK

SEQ ID NO: 50593 - protein, 16 aa, Homo sapiens
KKEPEPNFQLLDNPAR

SEQ ID NO: 50594 - protein, 14 aa, Homo sapiens
LLHVAVSDVNDDVR

SEQ ID NO: 50595 - protein, 15 aa, Homo sapiens
LLHVAVSDVNDDVRR

SEQ ID NO: 50596 - protein, 29 aa, Homo sapiens
LNAVVNDFWAEISESVDKIEVLYEDEGFR

SEQ ID NO: 50597 - protein, 26 aa, Homo sapiens
NSVCHTATVIANSFMHCGTTSDQFLR

SEQ ID NO: 50598 - protein, 18 aa, Homo sapiens
SNCKPSTFAYPAPLEVPK

SEQ ID NO: 50599 - protein, 21 aa, Homo sapiens
TPEQCPSVVSLLSESYNPHVR

SEQ ID NO: 50600 - protein, 23 aa, Homo sapiens
TVGTPIASVPGSTNTGTVPGSEK

SEQ ID NO: 50601 - protein, 16 aa, Homo sapiens
YQPFKPLSIGGIIILK

SEQ ID NO: 50602 - protein, 29 aa, Homo sapiens
GNIPAESYTFFIDILLDTIRDEIAGCIEK

SEQ ID NO: 50603 - protein, 16 aa, Homo sapiens
HPVSLEQYLMEGSYNK

SEQ ID NO: 50604 - protein, 18 aa, Homo sapiens
DSLVHSSPHVALSHVDAR

SEQ ID NO: 50605 - protein, 14 aa, Homo sapiens
KELDLTCNITTDRA

SEQ ID NO: 50606 - protein, 19 aa, Homo sapiens
KLENWTDASRVDGVVLEKV

SEQ ID NO: 50607 - protein, 23 aa, Homo sapiens
RVVGTELVIPCNVSDYDGPSEQN

SEQ ID NO: 50608 - protein, 23 aa, Homo sapiens
RYSVLIMAEKPVGDLSSPNETKY

SEQ ID NO: 50609 - protein, 14 aa, Homo sapiens
VPGFADDPTELACR

SEQ ID NO: 50610 - protein, 32 aa, Homo sapiens
EGILFVTYPDGRPTGDAFVLFACEEYAQNALR

SEQ ID NO: 50611 - protein, 25 aa, Homo sapiens
GLPFTATAEEVVAFFGQHCPITGGK

SEQ ID NO: 50612 - protein, 23 aa, Homo sapiens
GLPYAATIEDILDFLGEFATDIR

SEQ ID NO: 50613 - protein, 12 aa, Homo sapiens
LDFLGEFATDIR

SEQ ID NO: 50614 - protein, 15 aa, Homo sapiens
NVLLPECFYSFFDLR

SEQ ID NO: 50615 - protein, 21 aa, Homo sapiens
TATAEEVVAFFGQHCPITGGK

SEQ ID NO: 50616 - protein, 21 aa, Homo sapiens
VGQLHEVLVRPDQLELTEDCK

SEQ ID NO: 50617 - protein, 25 aa, Homo sapiens
VGQLHEVLVRPDQLELTEDCKEETK

SEQ ID NO: 50618 - protein, 17 aa, Homo sapiens
ASAVGDDDKVYYFFTER

SEQ ID NO: 50619 - protein, 12 aa, Homo sapiens
GVCSLDAETSSR

SEQ ID NO: 50620 - protein, 12 aa, Homo sapiens
MTIPYEELSGTR

SEQ ID NO: 50621 - protein, 8 aa, Homo sapiens
DSCPLDCK

SEQ ID NO: 50622 - protein, 12 aa, Homo sapiens
VYVGNLGNNGNK

SEQ ID NO: 50623 - protein, 8 aa, Homo sapiens
EWTFPEAK

SEQ ID NO: 50624 - protein, 24 aa, Homo sapiens
LNWIQWASLLTLFLSIVALTAGTK

SEQ ID NO: 50625 - protein, 8 aa, Homo sapiens
GPILSTCK

SEQ ID NO: 50626 - protein, 15 aa, Homo sapiens
LDTNYDLLLDQSELR

SEQ ID NO: 50627 - protein, 10 aa, Homo sapiens
LEYQACVLGK

SEQ ID NO: 50628 - protein, 36 aa, Homo sapiens
KEALGSVVAHSTFSAMKANTMSNYTLLPPSLLDHRR

SEQ ID NO: 50629 - protein, 30 aa, Homo sapiens
ALSIPPNIDVLLCEQEVVADETPAVQAVLR

SEQ ID NO: 50630 - protein, 30 aa, Homo sapiens
EPDVLILDEPTNNLDIESIDALGEAINEYK

SEQ ID NO: 50631 - protein, 11 aa, Homo sapiens
FAALDNEEEDK

SEQ ID NO: 50632 - protein, 14 aa, Homo sapiens
FGLESHAHTIQICK

SEQ ID NO: 50633 - protein, 31 aa, Homo sapiens
FTFPDPPPLSPPVLGLHGVTFGYQGQKPLFK

SEQ ID NO: 50634 - protein, 16 aa, Homo sapiens
MSSRQAMLENASDIKL

SEQ ID NO: 50635 - protein, 26 aa, Homo sapiens
TLLIVSHDQGFLDDVCTDIIHLDAQR

SEQ ID NO: 50636 - protein, 28 aa, Homo sapiens
MACLMAAFSVGTAMNASSYSAEMTEPKS

SEQ ID NO: 50637 - protein, 22 aa, Homo sapiens
ATENTVNPCPDDTLISFLPLAH

SEQ ID NO: 50638 - protein, 11 aa, Homo sapiens
DSGLKPFEQVK

SEQ ID NO: 50639 - protein, 11 aa, Homo sapiens
GFEGSFEELCR

SEQ ID NO: 50640 - protein, 21 aa, Homo sapiens
GITLHPELFSIDNGLLTPTMK

SEQ ID NO: 50641 - protein, 21 aa, Homo sapiens
KRKEAELRSGIIRNNSLWDRL

SEQ ID NO: 50642 - protein, 11 aa, Homo sapiens
NIVSDCSAFVK

SEQ ID NO: 50643 - protein, 16 aa, Homo sapiens
QVAELSECIGSALIQK

SEQ ID NO: 50644 - protein, 25 aa, Homo sapiens
RKPKPPAPEDLAVICFTSGTTGNPK

SEQ ID NO: 50645 - protein, 26 aa, Homo sapiens
SALLDSDEPLVYFYDDVTTLYEGFQR

SEQ ID NO: 50646 - protein, 28 aa, Homo sapiens
EHSSLGHADLDALQQNPQPLIFHMEMLK

SEQ ID NO: 50647 - protein, 19 aa, Homo sapiens
LVVEEYYEVLDHCSSILNK

SEQ ID NO: 50648 - protein, 9 aa, Homo sapiens
ALLTLADGR

SEQ ID NO: 50649 - protein, 8 aa, Homo sapiens
ASIWVGHR

SEQ ID NO: 50650 - protein, 12 aa, Homo sapiens
DESLKVDEHLAK

SEQ ID NO: 50651 - protein, 11 aa, Homo sapiens
DISQAYYTVYK

SEQ ID NO: 50652 - protein, 12 aa, Homo sapiens
DISQAYYTVYKK

SEQ ID NO: 50653 - protein, 7 aa, Homo sapiens
DIVDSIK

SEQ ID NO: 50654 - protein, 16 aa, Homo sapiens
DYPDFSPSVDAEAIQK

SEQ ID NO: 50655 - protein, 16 aa, Homo sapiens
GAGTNEDALIEILTTR

SEQ ID NO: 50656 - protein, 24 aa, Homo sapiens
GDLSGHFEHLMVALVTPPAVFDAK

SEQ ID NO: 50657 - protein, 19 aa, Homo sapiens
GELSGHFEDLLLAIVNCVR

SEQ ID NO: 50658 - protein, 11 aa, Homo sapiens
GIGTDEFTLNR

SEQ ID NO: 50659 - protein, 11 aa, Homo sapiens
HYGYSLYSAIK

SEQ ID NO: 50660 - protein, 7 aa, Homo sapiens
LTFDEYR

SEQ ID NO: 50661 - protein, 9 aa, Homo sapiens
MLISILTER

SEQ ID NO: 50662 - protein, 14 aa, Homo sapiens
PDFSPSVDAEAIQK

SEQ ID NO: 50663 - protein, 8 aa, Homo sapiens
QDAQILYK

SEQ ID NO: 50664 - protein, 13 aa, Homo sapiens
RDESLKVDEHLAK

SEQ ID NO: 50665 - protein, 13 aa, Homo sapiens
SDTSGDYEITLLK

SEQ ID NO: 50666 - protein, 9 aa, Homo sapiens
SEIDLLDIR

SEQ ID NO: 50667 - protein, 15 aa, Homo sapiens
SLGDDISSETSGDFR

SEQ ID NO: 50668 - protein, 16 aa, Homo sapiens
SLGDDISSETSGDFRK

SEQ ID NO: 50669 - protein, 7 aa, Homo sapiens
VDEHLAK

SEQ ID NO: 50670 - protein, 15 aa, Homo sapiens
WGTDEDKFTEILCLR

SEQ ID NO: 50671 - protein, 13 aa, Homo sapiens
DAFDAGERPSFDR

SEQ ID NO: 50672 - protein, 9 aa, Homo sapiens
LPGQDNLVK

SEQ ID NO: 50673 - protein, 15 aa, Homo sapiens
EALICPTCNVTIHNR

SEQ ID NO: 50674 - protein, 12 aa, Homo sapiens
ILQHSHGIEEER

SEQ ID NO: 50675 - protein, 28 aa, Homo sapiens
MCYACNKSITAKEALICPTCNVTIHNRC

SEQ ID NO: 50676 - protein, 19 aa, Homo sapiens
AALETDENLLLCAPTGAGK

SEQ ID NO: 50677 - protein, 15 aa, Homo sapiens
DILCGAADEVLAVLK

SEQ ID NO: 50678 - protein, 10 aa, Homo sapiens
EGSASTEVLR

SEQ ID NO: 50679 - protein, 27 aa, Homo sapiens
FLYEPLPVESHLDHCMHDHFNAEIVTK

SEQ ID NO: 50680 - protein, 15 aa, Homo sapiens
FLYQLHETEKEDLIR

SEQ ID NO: 50681 - protein, 20 aa, Homo sapiens
GYTLLSEGIDEMVGIIYKPK

SEQ ID NO: 50682 - protein, 21 aa, Homo sapiens
HLSDHLSELVEQTLSDLEQSK

SEQ ID NO: 50683 - protein, 30 aa, Homo sapiens
IASHYYITNDTVQTYNQLLKPTLSEIELFR

SEQ ID NO: 50684 - protein, 29 aa, Homo sapiens
IHAYVDYPIYDVLQMVGHANRPLQDDEGR

SEQ ID NO: 50685 - protein, 19 aa, Homo sapiens
LATYGITVAELTGDHQLCK

SEQ ID NO: 50686 - protein, 14 aa, Homo sapiens
LYDLNHNEIGELIR

SEQ ID NO: 50687 - protein, 20 aa, Homo sapiens
QVLDLEDLVFTQGSHFMANK

SEQ ID NO: 50688 - protein, 14 aa, Homo sapiens
RLDLVHTAALMLDK

SEQ ID NO: 50689 - protein, 8 aa, Homo sapiens
SNSLISIK

SEQ ID NO: 50690 - protein, 6 aa, Homo sapiens
TLNLCK

SEQ ID NO: 50691 - protein, 21 aa, Homo sapiens
VRPVPLELHIQGFNISHTQTR

SEQ ID NO: 50692 - protein, 15 aa, Homo sapiens
WTELGALDILQMLGR

SEQ ID NO: 50693 - protein, 9 aa, Homo sapiens
YHVLVNLGK

SEQ ID NO: 50694 - protein, 19 aa, Homo sapiens
YPPPTELLDLQPLPVSALR

SEQ ID NO: 50695 - protein, 24 aa, Homo sapiens
AGEYDHLPEQAFYMVGPIEEAVAK

SEQ ID NO: 50696 - protein, 14 aa, Homo sapiens
AHGGYSVFAGVGER

SEQ ID NO: 50697 - protein, 19 aa, Homo sapiens
AIAELGIYPAVDPLDSTSR

SEQ ID NO: 50698 - protein, 16 aa, Homo sapiens
DQEGQDVLLFIDNIFR

SEQ ID NO: 50699 - protein, 18 aa, Homo sapiens
EGNDLYHEMIESGVINLK

SEQ ID NO: 50700 - protein, 18 aa, Homo sapiens
FLSQPFQVAEVFTGHMGK

SEQ ID NO: 50701 - protein, 14 aa, Homo sapiens
FTQAGSEVSALLGR

SEQ ID NO: 50702 - protein, 23 aa, Homo sapiens
GEYDHLPEQAFYMVGPIEEAVAK

SEQ ID NO: 50703 - protein, 30 aa, Homo sapiens
GFQQILAGEYDHLPEQAFYMVGPIEEAVAK

SEQ ID NO: 50704 - protein, 36 aa, Homo sapiens
GSITSVQAIYVPADDLTDPAPATTFAHLDATTVLSR

SEQ ID NO: 50705 - protein, 11 aa, Homo sapiens
IGLFGGAGVGK

SEQ ID NO: 50706 - protein, 16 aa, Homo sapiens
IMDPNIVGSEHYDVAR

SEQ ID NO: 50707 - protein, 21 aa, Homo sapiens
IPSAVGYQPTLATDMGTMQER

SEQ ID NO: 50708 - protein, 10 aa, Homo sapiens
IPVGPETLGR

SEQ ID NO: 50709 - protein, 37 aa, Homo sapiens
KGSITSVQAIYVPADDLTDPAPATTFAHLDATTVLSR

SEQ ID NO: 50710 - protein, 25 aa, Homo sapiens
LAGEYDHLPEQAFYMVGPIEEAVAK

SEQ ID NO: 50711 - protein, 15 aa, Homo sapiens
LVLEVAQHLGESTVR

SEQ ID NO: 50712 - protein, 25 aa, Homo sapiens
PADDLTDPAPATTFAHLDATTVLSR

SEQ ID NO: 50713 - protein, 19 aa, Homo sapiens
SLQDIIAILGMDELSEEDK

SEQ ID NO: 50714 - protein, 24 aa, Homo sapiens
SLQDIIAILGMDELSEEDKLTVSR

SEQ ID NO: 50715 - protein, 13 aa, Homo sapiens
TVLIMELINNVAK

SEQ ID NO: 50716 - protein, 13 aa, Homo sapiens
VALTGLTVAEYFR

SEQ ID NO: 50717 - protein, 10 aa, Homo sapiens
VVDLLAPYAK

SEQ ID NO: 50718 - protein, 19 aa, Homo sapiens
RIDDLQMVLNQTEDHRQRV

SEQ ID NO: 50719 - protein, 14 aa, Homo sapiens
TNQTPPTYNKTNKF

SEQ ID NO: 50720 - protein, 17 aa, Homo sapiens
CSELKGQLGEAEGENLR

SEQ ID NO: 50721 - protein, 14 aa, Homo sapiens
LEADMALAKEESEK

SEQ ID NO: 50722 - protein, 17 aa, Homo sapiens
LRDKYEAELSELEQSER

SEQ ID NO: 50723 - protein, 10 aa, Homo sapiens
VKETEKALSR

SEQ ID NO: 50724 - protein, 17 aa, Homo sapiens
EALKFHPQKEAENQHNK

SEQ ID NO: 50725 - protein, 25 aa, Homo sapiens
GLREMLDQSNQWGGTALVVPAFEIR

SEQ ID NO: 50726 - protein, 26 aa, Homo sapiens
GLREMLDQSNQWGGTALVVPAFEIRR

SEQ ID NO: 50727 - protein, 33 aa, Homo sapiens
KNELVQLYQVGEVRPFYYGLCTPCQAPTNYSRW

SEQ ID NO: 50728 - protein, 24 aa, Homo sapiens
RVAQPGINYALGTNVSYPNNLLRN

SEQ ID NO: 50729 - protein, 11 aa, Homo sapiens
SCQEVFDKLAR

SEQ ID NO: 50730 - protein, 10 aa, Homo sapiens
SVDQVKAQLR

SEQ ID NO: 50731 - protein, 16 aa, Homo sapiens
TALASGGVLDASGDYR

SEQ ID NO: 50732 - protein, 7 aa, Homo sapiens
VPTFDER

SEQ ID NO: 50733 - protein, 14 aa, Homo sapiens
WEGPLSVSVFAATK

SEQ ID NO: 50734 - protein, 9 aa, Homo sapiens
YEAAVPDPR

SEQ ID NO: 50735 - protein, 27 aa, Homo sapiens
EMTSVVAENGTGLVCSLELEEEQPELK

SEQ ID NO: 50736 - protein, 18 aa, Homo sapiens
KRKSGYSLNFSEGDGRRR

SEQ ID NO: 50737 - protein, 15 aa, Homo sapiens
MELAGSNTTASSPAR

SEQ ID NO: 50738 - protein, 22 aa, Homo sapiens
KQTLGQNDTGFSCDGTANTFRV

SEQ ID NO: 50739 - protein, 30 aa, Homo sapiens
KGTSSSPLAVASGPAKSSSMTTLAKNVTNK

SEQ ID NO: 50740 - protein, 20 aa, Homo sapiens
DQTIRFDHVITNMNNNYEPR

SEQ ID NO: 50741 - protein, 10 aa, Homo sapiens
FDHVITNMNN

SEQ ID NO: 50742 - protein, 15 aa, Homo sapiens
FDHVITNMNNNYEPR

SEQ ID NO: 50743 - protein, 9 aa, Homo sapiens
GNLCVNLMR

SEQ ID NO: 50744 - protein, 7 aa, Homo sapiens
IAFSATR

SEQ ID NO: 50745 - protein, 14 aa, Homo sapiens
LEQGENVFLQATDK

SEQ ID NO: 50746 - protein, 15 aa, Homo sapiens
LEQGENVFLQATDKN

SEQ ID NO: 50747 - protein, 10 aa, Homo sapiens
NSLLGMEGAN

SEQ ID NO: 50748 - protein, 13 aa, Homo sapiens
NSLLGMEGANSIF

SEQ ID NO: 50749 - protein, 24 aa, Homo sapiens
NSLLGMEGANSIFSGFLLFPDMEA

SEQ ID NO: 50750 - protein, 13 aa, Homo sapiens
NTFQVTTGGMVLK

SEQ ID NO: 50751 - protein, 14 aa, Homo sapiens
SIFSGFLLFPDMEA

SEQ ID NO: 50752 - protein, 7 aa, Homo sapiens
TINVPLR

SEQ ID NO: 50753 - protein, 8 aa, Homo sapiens
TINVPLRR

SEQ ID NO: 50754 - protein, 10 aa, Homo sapiens
VPGLYYFTYH

SEQ ID NO: 50755 - protein, 12 aa, Homo sapiens
VPGLYYFTYHAS

SEQ ID NO: 50756 - protein, 14 aa, Homo sapiens
VPGLYYFTYHASSR

SEQ ID NO: 50757 - protein, 12 aa, Homo sapiens
VVTFCDYAYNTF

SEQ ID NO: 50758 - protein, 22 aa, Homo sapiens
VVTFCDYAYNTFQVTTGGMVLK

SEQ ID NO: 50759 - protein, 9 aa, Homo sapiens
YFTYHASSR

SEQ ID NO: 50760 - protein, 27 aa, Homo sapiens
TGWHSNRLLGDCGPHTPVSTALSFIAV

SEQ ID NO: 50761 - protein, 11 aa, Homo sapiens
APSDLYQIILK

SEQ ID NO: 50762 - protein, 25 aa, Homo sapiens
DMETIGFAVYEVPPELVGQPAVHLK

SEQ ID NO: 50763 - protein, 10 aa, Homo sapiens
GHAYSVTGAK

SEQ ID NO: 50764 - protein, 8 aa, Homo sapiens
GQVVSLIR

SEQ ID NO: 50765 - protein, 12 aa, Homo sapiens
KAPSDLYQIILK

SEQ ID NO: 50766 - protein, 9 aa, Homo sapiens
KLYELIITR

SEQ ID NO: 50767 - protein, 22 aa, Homo sapiens
KRDFFLANASRARSEQFINLRE

SEQ ID NO: 50768 - protein, 13 aa, Homo sapiens
LDETDDPDDYGDR

SEQ ID NO: 50769 - protein, 12 aa, Homo sapiens
LEICNLTPDALK

SEQ ID NO: 50770 - protein, 24 aa, Homo sapiens
LPPGEYVVVPSTFEPNKEGDFVLR

SEQ ID NO: 50771 - protein, 19 aa, Homo sapiens
LVFVHSAEGNEFWSALLEK

SEQ ID NO: 50772 - protein, 9 aa, Homo sapiens
MAIESAGFK

SEQ ID NO: 50773 - protein, 13 aa, Homo sapiens
NYPATFWVNPQFK

SEQ ID NO: 50774 - protein, 12 aa, Homo sapiens
QLAGEDMEISVK

SEQ ID NO: 50775 - protein, 18 aa, Homo sapiens
RPTELLSNPQFIVDGATR

SEQ ID NO: 50776 - protein, 31 aa, Homo sapiens
SAGTVELDDQIQANLPDEQVLSEEEIDENFK

SEQ ID NO: 50777 - protein, 10 aa, Homo sapiens
SGSMSAYEMR

SEQ ID NO: 50778 - protein, 29 aa, Homo sapiens
TDICQGALGDCWLLAAIASLTLNDTLLHR

SEQ ID NO: 50779 - protein, 20 aa, Homo sapiens
WKRPTELLSNPQFIVDGATR

SEQ ID NO: 50780 - protein, 10 aa, Homo sapiens
YLGQDYEQLR

SEQ ID NO: 50781 - protein, 19 aa, Homo sapiens
YSEPDLAVDFDNFVCCLVR

SEQ ID NO: 50782 - protein, 19 aa, Homo sapiens
DFLTGVLDNLVEQNVLNWK

SEQ ID NO: 50783 - protein, 24 aa, Homo sapiens
DSPASLEVASSQSSENLEEDAVYK

SEQ ID NO: 50784 - protein, 6 aa, Homo sapiens
AVLTQK

SEQ ID NO: 50785 - protein, 14 aa, Homo sapiens
CSGEEQSLEQCQHR

SEQ ID NO: 50786 - protein, 8 aa, Homo sapiens
CYGPGVGR

SEQ ID NO: 50787 - protein, 7 aa, Homo sapiens
DVAVLCR

SEQ ID NO: 50788 - protein, 14 aa, Homo sapiens
EATLQDCPSGPWGK

SEQ ID NO: 50789 - protein, 22 aa, Homo sapiens
ELGCGAASGTPSGILYEPPAEK

SEQ ID NO: 50790 - protein, 25 aa, Homo sapiens
ELGCGAASGTPSGILYEPPAEKEQK

SEQ ID NO: 50791 - protein, 19 aa, Homo sapiens
FWGFHDCTHQEDVAVICSG

SEQ ID NO: 50792 - protein, 18 aa, Homo sapiens
GAASGTPSGILYEPPAEK

SEQ ID NO: 50793 - protein, 14 aa, Homo sapiens
GQWGTVCDDGWDIK

SEQ ID NO: 50794 - protein, 14 aa, Homo sapiens
GVWGSVCDDNWGEK

SEQ ID NO: 50795 - protein, 21 aa, Homo sapiens
GVWGSVCDDNWGEKEDQVVCK

SEQ ID NO: 50796 - protein, 18 aa, Homo sapiens
HAYGRKPIWLSQMSCSGR

SEQ ID NO: 50797 - protein, 16 aa, Homo sapiens
HQNQWYTVCQTGWSLR

SEQ ID NO: 50798 - protein, 7 aa, Homo sapiens
IWLDNVR

SEQ ID NO: 50799 - protein, 9 aa, Homo sapiens
KCYGPGVGR

SEQ ID NO: 50800 - protein, 8 aa, Homo sapiens
KPIWLSQM

SEQ ID NO: 50801 - protein, 13 aa, Homo sapiens
KPIWLSQMSCSGR

SEQ ID NO: 50802 - protein, 9 aa, Homo sapiens
LADGPGHCK

SEQ ID NO: 50803 - protein, 11 aa, Homo sapiens
LVGGDNLCSGR

SEQ ID NO: 50804 - protein, 7 aa, Homo sapiens
LVGGLHR

SEQ ID NO: 50805 - protein, 20 aa, Homo sapiens
NTCNHDEDTWVECEDPFDLR

SEQ ID NO: 50806 - protein, 13 aa, Homo sapiens
PESSFSPVPEGVR

SEQ ID NO: 50807 - protein, 6 aa, Homo sapiens
QLGCGR

SEQ ID NO: 50808 - protein, 7 aa, Homo sapiens
SLSPSFR

SEQ ID NO: 50809 - protein, 6 aa, Homo sapiens
VEVEQK

SEQ ID NO: 50810 - protein, 10 aa, Homo sapiens
NNANVTWWRV

SEQ ID NO: 50811 - protein, 32 aa, Homo sapiens
RVLHGNYTWPPEFLGPGEDPNGTLIIQNVNKS

SEQ ID NO: 50812 - protein, 26 aa, Homo sapiens
GHFIYKNVSEDLPLPTFSPTLLGDSR

SEQ ID NO: 50813 - protein, 15 aa, Homo sapiens
GVSLFDIINPEIITR

SEQ ID NO: 50814 - protein, 11 aa, Homo sapiens
GVVVNSSVMVK

SEQ ID NO: 50815 - protein, 28 aa, Homo sapiens
KGHFIYKNVSEDLPLPTFSPTLLGDSRM

SEQ ID NO: 50816 - protein, 13 aa, Homo sapiens
KGVVVNSSVMVKF

SEQ ID NO: 50817 - protein, 22 aa, Homo sapiens
KNVSEDLPLPTFSPTLLGDSRM

SEQ ID NO: 50818 - protein, 34 aa, Homo sapiens
KTVSNLTESSSESIQSFLQSMITAVGIPEVMSRL

SEQ ID NO: 50819 - protein, 32 aa, Homo sapiens
TVSNLTESSSESIQSFLQSMITAVGIPEVMSR

SEQ ID NO: 50820 - protein, 9 aa, Homo sapiens
CAGQQQDIR

SEQ ID NO: 50821 - protein, 13 aa, Homo sapiens
CSAPEPSQKPPGK

SEQ ID NO: 50822 - protein, 23 aa, Homo sapiens
CSAPEPSQKPPGKPCPGLAYEQR

SEQ ID NO: 50823 - protein, 11 aa, Homo sapiens
CVGWNGQCSGK

SEQ ID NO: 50824 - protein, 22 aa, Homo sapiens
GLLGGGVSVEDCCLNTAFAYQK

SEQ ID NO: 50825 - protein, 11 aa, Homo sapiens
HCYSIQHCPLK

SEQ ID NO: 50826 - protein, 13 aa, Homo sapiens
KNVTFWGRPLPRC

SEQ ID NO: 50827 - protein, 27 aa, Homo sapiens
KYPPTVSMVEGQGEKNVTFWGRPLPRC

SEQ ID NO: 50828 - protein, 8 aa, Homo sapiens
LCTPLLPK

SEQ ID NO: 50829 - protein, 16 aa, Homo sapiens
NMKSISCQEIPGQQSR

SEQ ID NO: 50830 - protein, 10 aa, Homo sapiens
RPCLHVPACK

SEQ ID NO: 50831 - protein, 17 aa, Homo sapiens
RPCLHVPACKDPEEEEL

SEQ ID NO: 50832 - protein, 13 aa, Homo sapiens
SISCQEIPGQQSR

SEQ ID NO: 50833 - protein, 20 aa, Homo sapiens
TCNHPVPQHGGPFCAGDATR

SEQ ID NO: 50834 - protein, 14 aa, Homo sapiens
YPPTVSMVEGQGEK

SEQ ID NO: 50835 - protein, 21 aa, Homo sapiens
YPPTVSMVEGQGEKNVTFWGR

SEQ ID NO: 50836 - protein, 25 aa, Homo sapiens
YPPTVSMVEGQGEKNVTFWGRPLPR

SEQ ID NO: 50837 - protein, 12 aa, Homo sapiens
QLMSNMNISNKI

SEQ ID NO: 50838 - protein, 19 aa, Homo sapiens
RNISLQLMSNMNISNKIRN

SEQ ID NO: 50839 - protein, 27 aa, Homo sapiens
RVYSLPGRENYSSVDANGIQSQMLSRW

SEQ ID NO: 50840 - protein, 15 aa, Homo sapiens
KEAPYFYNDTVTFKC

SEQ ID NO: 50841 - protein, 15 aa, Homo sapiens
KTPNGNHTGGNIARF

SEQ ID NO: 50842 - protein, 23 aa, Homo sapiens
AGESVLVHGASGGVGLAACQIAR

SEQ ID NO: 50843 - protein, 9 aa, Homo sapiens
ALIHSACVK

SEQ ID NO: 50844 - protein, 14 aa, Homo sapiens
IVLQNGAHEVFNHR

SEQ ID NO: 50845 - protein, 20 aa, Homo sapiens
KGIDIIIEMLANVNLSKDLS

SEQ ID NO: 50846 - protein, 27 aa, Homo sapiens
KPLLPYTPGSDVAGVIEAVGDNASAFK

SEQ ID NO: 50847 - protein, 11 aa, Homo sapiens
VFEFGGPEVLK

SEQ ID NO: 50848 - protein, 14 aa, Homo sapiens
VHACGVNPVETYIR

SEQ ID NO: 50849 - protein, 14 aa, Homo sapiens
DSILSEMKMLKEKR

SEQ ID NO: 50850 - protein, 13 aa, Homo sapiens
ELKSLDQAINDKK

SEQ ID NO: 50851 - protein, 14 aa, Homo sapiens
KALDQFVNFSEQKE

SEQ ID NO: 50852 - protein, 9 aa, Homo sapiens
KDQYFLDKK

SEQ ID NO: 50853 - protein, 11 aa, Homo sapiens
KLEQCNTELKK

SEQ ID NO: 50854 - protein, 14 aa, Homo sapiens
KRLDQVEQELNELR

SEQ ID NO: 50855 - protein, 11 aa, Homo sapiens
LDQDLNEVKAR

SEQ ID NO: 50856 - protein, 7 aa, Homo sapiens
LEGIITR

SEQ ID NO: 50857 - protein, 16 aa, Homo sapiens
LHTLEEEKEELAQYQK

SEQ ID NO: 50858 - protein, 21 aa, Homo sapiens
RFSSFVPVTIPHATTANTSVL

SEQ ID NO: 50859 - protein, 25 aa, Homo sapiens
QIEELLELLMTEILHPSSQAPNGVK

SEQ ID NO: 50860 - protein, 13 aa, Homo sapiens
SHFIEIFLEELTK

SEQ ID NO: 50861 - protein, 19 aa, Homo sapiens
MNISLAFFLYDLLSLMDRG

SEQ ID NO: 50862 - protein, 15 aa, Homo sapiens
AEDNFEDIITKPPVR

SEQ ID NO: 50863 - protein, 19 aa, Homo sapiens
AGATSEGVLANFFNSLLSK

SEQ ID NO: 50864 - protein, 12 aa, Homo sapiens
DEHFDFFQSHIR

SEQ ID NO: 50865 - protein, 18 aa, Homo sapiens
DFQEYVEPGEDFPASPQR

SEQ ID NO: 50866 - protein, 30 aa, Homo sapiens
RVPGGSPRTPNRSVSSNVASVSPIPAGSKK

SEQ ID NO: 50867 - protein, 17 aa, Homo sapiens
SVSSNVASVSPIPAGSK

SEQ ID NO: 50868 - protein, 30 aa, Homo sapiens
TGSPGGPGVSGGSPAGGAGGGSSGLPPSTK

SEQ ID NO: 50869 - protein, 25 aa, Homo sapiens
GIPLATGDTSPEPELLPGAPLPPPK

SEQ ID NO: 50870 - protein, 31 aa, Homo sapiens
PTGDFDSKPSWADQVEEEGEDDKCVTSELLK

SEQ ID NO: 50871 - protein, 16 aa, Homo sapiens
ANQGDEACTHCPINSR

SEQ ID NO: 50872 - protein, 15 aa, Homo sapiens
DSGGREDLVYNIICK

SEQ ID NO: 50873 - protein, 13 aa, Homo sapiens
KELSEYNATAIKS

SEQ ID NO: 50874 - protein, 11 aa, Homo sapiens
NILVNSNLVCK

SEQ ID NO: 50875 - protein, 20 aa, Homo sapiens
SGFYLAFQDYGGCMSLIAVR

SEQ ID NO: 50876 - protein, 15 aa, Homo sapiens
DFIDDLADLSCLVYR

SEQ ID NO: 50877 - protein, 31 aa, Homo sapiens
MNPNSPSITYDISQLFDFIDDLADLSCLVYR

SEQ ID NO: 50878 - protein, 27 aa, Homo sapiens
SPSITYDISQLFDFIDDLADLSCLVYR

SEQ ID NO: 50879 - protein, 17 aa, Homo sapiens
TYADYESVNECMEGVCK

SEQ ID NO: 50880 - protein, 13 aa, Homo sapiens
RVLEAVNGTDARL

SEQ ID NO: 50881 - protein, 33 aa, Homo sapiens
LTCADTTAALLTSHLLQSEIGDYDETLDREHLK

SEQ ID NO: 50882 - protein, 30 aa, Homo sapiens
SGAVAGGPDTPSAQPLGPPALQPGPGLSTK

SEQ ID NO: 50883 - protein, 14 aa, Homo sapiens
VNEYLPGQQHCLEK

SEQ ID NO: 50884 - protein, 29 aa, Homo sapiens
KQRMEPLYSLNVSVSDGLFTSTAQVHIRV

SEQ ID NO: 50885 - protein, 31 aa, Homo sapiens
KAVSLSVTVPVSHPVLNLSSPEDLIFEGAKV

SEQ ID NO: 50886 - protein, 19 aa, Homo sapiens
MLQDDNTSAGLHFMASVKK

SEQ ID NO: 50887 - protein, 24 aa, Homo sapiens
RFPPPVGYNKDINESDEVEVYSRA

SEQ ID NO: 50888 - protein, 19 aa, Homo sapiens
KFNSTQIAAMAPEHEEPRI

SEQ ID NO: 50889 - protein, 16 aa, Homo sapiens
KTGVNSGVMLMNMTRM

SEQ ID NO: 50890 - protein, 15 aa, Homo sapiens
IQIPGIMNDEKFNLK

SEQ ID NO: 50891 - protein, 23 aa, Homo sapiens
KGDVSLTIENVTLADSGIYCCRI

SEQ ID NO: 50892 - protein, 12 aa, Homo sapiens
TDERDVNYWTSR

SEQ ID NO: 50893 - protein, 17 aa, Homo sapiens
YTCHVQHEGLPEPVTLR

SEQ ID NO: 50894 - protein, 26 aa, Homo sapiens
EEIVQFFSGLEIVPNGITLPVDFQGR

SEQ ID NO: 50895 - protein, 13 aa, Homo sapiens
GLPWSCSADEVQR

SEQ ID NO: 50896 - protein, 14 aa, Homo sapiens
YGDGGSTFQSTTGH

SEQ ID NO: 50897 - protein, 17 aa, Homo sapiens
YGDGGSTFQSTTGHCVH

SEQ ID NO: 50898 - protein, 19 aa, Homo sapiens
YGDGGSTFQSTTGHCVHMR

SEQ ID NO: 50899 - protein, 20 aa, Homo sapiens
YVELFLNSTAGASGGAYEHR

SEQ ID NO: 50900 - protein, 12 aa, Homo sapiens
ARFEELNADLFR

SEQ ID NO: 50901 - protein, 20 aa, Homo sapiens
AVGIDLGTTYSCVGVFQHGK

SEQ ID NO: 50902 - protein, 10 aa, Homo sapiens
CNEIINWLDK

SEQ ID NO: 50903 - protein, 12 aa, Homo sapiens
DAGTIAGLNVLR

SEQ ID NO: 50904 - protein, 9 aa, Homo sapiens
EIAEAYLGK

SEQ ID NO: 50905 - protein, 10 aa, Homo sapiens
FEELNADLFR

SEQ ID NO: 50906 - protein, 22 aa, Homo sapiens
GPAVGIDLGTTYSCVGVFQHGK

SEQ ID NO: 50907 - protein, 24 aa, Homo sapiens
GVPQIEVTFDIDANGILNVSAVDK

SEQ ID NO: 50908 - protein, 14 aa, Homo sapiens
HWPFMVVNDAGRPK

SEQ ID NO: 50909 - protein, 20 aa, Homo sapiens
KTVTNAVVTVPAYFNDSQRQ

SEQ ID NO: 50910 - protein, 23 aa, Homo sapiens
LIGDAAKNQVAMNPTNTVFDAKR

SEQ ID NO: 50911 - protein, 9 aa, Homo sapiens
LLQDFFNGK

SEQ ID NO: 50912 - protein, 8 aa, Homo sapiens
LSKEDIER

SEQ ID NO: 50913 - protein, 11 aa, Homo sapiens
MKEIAEAYLGK

SEQ ID NO: 50914 - protein, 10 aa, Homo sapiens
MVNHFIAEFK

SEQ ID NO: 50915 - protein, 15 aa, Homo sapiens
NQVAMNPTNTVFDAK

SEQ ID NO: 50916 - protein, 16 aa, Homo sapiens
NQVAMNPTNTVFDAKR

SEQ ID NO: 50917 - protein, 11 aa, Homo sapiens
NSLESYAFNMK

SEQ ID NO: 50918 - protein, 24 aa, Homo sapiens
QTQTFTTYSDNQPGVLIQVYEGER

SEQ ID NO: 50919 - protein, 12 aa, Homo sapiens
RFDDAVVQSDMK

SEQ ID NO: 50920 - protein, 26 aa, Homo sapiens
RGVPQIEVTFDIDANGILNVSAVDKS

SEQ ID NO: 50921 - protein, 31 aa, Homo sapiens
SENVQDLLLLDVTPLSLGIETAGGVMTVLIK

SEQ ID NO: 50922 - protein, 14 aa, Homo sapiens
SFYPEEVSSMVLTK

SEQ ID NO: 50923 - protein, 23 aa, Homo sapiens
SINPDEAVAYGAAVQAAILSGDK

SEQ ID NO: 50924 - protein, 14 aa, Homo sapiens
SQIHDIVLVGGSTR

SEQ ID NO: 50925 - protein, 16 aa, Homo sapiens
STAGDTHLGGEDFDNR

SEQ ID NO: 50926 - protein, 27 aa, Homo sapiens
TLSSSTQASIEIDSLYEGIDFYTSITR

SEQ ID NO: 50927 - protein, 18 aa, Homo sapiens
TVTNAVVTVPAYFNDSQR

SEQ ID NO: 50928 - protein, 8 aa, Homo sapiens
VCNPIITK

SEQ ID NO: 50929 - protein, 10 aa, Homo sapiens
VQVEYKGETK

SEQ ID NO: 50930 - protein, 22 aa, Homo sapiens
RLYNAEQVLSWEPVALSNSTRP

SEQ ID NO: 50931 - protein, 24 aa, Homo sapiens
RNVTVGPPENIEVTPGEGSLIIRF

SEQ ID NO: 50932 - protein, 14 aa, Homo sapiens
RIYNVTYLEPSLRI

SEQ ID NO: 50933 - protein, 36 aa, Homo sapiens
KNKISIEDLLQSSMGSTQQAQNTTSSLMNLVMQFRK

SEQ ID NO: 50934 - protein, 25 aa, Homo sapiens
DATNPSVPLDPISVSNSSSQIILKW

SEQ ID NO: 50935 - protein, 14 aa, Homo sapiens
KELGLYNLMNITRG

SEQ ID NO: 50936 - protein, 22 aa, Homo sapiens
RGETLEIGNYSFYALDNQNLRQ

SEQ ID NO: 50937 - protein, 12 aa, Homo sapiens
RGLSPGNYSVRI

SEQ ID NO: 50938 - protein, 15 aa, Homo sapiens
GLGSTVQEIDLTGVK

SEQ ID NO: 50939 - protein, 13 aa, Homo sapiens
FHVDISLTDFIQK

SEQ ID NO: 50940 - protein, 19 aa, Homo sapiens
KGELSIIPYEITLLSPCLH

SEQ ID NO: 50941 - protein, 14 aa, Homo sapiens
LPETNLFETEETRK

SEQ ID NO: 50942 - protein, 13 aa, Homo sapiens
RGDIIGVQGNPGK

SEQ ID NO: 50943 - protein, 8 aa, Homo sapiens
SQAIHQLK

SEQ ID NO: 50944 - protein, 22 aa, Homo sapiens
VTYHPDGPEGQAYDVDFTPPFR

SEQ ID NO: 50945 - protein, 16 aa, Homo sapiens
YSHLQPGDHLTDITLK

SEQ ID NO: 50946 - protein, 20 aa, Homo sapiens
KMGDLYYYGHQNQSQDLELS

SEQ ID NO: 50947 - protein, 35 aa, Homo sapiens
NPDASYNLGVLHLDGIFPGVPGRNQTLAGEIFHKA

SEQ ID NO: 50948 - protein, 33 aa, Homo sapiens
REDFHYNDTAGYFIIGGSRYVAGIEGFFGPLKY

SEQ ID NO: 50949 - protein, 18 aa, Homo sapiens
DYQVTLQIPAANLSANRK

SEQ ID NO: 50950 - protein, 22 aa, Homo sapiens
KCVVEMEGNQTVLHPPPSNTKQ

SEQ ID NO: 50951 - protein, 11 aa, Homo sapiens
DVSSSVYSTWK

SEQ ID NO: 50952 - protein, 10 aa, Homo sapiens
KSENESNIRY

SEQ ID NO: 50953 - protein, 13 aa, Homo sapiens
LVVQSSIDSSAFK

SEQ ID NO: 50954 - protein, 37 aa, Homo sapiens
RCSASVLPVDVQTLNSSGPPFGKLVVQSSIDSSAFKH

SEQ ID NO: 50955 - protein, 15 aa, Homo sapiens
RSLYGKEDNDTLVRC

SEQ ID NO: 50956 - protein, 31 aa, Homo sapiens
RVNDSGVFMCYANNTFGSANVTTTLEVVDKG

SEQ ID NO: 50957 - protein, 13 aa, Homo sapiens
SLYGKEDNDTLVR

SEQ ID NO: 50958 - protein, 19 aa, Homo sapiens
TFTDKWEDYPKSENESNIR

SEQ ID NO: 50959 - protein, 9 aa, Homo sapiens
YVSELHLTR

SEQ ID NO: 50960 - protein, 12 aa, Homo sapiens
AHVQEVAQHNLK

SEQ ID NO: 50961 - protein, 29 aa, Homo sapiens
KETMSVSLNQTVTQLQQLLQAVNQQLTKE

SEQ ID NO: 50962 - protein, 21 aa, Homo sapiens
QPTPPSEAAASKKKPGQKKSK

SEQ ID NO: 50963 - protein, 18 aa, Homo sapiens
VSVPSNLSYGEWLHGFEK

SEQ ID NO: 50964 - protein, 15 aa, Homo sapiens
RTDANESSSSPEIRD

SEQ ID NO: 50965 - protein, 14 aa, Homo sapiens
CVVVDVSHEDPEVK

SEQ ID NO: 50966 - protein, 26 aa, Homo sapiens
DTLMISRTPEVTCVVVDVSHEDPEVK

SEQ ID NO: 50967 - protein, 17 aa, Homo sapiens
EVTCVVVDVSHEDPEVK

SEQ ID NO: 50968 - protein, 11 aa, Homo sapiens
FNWYVDGVEVH

SEQ ID NO: 50969 - protein, 12 aa, Homo sapiens
FNWYVDGVEVHN

SEQ ID NO: 50970 - protein, 13 aa, Homo sapiens
FNWYVDGVEVHNA

SEQ ID NO: 50971 - protein, 14 aa, Homo sapiens
FNWYVDGVEVHNAK

SEQ ID NO: 50972 - protein, 13 aa, Homo sapiens
GGPSVFLFPPKPK

SEQ ID NO: 50973 - protein, 10 aa, Homo sapiens
GTAALGCLVK

SEQ ID NO: 50974 - protein, 13 aa, Homo sapiens
NWYVDGVEVHNAK

SEQ ID NO: 50975 - protein, 18 aa, Homo sapiens
PEVTCVVVDVSHEDPEVK

SEQ ID NO: 50976 - protein, 15 aa, Homo sapiens
PPMLDSNGSFFLYSK

SEQ ID NO: 50977 - protein, 16 aa, Homo sapiens
SLSSVVTVPSSSLGTQ

SEQ ID NO: 50978 - protein, 15 aa, Homo sapiens
TCVVVDVSHEDPEVK

SEQ ID NO: 50979 - protein, 19 aa, Homo sapiens
TPEVTCVVVDVSHEDPEVK

SEQ ID NO: 50980 - protein, 33 aa, Homo sapiens
TPEVTCVVVDVSHEDPEVKFNWYVDGVEVHNAK

SEQ ID NO: 50981 - protein, 17 aa, Homo sapiens
TTPPMLDSNGSFFLYSK

SEQ ID NO: 50982 - protein, 10 aa, Homo sapiens
VDGVEVHNAK

SEQ ID NO: 50983 - protein, 16 aa, Homo sapiens
VTCVVVDVSHEDPEVK

SEQ ID NO: 50984 - protein, 13 aa, Homo sapiens
VVVDVSHEDPEVK

SEQ ID NO: 50985 - protein, 18 aa, Homo sapiens
WQEGNVFSCSVMHEALHN

SEQ ID NO: 50986 - protein, 23 aa, Homo sapiens
WQEGNVFSCSVMHEALHNHYTQK

SEQ ID NO: 50987 - protein, 9 aa, Homo sapiens
WYVDGVEVH

SEQ ID NO: 50988 - protein, 10 aa, Homo sapiens
WYVDGVEVHN

SEQ ID NO: 50989 - protein, 12 aa, Homo sapiens
WYVDGVEVHNAK

SEQ ID NO: 50990 - protein, 11 aa, Homo sapiens
YVDGVEVHNAK

SEQ ID NO: 50991 - protein, 11 aa, Homo sapiens
AKGQPREPQVY

SEQ ID NO: 50992 - protein, 20 aa, Homo sapiens
CPAPEFLGGPSVFLFPPKPK

SEQ ID NO: 50993 - protein, 9 aa, Homo sapiens
EEQFNSTYR

SEQ ID NO: 50994 - protein, 11 aa, Homo sapiens
EEQFNSTYRVV

SEQ ID NO: 50995 - protein, 16 aa, Homo sapiens
EPQVYTLPPSQEEMTK

SEQ ID NO: 50996 - protein, 18 aa, Homo sapiens
FNWYVDGVEVHNAKTKPR

SEQ ID NO: 50997 - protein, 8 aa, Homo sapiens
GLPSSIEK

SEQ ID NO: 50998 - protein, 12 aa, Homo sapiens
GLPSSIEKTISK

SEQ ID NO: 50999 - protein, 14 aa, Homo sapiens
GLPSSIEKTISKAK

SEQ ID NO: 51000 - protein, 30 aa, Homo sapiens
GQPREPQVYTLPPSQEEMTKNQVSLTCLVK

SEQ ID NO: 51001 - protein, 12 aa, Homo sapiens
LTVLHQDWLNGK

SEQ ID NO: 51002 - protein, 15 aa, Homo sapiens
LTVLHQDWLNGKEYK

SEQ ID NO: 51003 - protein, 24 aa, Homo sapiens
NSTYRVVSVLTVLHQDWLNGKEYK

SEQ ID NO: 51004 - protein, 19 aa, Homo sapiens
PAPEFLGGPSVFLFPPKPK

SEQ ID NO: 51005 - protein, 24 aa, Homo sapiens
PCPSCPAPEFLGGPSVFLFPPKPK

SEQ ID NO: 51006 - protein, 25 aa, Homo sapiens
PPCPSCPAPEFLGGPSVFLFPPKPK

SEQ ID NO: 51007 - protein, 9 aa, Homo sapiens
PPSQEEMTK

SEQ ID NO: 51008 - protein, 15 aa, Homo sapiens
PPVLDSDGSFFLYSR

SEQ ID NO: 51009 - protein, 11 aa, Homo sapiens
PREEQFNSTYR

SEQ ID NO: 51010 - protein, 22 aa, Homo sapiens
PSCPAPEFLGGPSVFLFPPKPK

SEQ ID NO: 51011 - protein, 7 aa, Homo sapiens
QFNSTYR

SEQ ID NO: 51012 - protein, 10 aa, Homo sapiens
REEQFNSTYR

SEQ ID NO: 51013 - protein, 11 aa, Homo sapiens
REEQFNSTYRV

SEQ ID NO: 51014 - protein, 7 aa, Homo sapiens
SFFLYSR

SEQ ID NO: 51015 - protein, 37 aa, Homo sapiens
SGALTSGVHTFPAVLQSSGLYSLSSVVTVPSSSLGTK

SEQ ID NO: 51016 - protein, 14 aa, Homo sapiens
SVLTVLHQDWLNGK

SEQ ID NO: 51017 - protein, 17 aa, Homo sapiens
SVLTVLHQDWLNGKEYK

SEQ ID NO: 51018 - protein, 28 aa, Homo sapiens
TFPAVLQSSGLYSLSSVVTVPSSSLGTK

SEQ ID NO: 51019 - protein, 10 aa, Homo sapiens
TISKAKGQPR

SEQ ID NO: 51020 - protein, 13 aa, Homo sapiens
TKPREEQFNSTYR

SEQ ID NO: 51021 - protein, 30 aa, Homo sapiens
TPEVTCVVVDVSQEDPEVQFNWYVDGVEVH

SEQ ID NO: 51022 - protein, 33 aa, Homo sapiens
TPEVTCVVVDVSQEDPEVQFNWYVDGVEVHNAK

SEQ ID NO: 51023 - protein, 12 aa, Homo sapiens
TTPPVLDSDGSF

SEQ ID NO: 51024 - protein, 13 aa, Homo sapiens
TTPPVLDSDGSFF

SEQ ID NO: 51025 - protein, 14 aa, Homo sapiens
TTPPVLDSDGSFFL

SEQ ID NO: 51026 - protein, 15 aa, Homo sapiens
TTPPVLDSDGSFFLY

SEQ ID NO: 51027 - protein, 17 aa, Homo sapiens
TTPPVLDSDGSFFLYSR

SEQ ID NO: 51028 - protein, 11 aa, Homo sapiens
TVLHQDWLNGK

SEQ ID NO: 51029 - protein, 14 aa, Homo sapiens
TVLHQDWLNGKEYK

SEQ ID NO: 51030 - protein, 22 aa, Homo sapiens
TYTCNVDHKPSNTKVDKRVESK

SEQ ID NO: 51031 - protein, 31 aa, Homo sapiens
VESKYGPPCPSCPAPEFLGGPSVFLFPPKPK

SEQ ID NO: 51032 - protein, 10 aa, Homo sapiens
VLHQDWLNGK

SEQ ID NO: 51033 - protein, 13 aa, Homo sapiens
VLTVLHQDWLNGK

SEQ ID NO: 51034 - protein, 12 aa, Homo sapiens
VSNKGLPSSIEK

SEQ ID NO: 51035 - protein, 16 aa, Homo sapiens
VSNKGLPSSIEKTISK

SEQ ID NO: 51036 - protein, 15 aa, Homo sapiens
VSVLTVLHQDWLNGK

SEQ ID NO: 51037 - protein, 11 aa, Homo sapiens
VVSVLTVLHQD

SEQ ID NO: 51038 - protein, 16 aa, Homo sapiens
VVSVLTVLHQDWLNGK

SEQ ID NO: 51039 - protein, 19 aa, Homo sapiens
VVSVLTVLHQDWLNGKEYK

SEQ ID NO: 51040 - protein, 21 aa, Homo sapiens
VVSVLTVLHQDWLNGKEYKCK

SEQ ID NO: 51041 - protein, 20 aa, Homo sapiens
YGPPCPSCPAPEFLGGPSVF

SEQ ID NO: 51042 - protein, 25 aa, Homo sapiens
YGPPCPSCPAPEFLGGPSVFLFPPK

SEQ ID NO: 51043 - protein, 27 aa, Homo sapiens
YGPPCPSCPAPEFLGGPSVFLFPPKPK

SEQ ID NO: 51044 - protein, 21 aa, Homo sapiens
GLEWIGEINHSGSTNYNPSLK

SEQ ID NO: 51045 - protein, 12 aa, Homo sapiens
HSGSTNYNPSLK

SEQ ID NO: 51046 - protein, 14 aa, Homo sapiens
INHSGSTNYNPSLK

SEQ ID NO: 51047 - protein, 23 aa, Homo sapiens
KGLEWIGEINHSGSTNYNPSLKS

SEQ ID NO: 51048 - protein, 16 aa, Homo sapiens
LSSVTAADTAVYYCAR

SEQ ID NO: 51049 - protein, 17 aa, Homo sapiens
LSSVTAADTAVYYCARG

SEQ ID NO: 51050 - protein, 6 aa, Homo sapiens
NQFSLK

SEQ ID NO: 51051 - protein, 22 aa, Homo sapiens
NQFSLKLSSVTAADTAVYYCAR

SEQ ID NO: 51052 - protein, 11 aa, Homo sapiens
SRVTISVDTSK

SEQ ID NO: 51053 - protein, 14 aa, Homo sapiens
SVTAADTAVYYCAR

SEQ ID NO: 51054 - protein, 9 aa, Homo sapiens
VTISVDTSK

SEQ ID NO: 51055 - protein, 15 aa, Homo sapiens
VTISVDTSKNQFSLK

SEQ ID NO: 51056 - protein, 26 aa, Homo sapiens
ATAAVIFLHGLGDTGHGWAEAFAGIR

SEQ ID NO: 51057 - protein, 26 aa, Homo sapiens
DISILQCHGDCDPLVPLMFGSLTVEK

SEQ ID NO: 51058 - protein, 18 aa, Homo sapiens
GNNMSTPLPAIVPAARKA

SEQ ID NO: 51059 - protein, 27 aa, Homo sapiens
KATAAVIFLHGLGDTGHGWAEAFAGIR

SEQ ID NO: 51060 - protein, 13 aa, Homo sapiens
YICPHAPVRPVTL

SEQ ID NO: 51061 - protein, 14 aa, Homo sapiens
YICPHAPVRPVTLN

SEQ ID NO: 51062 - protein, 27 aa, Homo sapiens
KCRLDVNTELNSSIEDLLEASMPSSDT

SEQ ID NO: 51063 - protein, 14 aa, Homo sapiens
GDLTIANLGTSEGR

SEQ ID NO: 51064 - protein, 29 aa, Homo sapiens
MVSNESVDYRATFPEDQFPNSSQNGSCRQ

SEQ ID NO: 51065 - protein, 18 aa, Homo sapiens
RHVFPHNHTADIQSEVHC

SEQ ID NO: 51066 - protein, 22 aa, Homo sapiens
SCENIHLHSEAVLCTVPNDLLK

SEQ ID NO: 51067 - protein, 23 aa, Homo sapiens
SVSNSILECYTPAQTISTEFAVK

SEQ ID NO: 51068 - protein, 20 aa, Homo sapiens
AGKPTHVNVSVVMAEVDGTC

SEQ ID NO: 51069 - protein, 21 aa, Homo sapiens
AGKPTHVNVSVVMAEVDGTCY

SEQ ID NO: 51070 - protein, 11 aa, Homo sapiens
ANLTCTLTGLR

SEQ ID NO: 51071 - protein, 14 aa, Homo sapiens
ASGVTFTWTPSSGK

SEQ ID NO: 51072 - protein, 20 aa, Homo sapiens
ASRQEPSQGTTTFAVTSILR

SEQ ID NO: 51073 - protein, 21 aa, Homo sapiens
CGCYSVSSVLPGCAEPWNHGK

SEQ ID NO: 51074 - protein, 15 aa, Homo sapiens
CMVGHEALPLAFTQK

SEQ ID NO: 51075 - protein, 7 aa, Homo sapiens
CTLTGLR

SEQ ID NO: 51076 - protein, 15 aa, Homo sapiens
DASGVTFTWTPSSGK

SEQ ID NO: 51077 - protein, 24 aa, Homo sapiens
DASGVTFTWTPSSGKSAVQGPPER

SEQ ID NO: 51078 - protein, 23 aa, Homo sapiens
DLCGCYSVSSVLPGCAEPWNHGK

SEQ ID NO: 51079 - protein, 35 aa, Homo sapiens
DLCGCYSVSSVLPGCAEPWNHGKTFTCTAAYPESK

SEQ ID NO: 51080 - protein, 19 aa, Homo sapiens
DTFSCMVGHEALPLAFTQK

SEQ ID NO: 51081 - protein, 15 aa, Homo sapiens
DVLVRWLQGSQELPR

SEQ ID NO: 51082 - protein, 17 aa, Homo sapiens
DVLVRWLQGSQELPREK

SEQ ID NO: 51083 - protein, 10 aa, Homo sapiens
EALPLAFTQK

SEQ ID NO: 51084 - protein, 12 aa, Homo sapiens
EANLTCTLTGLR

SEQ ID NO: 51085 - protein, 19 aa, Homo sapiens
EDLLLGSEANLTCTLTGLR

SEQ ID NO: 51086 - protein, 16 aa, Homo sapiens
EELALNELVTLTCLAR

SEQ ID NO: 51087 - protein, 9 aa, Homo sapiens
EKYLTWASR

SEQ ID NO: 51088 - protein, 26 aa, Homo sapiens
EKYLTWASRQEPSQGTTTFAVTSILR

SEQ ID NO: 51089 - protein, 16 aa, Homo sapiens
EPSQGTTTFAVTSILR

SEQ ID NO: 51090 - protein, 8 aa, Homo sapiens
FAVTSILR

SEQ ID NO: 51091 - protein, 17 aa, Homo sapiens
FSCMVGHEALPLAFTQK

SEQ ID NO: 51092 - protein, 20 aa, Homo sapiens
GCYSVSSVLPGCAEPWNHGK

SEQ ID NO: 51093 - protein, 20 aa, Homo sapiens
GDTFSCMVGHEALPLAFTQK

SEQ ID NO: 51094 - protein, 10 aa, Homo sapiens
GFSPKDVLVR

SEQ ID NO: 51095 - protein, 14 aa, Homo sapiens
GFSPKDVLVRWLQG

SEQ ID NO: 51096 - protein, 20 aa, Homo sapiens
GFSPKDVLVRWLQGSQELPR

SEQ ID NO: 51097 - protein, 22 aa, Homo sapiens
GFSPKDVLVRWLQGSQELPREK

SEQ ID NO: 51098 - protein, 29 aa, Homo sapiens
GFSPKDVLVRWLQGSQELPREKYLTWASR

SEQ ID NO: 51099 - protein, 19 aa, Homo sapiens
GKPTHVNVSVVMAEVDGTC

SEQ ID NO: 51100 - protein, 20 aa, Homo sapiens
GKPTHVNVSVVMAEVDGTCY

SEQ ID NO: 51101 - protein, 14 aa, Homo sapiens
GSEANLTCTLTGLR

SEQ ID NO: 51102 - protein, 12 aa, Homo sapiens
GTTTFAVTSILR

SEQ ID NO: 51103 - protein, 12 aa, Homo sapiens
GVTFTWTPSSGK

SEQ ID NO: 51104 - protein, 11 aa, Homo sapiens
HEALPLAFTQK

SEQ ID NO: 51105 - protein, 24 aa, Homo sapiens
HRPALEDLLLGSEANLTCTLTGLR

SEQ ID NO: 51106 - protein, 12 aa, Homo sapiens
KGDTFSCMVGHE

SEQ ID NO: 51107 - protein, 13 aa, Homo sapiens
KGDTFSCMVGHEA

SEQ ID NO: 51108 - protein, 16 aa, Homo sapiens
KGDTFSCMVGHEALPL

SEQ ID NO: 51109 - protein, 18 aa, Homo sapiens
KGDTFSCMVGHEALPLAF

SEQ ID NO: 51110 - protein, 21 aa, Homo sapiens
KGDTFSCMVGHEALPLAFTQK

SEQ ID NO: 51111 - protein, 25 aa, Homo sapiens
KGDTFSCMVGHEALPLAFTQKTIDR

SEQ ID NO: 51112 - protein, 14 aa, Homo sapiens
KTPLTATLSKSGNT

SEQ ID NO: 51113 - protein, 13 aa, Homo sapiens
LAGKPTHVNVSVV

SEQ ID NO: 51114 - protein, 15 aa, Homo sapiens
LAGKPTHVNVSVVMA

SEQ ID NO: 51115 - protein, 18 aa, Homo sapiens
LAGKPTHVNVSVVMAEVD

SEQ ID NO: 51116 - protein, 19 aa, Homo sapiens
LAGKPTHVNVSVVMAEVDG

SEQ ID NO: 51117 - protein, 20 aa, Homo sapiens
LAGKPTHVNVSVVMAEVDGT

SEQ ID NO: 51118 - protein, 21 aa, Homo sapiens
LAGKPTHVNVSVVMAEVDGTC

SEQ ID NO: 51119 - protein, 22 aa, Homo sapiens
LAGKPTHVNVSVVMAEVDGTCY

SEQ ID NO: 51120 - protein, 15 aa, Homo sapiens
LGSEANLTCTLTGLR

SEQ ID NO: 51121 - protein, 25 aa, Homo sapiens
LHRPALEDLLLGSEANLTCTLTGLR

SEQ ID NO: 51122 - protein, 16 aa, Homo sapiens
LLGSEANLTCTLTGLR

SEQ ID NO: 51123 - protein, 17 aa, Homo sapiens
LLLGSEANLTCTLTGLR

SEQ ID NO: 51124 - protein, 22 aa, Homo sapiens
LLPPPSEELALNELVTLTCLAR

SEQ ID NO: 51125 - protein, 12 aa, Homo sapiens
LPGCAEPWNHGK

SEQ ID NO: 51126 - protein, 21 aa, Homo sapiens
LPPPSEELALNELVTLTCLAR

SEQ ID NO: 51127 - protein, 9 aa, Homo sapiens
LQGSQELPR

SEQ ID NO: 51128 - protein, 10 aa, Homo sapiens
LSLHRPALED

SEQ ID NO: 51129 - protein, 14 aa, Homo sapiens
LSLHRPALEDLLLG

SEQ ID NO: 51130 - protein, 18 aa, Homo sapiens
LSLHRPALEDLLLGSEAN

SEQ ID NO: 51131 - protein, 19 aa, Homo sapiens
LSLHRPALEDLLLGSEANL

SEQ ID NO: 51132 - protein, 20 aa, Homo sapiens
LSLHRPALEDLLLGSEANLT

SEQ ID NO: 51133 - protein, 21 aa, Homo sapiens
LSLHRPALEDLLLGSEANLTC

SEQ ID NO: 51134 - protein, 23 aa, Homo sapiens
LSLHRPALEDLLLGSEANLTCTL

SEQ ID NO: 51135 - protein, 24 aa, Homo sapiens
LSLHRPALEDLLLGSEANLTCTLT

SEQ ID NO: 51136 - protein, 25 aa, Homo sapiens
LSLHRPALEDLLLGSEANLTCTLTG

SEQ ID NO: 51137 - protein, 26 aa, Homo sapiens
LSLHRPALEDLLLGSEANLTCTLTGL

SEQ ID NO: 51138 - protein, 27 aa, Homo sapiens
LSLHRPALEDLLLGSEANLTCTLTGLR

SEQ ID NO: 51139 - protein, 9 aa, Homo sapiens
LTCTLTGLR

SEQ ID NO: 51140 - protein, 14 aa, Homo sapiens
MVGHEALPLAFTQK

SEQ ID NO: 51141 - protein, 10 aa, Homo sapiens
NLTCTLTGLR

SEQ ID NO: 51142 - protein, 22 aa, Homo sapiens
PALEDLLLGSEANLTCTLTGLR

SEQ ID NO: 51143 - protein, 13 aa, Homo sapiens
PESKTPLTATLSK

SEQ ID NO: 51144 - protein, 26 aa, Homo sapiens
PEVHLLPPPSEELALNELVTLTCLAR

SEQ ID NO: 51145 - protein, 11 aa, Homo sapiens
PGCAEPWNHGK

SEQ ID NO: 51146 - protein, 7 aa, Homo sapiens
PKDVLVR

SEQ ID NO: 51147 - protein, 7 aa, Homo sapiens
PLAFTQK

SEQ ID NO: 51148 - protein, 20 aa, Homo sapiens
PPPSEELALNELVTLTCLAR

SEQ ID NO: 51149 - protein, 21 aa, Homo sapiens
PPPSEELALNELVTLTCLARG

SEQ ID NO: 51150 - protein, 19 aa, Homo sapiens
PPSEELALNELVTLTCLAR

SEQ ID NO: 51151 - protein, 15 aa, Homo sapiens
PSQGTTTFAVTSILR

SEQ ID NO: 51152 - protein, 14 aa, Homo sapiens
PSSGKSAVQGPPER

SEQ ID NO: 51153 - protein, 17 aa, Homo sapiens
PTHVNVSVVMAEVDGTC

SEQ ID NO: 51154 - protein, 18 aa, Homo sapiens
PTHVNVSVVMAEVDGTCY

SEQ ID NO: 51155 - protein, 10 aa, Homo sapiens
QEPSQGTTTF

SEQ ID NO: 51156 - protein, 13 aa, Homo sapiens
QEPSQGTTTFAVT

SEQ ID NO: 51157 - protein, 14 aa, Homo sapiens
QEPSQGTTTFAVTS

SEQ ID NO: 51158 - protein, 17 aa, Homo sapiens
QEPSQGTTTFAVTSILR

SEQ ID NO: 51159 - protein, 24 aa, Homo sapiens
RDLCGCYSVSSVLPGCAEPWNHGK

SEQ ID NO: 51160 - protein, 23 aa, Homo sapiens
RLAGKPTHVNVSVVMAEVDGTCY

SEQ ID NO: 51161 - protein, 29 aa, Homo sapiens
RLSLHRPALEDLLLGSEANLTCTLTGLRD

SEQ ID NO: 51162 - protein, 23 aa, Homo sapiens
RPALEDLLLGSEANLTCTLTGLR

SEQ ID NO: 51163 - protein, 24 aa, Homo sapiens
RPALEDLLLGSEANLTCTLTGLRD

SEQ ID NO: 51164 - protein, 9 aa, Homo sapiens
SAVQGPPER

SEQ ID NO: 51165 - protein, 12 aa, Homo sapiens
SAVQGPPERDLC

SEQ ID NO: 51166 - protein, 13 aa, Homo sapiens
SAVQGPPERDLCG

SEQ ID NO: 51167 - protein, 14 aa, Homo sapiens
SAVQGPPERDLCGC

SEQ ID NO: 51168 - protein, 15 aa, Homo sapiens
SAVQGPPERDLCGCY

SEQ ID NO: 51169 - protein, 23 aa, Homo sapiens
SAVQGPPERDLCGCYSVSSVLPG

SEQ ID NO: 51170 - protein, 16 aa, Homo sapiens
SCMVGHEALPLAFTQK

SEQ ID NO: 51171 - protein, 13 aa, Homo sapiens
SEANLTCTLTGLR

SEQ ID NO: 51172 - protein, 17 aa, Homo sapiens
SEELALNELVTLTCLAR

SEQ ID NO: 51173 - protein, 10 aa, Homo sapiens
SGNTFRPEVH

SEQ ID NO: 51174 - protein, 12 aa, Homo sapiens
SGNTFRPEVHLL

SEQ ID NO: 51175 - protein, 27 aa, Homo sapiens
SGNTFRPEVHLLPPPSEELALNELVTL

SEQ ID NO: 51176 - protein, 28 aa, Homo sapiens
SGNTFRPEVHLLPPPSEELALNELVTLT

SEQ ID NO: 51177 - protein, 29 aa, Homo sapiens
SGNTFRPEVHLLPPPSEELALNELVTLTC

SEQ ID NO: 51178 - protein, 30 aa, Homo sapiens
SGNTFRPEVHLLPPPSEELALNELVTLTCL

SEQ ID NO: 51179 - protein, 31 aa, Homo sapiens
SGNTFRPEVHLLPPPSEELALNELVTLTCLA

SEQ ID NO: 51180 - protein, 32 aa, Homo sapiens
SGNTFRPEVHLLPPPSEELALNELVTLTCLAR

SEQ ID NO: 51181 - protein, 33 aa, Homo sapiens
SGNTFRPEVHLLPPPSEELALNELVTLTCLARG

SEQ ID NO: 51182 - protein, 13 aa, Homo sapiens
SGVTFTWTPSSGK

SEQ ID NO: 51183 - protein, 26 aa, Homo sapiens
SLHRPALEDLLLGSEANLTCTLTGLR

SEQ ID NO: 51184 - protein, 8 aa, Homo sapiens
SPKDVLVR

SEQ ID NO: 51185 - protein, 17 aa, Homo sapiens
SVSSVLPGCAEPWNHGK

SEQ ID NO: 51186 - protein, 17 aa, Homo sapiens
TAAYPESKTPLTATLSK

SEQ ID NO: 51187 - protein, 10 aa, Homo sapiens
TCTAAYPESK

SEQ ID NO: 51188 - protein, 8 aa, Homo sapiens
TCTLTGLR

SEQ ID NO: 51189 - protein, 23 aa, Homo sapiens
TCTLTGLRDASGVTFTWTPSSGK

SEQ ID NO: 51190 - protein, 9 aa, Homo sapiens
TFAVTSILR

SEQ ID NO: 51191 - protein, 29 aa, Homo sapiens
TFRPEVHLLPPPSEELALNELVTLTCLAR

SEQ ID NO: 51192 - protein, 18 aa, Homo sapiens
TFSCMVGHEALPLAFTQK

SEQ ID NO: 51193 - protein, 12 aa, Homo sapiens
TFTCTAAYPESK

SEQ ID NO: 51194 - protein, 21 aa, Homo sapiens
TFTCTAAYPESKTPLTATLSK

SEQ ID NO: 51195 - protein, 10 aa, Homo sapiens
TFTWTPSSGK

SEQ ID NO: 51196 - protein, 19 aa, Homo sapiens
TFTWTPSSGKSAVQGPPER

SEQ ID NO: 51197 - protein, 25 aa, Homo sapiens
TIDRLAGKPTHVNVSVVMAEVDGTC

SEQ ID NO: 51198 - protein, 26 aa, Homo sapiens
TIDRLAGKPTHVNVSVVMAEVDGTCY

SEQ ID NO: 51199 - protein, 9 aa, Homo sapiens
TPLTATLSK

SEQ ID NO: 51200 - protein, 12 aa, Homo sapiens
TPLTATLSKSGN

SEQ ID NO: 51201 - protein, 19 aa, Homo sapiens
TPLTATLSKSGNTFRPEVH

SEQ ID NO: 51202 - protein, 15 aa, Homo sapiens
TPSSGKSAVQGPPER

SEQ ID NO: 51203 - protein, 10 aa, Homo sapiens
TTFAVTSILR

SEQ ID NO: 51204 - protein, 11 aa, Homo sapiens
TTTFAVTSILR

SEQ ID NO: 51205 - protein, 7 aa, Homo sapiens
VAAEDWK

SEQ ID NO: 51206 - protein, 8 aa, Homo sapiens
VAAEDWKK

SEQ ID NO: 51207 - protein, 12 aa, Homo sapiens
VAAEDWKKGDTF

SEQ ID NO: 51208 - protein, 28 aa, Homo sapiens
VAAEDWKKGDTFSCMVGHEALPLAFTQK

SEQ ID NO: 51209 - protein, 13 aa, Homo sapiens
VGHEALPLAFTQK

SEQ ID NO: 51210 - protein, 12 aa, Homo sapiens
VRWLQGSQELPR

SEQ ID NO: 51211 - protein, 12 aa, Homo sapiens
VSVVMAEVDGTC

SEQ ID NO: 51212 - protein, 13 aa, Homo sapiens
VSVVMAEVDGTCY

SEQ ID NO: 51213 - protein, 10 aa, Homo sapiens
WLQGSQELPR

SEQ ID NO: 51214 - protein, 12 aa, Homo sapiens
WLQGSQELPREK

SEQ ID NO: 51215 - protein, 19 aa, Homo sapiens
WLQGSQELPREKYLTWASR

SEQ ID NO: 51216 - protein, 7 aa, Homo sapiens
YLTWASR

SEQ ID NO: 51217 - protein, 13 aa, Homo sapiens
YLTWASRQEPSQG

SEQ ID NO: 51218 - protein, 24 aa, Homo sapiens
YLTWASRQEPSQGTTTFAVTSILR

SEQ ID NO: 51219 - protein, 21 aa, Homo sapiens
NFGHNDSTSQMSLNSAAVTKT

SEQ ID NO: 51220 - protein, 23 aa, Homo sapiens
KVLNLVLPNLSLGPIDSSVLSRN

SEQ ID NO: 51221 - protein, 29 aa, Homo sapiens
AFAPGTGVGGDSHFDDDELWTLGEGQVVR

SEQ ID NO: 51222 - protein, 12 aa, Homo sapiens
AFQVWSDVTPLR

SEQ ID NO: 51223 - protein, 15 aa, Homo sapiens
APSPIIKFPGDVAPK

SEQ ID NO: 51224 - protein, 19 aa, Homo sapiens
DKPMGPLLVATFWPELPEK

SEQ ID NO: 51225 - protein, 31 aa, Homo sapiens
DKPMGPLLVATFWPELPEKIDAVYEAPQEEK

SEQ ID NO: 51226 - protein, 15 aa, Homo sapiens
ELAVQYLNTFYGCPK

SEQ ID NO: 51227 - protein, 19 aa, Homo sapiens
FFGLPQTGDLDQNTIETMR

SEQ ID NO: 51228 - protein, 14 aa, Homo sapiens
FQGTSYDSCTTEGR

SEQ ID NO: 51229 - protein, 7 aa, Homo sapiens
GEIFFFK

SEQ ID NO: 51230 - protein, 12 aa, Homo sapiens
IDAVYEAPQEEK

SEQ ID NO: 51231 - protein, 14 aa, Homo sapiens
IHDGEADIMINFGR

SEQ ID NO: 51232 - protein, 19 aa, Homo sapiens
IIGYTPDLDPETVDDAFAR

SEQ ID NO: 51233 - protein, 8 aa, Homo sapiens
KMDPGFPK

SEQ ID NO: 51234 - protein, 29 aa, Homo sapiens
LIADAWNAIPDNLDAVVDLQGGGHSYFFK

SEQ ID NO: 51235 - protein, 13 aa, Homo sapiens
PLTSLGLPPDVQR

SEQ ID NO: 51236 - protein, 12 aa, Homo sapiens
QDIVFDGIAQIR

SEQ ID NO: 51237 - protein, 15 aa, Homo sapiens
SDGFLWCSTTYNFEK

SEQ ID NO: 51238 - protein, 11 aa, Homo sapiens
TYIFAGDKFWR

SEQ ID NO: 51239 - protein, 9 aa, Homo sapiens
VDAAFNWSK

SEQ ID NO: 51240 - protein, 9 aa, Homo sapiens
WDKNQITYR

SEQ ID NO: 51241 - protein, 12 aa, Homo sapiens
WEHGDGYPFDGK

SEQ ID NO: 51242 - protein, 19 aa, Homo sapiens
GVCDQSFGIHVAELANFPK

SEQ ID NO: 51243 - protein, 21 aa, Homo sapiens
HACVEVQDEIAFIPNDVYFEK

SEQ ID NO: 51244 - protein, 25 aa, Homo sapiens
LGLCEFPDNDQFSNLEALLIQIGPK

SEQ ID NO: 51245 - protein, 15 aa, Homo sapiens
HEHEAWPEDLISLTK

SEQ ID NO: 51246 - protein, 37 aa, Homo sapiens
KAVQEDEVGVPGSNSADLLRWTTATTMKVLSNTTTTT

SEQ ID NO: 51247 - protein, 17 aa, Homo sapiens
SLAHLETLSHSFILSLK

SEQ ID NO: 51248 - protein, 30 aa, Homo sapiens
DCFIIYQGHHGDVGAPIADVILPGAAYTEK

SEQ ID NO: 51249 - protein, 6 aa, Homo sapiens
FCYHER

SEQ ID NO: 51250 - protein, 20 aa, Homo sapiens
IASQVAALDLGYKPGVEAIR

SEQ ID NO: 51251 - protein, 17 aa, Homo sapiens
ILQDIASGSHPFSQVLK

SEQ ID NO: 51252 - protein, 19 aa, Homo sapiens
LVNQQLLADPLVPPQLTIK

SEQ ID NO: 51253 - protein, 16 aa, Homo sapiens
NDGAAILAAVSSIAQK

SEQ ID NO: 51254 - protein, 8 aa, Homo sapiens
QQANELSK

SEQ ID NO: 51255 - protein, 22 aa, Homo sapiens
VALIGSPVDLTYTYDHLGDSPK

SEQ ID NO: 51256 - protein, 22 aa, Homo sapiens
VDSDTLCTEEVFPTAGAGTDLR

SEQ ID NO: 51257 - protein, 14 aa, Homo sapiens
VLFLLGADGGCITR

SEQ ID NO: 51258 - protein, 18 aa, Homo sapiens
YDDIEGANYFQQANELSK

SEQ ID NO: 51259 - protein, 26 aa, Homo sapiens
KREEEEEEEGSIMNGSTAEDEEQTRS

SEQ ID NO: 51260 - protein, 12 aa, Homo sapiens
NFEDLEKEREEK

SEQ ID NO: 51261 - protein, 8 aa, Homo sapiens
QRRIEEQK

SEQ ID NO: 51262 - protein, 22 aa, Homo sapiens
RSVRKNLTYSCRSNQDCIINKH

SEQ ID NO: 51263 - protein, 13 aa, Homo sapiens
SPLIATPTFVADK

SEQ ID NO: 51264 - protein, 18 aa, Homo sapiens
TDVQRPQVVEYCVVCGDK

SEQ ID NO: 51265 - protein, 23 aa, Homo sapiens
RGCRNHEHVNVSWCFVCSEGGSL

SEQ ID NO: 51266 - protein, 15 aa, Homo sapiens
ANLVPVPITNATLDR

SEQ ID NO: 51267 - protein, 18 aa, Homo sapiens
ATFFYFTPNKTEDTIFLR

SEQ ID NO: 51268 - protein, 16 aa, Homo sapiens
CANLVPVPITNATLDR

SEQ ID NO: 51269 - protein, 12 aa, Homo sapiens
CEPLEKQHEKER

SEQ ID NO: 51270 - protein, 19 aa, Homo sapiens
CEPLEKQHEKERKQEEGES

SEQ ID NO: 51271 - protein, 12 aa, Homo sapiens
CFYNSSYLNVQR

SEQ ID NO: 51272 - protein, 8 aa, Homo sapiens
DKCEPLEK

SEQ ID NO: 51273 - protein, 12 aa, Homo sapiens
DKCEPLEKQHEK

SEQ ID NO: 51274 - protein, 14 aa, Homo sapiens
DKCEPLEKQHEKER

SEQ ID NO: 51275 - protein, 21 aa, Homo sapiens
DKCEPLEKQHEKERKQEEGES

SEQ ID NO: 51276 - protein, 8 aa, Homo sapiens
EHVAHLLF

SEQ ID NO: 51277 - protein, 10 aa, Homo sapiens
EHVAHLLFLR

SEQ ID NO: 51278 - protein, 13 aa, Homo sapiens
EHVAHLLFLRDTK

SEQ ID NO: 51279 - protein, 21 aa, Homo sapiens
EIQATFFYFTPNKTEDTIFLR

SEQ ID NO: 51280 - protein, 11 aa, Homo sapiens
EQLGEFYEALD

SEQ ID NO: 51281 - protein, 14 aa, Homo sapiens
EQLGEFYEALDCLC

SEQ ID NO: 51282 - protein, 15 aa, Homo sapiens
EQLGEFYEALDCLCI

SEQ ID NO: 51283 - protein, 17 aa, Homo sapiens
EQLGEFYEALDCLCIPR

SEQ ID NO: 51284 - protein, 16 aa, Homo sapiens
FFYFTPNKTEDTIFLR

SEQ ID NO: 51285 - protein, 9 aa, Homo sapiens
FGSYLDDEK

SEQ ID NO: 51286 - protein, 24 aa, Homo sapiens
FGSYLDDEKNWGLSFYADKPETTK

SEQ ID NO: 51287 - protein, 10 aa, Homo sapiens
FYADKPETTK

SEQ ID NO: 51288 - protein, 15 aa, Homo sapiens
FYFTPNKTEDTIFLR

SEQ ID NO: 51289 - protein, 11 aa, Homo sapiens
FYNSSYLNVQR

SEQ ID NO: 51290 - protein, 14 aa, Homo sapiens
GEFYEALDCLCIPR

SEQ ID NO: 51291 - protein, 13 aa, Homo sapiens
GGREHVAHLLFLR

SEQ ID NO: 51292 - protein, 13 aa, Homo sapiens
GLSFYADKPETTK

SEQ ID NO: 51293 - protein, 9 aa, Homo sapiens
HVAHLLFLR

SEQ ID NO: 51294 - protein, 20 aa, Homo sapiens
IQATFFYFTPNKTEDTIFLR

SEQ ID NO: 51295 - protein, 13 aa, Homo sapiens
ITGKWFYIASAFR

SEQ ID NO: 51296 - protein, 9 aa, Homo sapiens
KDKCEPLEK

SEQ ID NO: 51297 - protein, 7 aa, Homo sapiens
KQEEGES

SEQ ID NO: 51298 - protein, 18 aa, Homo sapiens
KSVQEIQATFFYFTPNKT

SEQ ID NO: 51299 - protein, 25 aa, Homo sapiens
LLEAQIPLCANLVPVPITNATLDRI

SEQ ID NO: 51300 - protein, 13 aa, Homo sapiens
LVPVPITNATLDR

SEQ ID NO: 51301 - protein, 10 aa, Homo sapiens
MFGSYLDDEK

SEQ ID NO: 51302 - protein, 25 aa, Homo sapiens
MFGSYLDDEKNWGLSFYADKPETTK

SEQ ID NO: 51303 - protein, 6 aa, Homo sapiens
NEEYNK

SEQ ID NO: 51304 - protein, 30 aa, Homo sapiens
NEEYNKSVQEIQATFFYFTPNKTEDTIFLR

SEQ ID NO: 51305 - protein, 14 aa, Homo sapiens
NLVPVPITNATLDR

SEQ ID NO: 51306 - protein, 14 aa, Homo sapiens
NQCFYNSSYLNVQR

SEQ ID NO: 51307 - protein, 12 aa, Homo sapiens
NVQRENGTVSRY

SEQ ID NO: 51308 - protein, 10 aa, Homo sapiens
NWGLSFYADK

SEQ ID NO: 51309 - protein, 15 aa, Homo sapiens
NWGLSFYADKPETTK

SEQ ID NO: 51310 - protein, 9 aa, Homo sapiens
PITNATLDR

SEQ ID NO: 51311 - protein, 13 aa, Homo sapiens
PITNATLDRITGK

SEQ ID NO: 51312 - protein, 11 aa, Homo sapiens
PNKTEDTIFLR

SEQ ID NO: 51313 - protein, 11 aa, Homo sapiens
PVPITNATLDR

SEQ ID NO: 51314 - protein, 19 aa, Homo sapiens
QATFFYFTPNKTEDTIFLR

SEQ ID NO: 51315 - protein, 22 aa, Homo sapiens
QEIQATFFYFTPNKTEDTIFLR

SEQ ID NO: 51316 - protein, 20 aa, Homo sapiens
QIPLCANLVPVPITNATLDR

SEQ ID NO: 51317 - protein, 15 aa, Homo sapiens
QNQCFYNSSYLNVQR

SEQ ID NO: 51318 - protein, 22 aa, Homo sapiens
QNQCFYNSSYLNVQRENGTVSR

SEQ ID NO: 51319 - protein, 8 aa, Homo sapiens
RNEEYNKS

SEQ ID NO: 51320 - protein, 17 aa, Homo sapiens
RQNQCFYNSSYLNVQRE

SEQ ID NO: 51321 - protein, 24 aa, Homo sapiens
RQNQCFYNSSYLNVQRENGTVSRY

SEQ ID NO: 51322 - protein, 9 aa, Homo sapiens
SDVMYTDWK

SEQ ID NO: 51323 - protein, 10 aa, Homo sapiens
SDVMYTDWKK

SEQ ID NO: 51324 - protein, 12 aa, Homo sapiens
SDVMYTDWKKDK

SEQ ID NO: 51325 - protein, 18 aa, Homo sapiens
SDVMYTDWKKDKCEPLEK

SEQ ID NO: 51326 - protein, 11 aa, Homo sapiens
SFYADKPETTK

SEQ ID NO: 51327 - protein, 10 aa, Homo sapiens
SVQEIQATFF

SEQ ID NO: 51328 - protein, 11 aa, Homo sapiens
SVQEIQATFFY

SEQ ID NO: 51329 - protein, 12 aa, Homo sapiens
SVQEIQATFFYF

SEQ ID NO: 51330 - protein, 16 aa, Homo sapiens
SVQEIQATFFYFTPNK

SEQ ID NO: 51331 - protein, 24 aa, Homo sapiens
SVQEIQATFFYFTPNKTEDTIFLR

SEQ ID NO: 51332 - protein, 22 aa, Homo sapiens
SYLDDEKNWGLSFYADKPETTK

SEQ ID NO: 51333 - protein, 8 aa, Homo sapiens
TEDTIFLR

SEQ ID NO: 51334 - protein, 13 aa, Homo sapiens
TEDTIFLREYQTR

SEQ ID NO: 51335 - protein, 17 aa, Homo sapiens
TFFYFTPNKTEDTIFLR

SEQ ID NO: 51336 - protein, 12 aa, Homo sapiens
TLMFGSYLDDEK

SEQ ID NO: 51337 - protein, 18 aa, Homo sapiens
TLMFGSYLDDEKNWGLSF

SEQ ID NO: 51338 - protein, 19 aa, Homo sapiens
TLMFGSYLDDEKNWGLSFY

SEQ ID NO: 51339 - protein, 27 aa, Homo sapiens
TLMFGSYLDDEKNWGLSFYADKPETTK

SEQ ID NO: 51340 - protein, 11 aa, Homo sapiens
VPITNATLDRI

SEQ ID NO: 51341 - protein, 9 aa, Homo sapiens
WFYIASAFR

SEQ ID NO: 51342 - protein, 15 aa, Homo sapiens
WFYIASAFRNEEYNK

SEQ ID NO: 51343 - protein, 14 aa, Homo sapiens
WGLSFYADKPETTK

SEQ ID NO: 51344 - protein, 9 aa, Homo sapiens
YADKPETTK

SEQ ID NO: 51345 - protein, 15 aa, Homo sapiens
YEGGREHVAHLLFLR

SEQ ID NO: 51346 - protein, 18 aa, Homo sapiens
YEGGREHVAHLLFLRDTK

SEQ ID NO: 51347 - protein, 14 aa, Homo sapiens
YFTPNKTEDTIFLR

SEQ ID NO: 51348 - protein, 10 aa, Homo sapiens
YNSSYLNVQR

SEQ ID NO: 51349 - protein, 14 aa, Homo sapiens
YTDWKKDKCEPLEK

SEQ ID NO: 51350 - protein, 27 aa, Homo sapiens
YTDWKKDKCEPLEKQHEKERKQEEGES

SEQ ID NO: 51351 - protein, 20 aa, Homo sapiens
KNFSSLHTVFCATGGGAYKF

SEQ ID NO: 51352 - protein, 31 aa, Homo sapiens
AFAMIIDKLEEDINSSMTNSTAASRPPVTLR

SEQ ID NO: 51353 - protein, 16 aa, Homo sapiens
AITIAGVPQSVTECVK

SEQ ID NO: 51354 - protein, 22 aa, Homo sapiens
ASTQTTHELTIPNNLIGCIIGR

SEQ ID NO: 51355 - protein, 29 aa, Homo sapiens
GYWASLDASTQTTHELTIPNNLIGCIIGR

SEQ ID NO: 51356 - protein, 11 aa, Homo sapiens
IANPVEGSSGR

SEQ ID NO: 51357 - protein, 13 aa, Homo sapiens
IITLTGPTNAIFK

SEQ ID NO: 51358 - protein, 14 aa, Homo sapiens
LVVPATQCGSLIGK

SEQ ID NO: 51359 - protein, 18 aa, Homo sapiens
MHGGTGFAGIDSSSPEVK

SEQ ID NO: 51360 - protein, 17 aa, Homo sapiens
QICLVMLETLSQSPQGR

SEQ ID NO: 51361 - protein, 21 aa, Homo sapiens
QVTITGSAASISLAQYLINAR

SEQ ID NO: 51362 - protein, 25 aa, Homo sapiens
RTITNVSDEVSSEEGPETGYSLRRH

SEQ ID NO: 51363 - protein, 25 aa, Homo sapiens
YNQSTATTLFHSLPLLRYIFVRERV

SEQ ID NO: 51364 - protein, 15 aa, Homo sapiens
FRGNLSGKRVDFSGR

SEQ ID NO: 51365 - protein, 19 aa, Homo sapiens
LQQQPGCTAEETLEALILK

SEQ ID NO: 51366 - protein, 17 aa, Homo sapiens
RFRGNLSGKRVDFSGRT

SEQ ID NO: 51367 - protein, 20 aa, Homo sapiens
RVLDNIKAVFPCPSEPALSK

SEQ ID NO: 51368 - protein, 32 aa, Homo sapiens
MTNGTLEPAAEWSVLLGVHSQDGPLDGAHTRA

SEQ ID NO: 51369 - protein, 25 aa, Homo sapiens
NASLLIQNVTQEDTGSYTLHIIKRG

SEQ ID NO: 51370 - protein, 8 aa, Homo sapiens
AIAYATHR

SEQ ID NO: 51371 - protein, 11 aa, Homo sapiens
ASAGSYISALR

SEQ ID NO: 51372 - protein, 12 aa, Homo sapiens
FQHGVIAAVDSR

SEQ ID NO: 51373 - protein, 14 aa, Homo sapiens
KGPGLYYVDEHGTR

SEQ ID NO: 51374 - protein, 14 aa, Homo sapiens
VESTDVSDLLHQYR

SEQ ID NO: 51375 - protein, 20 aa, Homo sapiens
APQETYADIGGLDNQIQEIK

SEQ ID NO: 51376 - protein, 14 aa, Homo sapiens
DLLEPGCSVLLNHK

SEQ ID NO: 51377 - protein, 22 aa, Homo sapiens
ESVELPLTHPEYYEEMGIKPPK

SEQ ID NO: 51378 - protein, 11 aa, Homo sapiens
LPLVTPHTQCR

SEQ ID NO: 51379 - protein, 21 aa, Homo sapiens
VAEEHAPSIVFIDEIDAIGTK

SEQ ID NO: 51380 - protein, 20 aa, Homo sapiens
VHAVIGVLMDDTDPLVTVMK

SEQ ID NO: 51381 - protein, 16 aa, Homo sapiens
ACLIFFDEIDAIGGAR

SEQ ID NO: 51382 - protein, 19 aa, Homo sapiens
FVVDLSDQVAPTDIEEGMR

SEQ ID NO: 51383 - protein, 10 aa, Homo sapiens
MPDYLGADQR

SEQ ID NO: 51384 - protein, 15 aa, Homo sapiens
TMLELINQLDGFDPR

SEQ ID NO: 51385 - protein, 21 aa, Homo sapiens
FMLNGALTIGTMDGANVEMAE

SEQ ID NO: 51386 - protein, 31 aa, Homo sapiens
GAGTVFDAFPDQVAIQLNDTHPALAIPELMR

SEQ ID NO: 51387 - protein, 11 aa, Homo sapiens
HLEIIYEINQK

SEQ ID NO: 51388 - protein, 19 aa, Homo sapiens
INMAHLCIVGSHAVNGVAK

SEQ ID NO: 51389 - protein, 12 aa, Homo sapiens
LHSFLGDDVFLR

SEQ ID NO: 51390 - protein, 17 aa, Homo sapiens
LKQEYFVVAATLQDIIR

SEQ ID NO: 51391 - protein, 14 aa, Homo sapiens
SRPEFMLPVHFYGK

SEQ ID NO: 51392 - protein, 16 aa, Homo sapiens
TFAYTNHTVLPEALER

SEQ ID NO: 51393 - protein, 16 aa, Homo sapiens
TPVPGYMNNTVNTMRL

SEQ ID NO: 51394 - protein, 16 aa, Homo sapiens
WLLLCNPGLAELIAEK

SEQ ID NO: 51395 - protein, 13 aa, Homo sapiens
GAVHQLCQSLAGK

SEQ ID NO: 51396 - protein, 17 aa, Homo sapiens
NRPSSGSLIQVVTTEGR

SEQ ID NO: 51397 - protein, 21 aa, Homo sapiens
DDSTEAHEGDPTNGSGEQSKT

SEQ ID NO: 51398 - protein, 10 aa, Homo sapiens
RKPSNVSEKE

SEQ ID NO: 51399 - protein, 12 aa, Homo sapiens
AQEHTFIHTIVK

SEQ ID NO: 51400 - protein, 8 aa, Homo sapiens
TEYGLLIR

SEQ ID NO: 51401 - protein, 21 aa, Homo sapiens
ENPSEEAQNLVEFTDEEGYGR

SEQ ID NO: 51402 - protein, 31 aa, Homo sapiens
ETSSALTHAGAHLDLSAFSSWEELASLGLDR

SEQ ID NO: 51403 - protein, 9 aa, Homo sapiens
HLTHENVQR

SEQ ID NO: 51404 - protein, 19 aa, Homo sapiens
KHPNEICVPMSVEFEELLK

SEQ ID NO: 51405 - protein, 18 aa, Homo sapiens
LDYITYLSIFDQLFDIPK

SEQ ID NO: 51406 - protein, 17 aa, Homo sapiens
NLPLGWDGKPIPYWLYK

SEQ ID NO: 51407 - protein, 10 aa, Homo sapiens
YLDLHDCYLK

SEQ ID NO: 51408 - protein, 14 aa, Homo sapiens
LPRPPPPEMPESLK

SEQ ID NO: 51409 - protein, 49 aa, Homo sapiens
VRIQTQPGYANTLRDAAPKMYKEEGLKAFYKGVAPLWMRQIPYTMMKFA

SEQ ID NO: 51410 - protein, 27 aa, Homo sapiens
YYALCGFGGVLSCGLTHTAVVPLDLVK

SEQ ID NO: 51411 - protein, 29 aa, Homo sapiens
KLLKSIPLDVVLSNNNHTEIQEISLALRS

SEQ ID NO: 51412 - protein, 18 aa, Homo sapiens
RILQNLTTLATNNGYIKF

SEQ ID NO: 51413 - protein, 14 aa, Homo sapiens
FHDLLSQLDDQYSR

SEQ ID NO: 51414 - protein, 18 aa, Homo sapiens
FLEQVHQLYDDSFPMEIR

SEQ ID NO: 51415 - protein, 27 aa, Homo sapiens
IGGPPNACLDQLQNWFTIVAESLQQVR

SEQ ID NO: 51416 - protein, 10 aa, Homo sapiens
MYLMLDNKRK

SEQ ID NO: 51417 - protein, 12 aa, Homo sapiens
QQLKKLEELEQK

SEQ ID NO: 51418 - protein, 32 aa, Homo sapiens
QQSACIGGPPNACLDQLQNWFTIVAESLQQVR

SEQ ID NO: 51419 - protein, 18 aa, Homo sapiens
SQNGGEPDFHAVEPYTKK

SEQ ID NO: 51420 - protein, 8 aa, Homo sapiens
YLYPNIDK

SEQ ID NO: 51421 - protein, 12 aa, Homo sapiens
YLYPNIDKDHAF

SEQ ID NO: 51422 - protein, 24 aa, Homo sapiens
KRNSSSSSTDSETLRYNHNFEPKS

SEQ ID NO: 51423 - protein, 14 aa, Homo sapiens
NMSGQWFYEAKAKR

SEQ ID NO: 51424 - protein, 13 aa, Homo sapiens
QQGSEEEPSPVLK

SEQ ID NO: 51425 - protein, 8 aa, Homo sapiens
QRSDPYVK

SEQ ID NO: 51426 - protein, 9 aa, Homo sapiens
SVCHVPGLK

SEQ ID NO: 51427 - protein, 23 aa, Homo sapiens
TCAVHITLDPDTANPWLILSEDR

SEQ ID NO: 51428 - protein, 26 aa, Homo sapiens
DVEFPNDYPSGCLLGCVDLIDCLSQK

SEQ ID NO: 51429 - protein, 29 aa, Homo sapiens
IVCEQEGSGPCLFCGTLVCTHEEQDILQR

SEQ ID NO: 51430 - protein, 15 aa, Homo sapiens
KRYNQSMVTAELQRL

SEQ ID NO: 51431 - protein, 22 aa, Homo sapiens
ACWELYCLEHGIQPDGQMPSDK

SEQ ID NO: 51432 - protein, 20 aa, Homo sapiens
AFVHWYVGEGMEEGEFSEAR

SEQ ID NO: 51433 - protein, 15 aa, Homo sapiens
AVFVDLEPTVIDEVR

SEQ ID NO: 51434 - protein, 16 aa, Homo sapiens
AYHEQLTVAEITNACF

SEQ ID NO: 51435 - protein, 24 aa, Homo sapiens
AYHEQLTVAEITNACFEPANQMVK

SEQ ID NO: 51436 - protein, 10 aa, Homo sapiens
DVNAAIATIK

SEQ ID NO: 51437 - protein, 9 aa, Homo sapiens
EIIDLVLDR

SEQ ID NO: 51438 - protein, 21 aa, Homo sapiens
FDGALNVDLTEFQTNLVPYPR

SEQ ID NO: 51439 - protein, 18 aa, Homo sapiens
HSFGGGTGSGFTSLLMER

SEQ ID NO: 51440 - protein, 16 aa, Homo sapiens
IHFPLATYAPVISAEK

SEQ ID NO: 51441 - protein, 15 aa, Homo sapiens
LADQCTGLQGFLVFH

SEQ ID NO: 51442 - protein, 17 aa, Homo sapiens
LADQCTGLQGFLVFHSF

SEQ ID NO: 51443 - protein, 32 aa, Homo sapiens
LADQCTGLQGFLVFHSFGGGTGSGFTSLLMER

SEQ ID NO: 51444 - protein, 26 aa, Homo sapiens
LEFSIYPAPQVSTAVVEPYNSILTTH

SEQ ID NO: 51445 - protein, 14 aa, Homo sapiens
LISQIVSSITASLR

SEQ ID NO: 51446 - protein, 21 aa, Homo sapiens
LVFHSFGGGTGSGFTSLLMER

SEQ ID NO: 51447 - protein, 14 aa, Homo sapiens
NLDIERPTYTNLNR

SEQ ID NO: 51448 - protein, 11 aa, Homo sapiens
QFVDWCPTGFK

SEQ ID NO: 51449 - protein, 12 aa, Homo sapiens
QLFHPEQLITGK

SEQ ID NO: 51450 - protein, 20 aa, Homo sapiens
TIGGGDDSFNTFFSETGAGK

SEQ ID NO: 51451 - protein, 13 aa, Homo sapiens
TIQFVDWCPTGFK

SEQ ID NO: 51452 - protein, 22 aa, Homo sapiens
TTLEHSDCAFMVDNEAIYDICR

SEQ ID NO: 51453 - protein, 18 aa, Homo sapiens
VGINYQPPTVVPGGDLAK

SEQ ID NO: 51454 - protein, 33 aa, Homo sapiens
KIKGIVENMGINANNMSDFIMKVDALMSSVPKR

SEQ ID NO: 51455 - protein, 16 aa, Homo sapiens
LQQTQNQVDEVVDIMR

SEQ ID NO: 51456 - protein, 15 aa, Homo sapiens
AKLHIDEMDSVPTVR

SEQ ID NO: 51457 - protein, 11 aa, Homo sapiens
CSVADVYPFDR

SEQ ID NO: 51458 - protein, 18 aa, Homo sapiens
CSVADVYPFDRLEIDLLK

SEQ ID NO: 51459 - protein, 19 aa, Homo sapiens
DPEIHLSGPLEAGKPITVK

SEQ ID NO: 51460 - protein, 11 aa, Homo sapiens
EVELIIQVTPK

SEQ ID NO: 51461 - protein, 11 aa, Homo sapiens
GIQVEIYSFPK

SEQ ID NO: 51462 - protein, 30 aa, Homo sapiens
GIQVEIYSFPKDPEIHLSGPLEAGKPITVK

SEQ ID NO: 51463 - protein, 11 aa, Homo sapiens
GIQVELYSFPR

SEQ ID NO: 51464 - protein, 10 aa, Homo sapiens
KEVELIVQEK

SEQ ID NO: 51465 - protein, 24 aa, Homo sapiens
KKLDNGNLQHLSGNATLTLIAMRM

SEQ ID NO: 51466 - protein, 10 aa, Homo sapiens
KSIDGAYTIR

SEQ ID NO: 51467 - protein, 11 aa, Homo sapiens
LHIDDMEFEPK

SEQ ID NO: 51468 - protein, 13 aa, Homo sapiens
LHIDDMEFEPKQR

SEQ ID NO: 51469 - protein, 13 aa, Homo sapiens
LHIDEMDSVPTVR

SEQ ID NO: 51470 - protein, 11 aa, Homo sapiens
NTVISVNPSTK

SEQ ID NO: 51471 - protein, 13 aa, Homo sapiens
QAVKELQVYISPK

SEQ ID NO: 51472 - protein, 33 aa, Homo sapiens
RDTTVLVSPSSILEEGSSVNMTCLSQGFPAPKI

SEQ ID NO: 51473 - protein, 24 aa, Homo sapiens
RQLPNGELQPLSENATLTLISTKM

SEQ ID NO: 51474 - protein, 15 aa, Homo sapiens
SLEMTFIPTIEDTGK

SEQ ID NO: 51475 - protein, 15 aa, Homo sapiens
SLEVTFTPVIEDIGK

SEQ ID NO: 51476 - protein, 16 aa, Homo sapiens
SQEFLEDADRKSLETK

SEQ ID NO: 51477 - protein, 14 aa, Homo sapiens
KLTFDTTFSPNTGK

SEQ ID NO: 51478 - protein, 13 aa, Homo sapiens
LTFDTTFSPNTGK

SEQ ID NO: 51479 - protein, 10 aa, Homo sapiens
LTLSALVDGK

SEQ ID NO: 51480 - protein, 8 aa, Homo sapiens
NNFAVGYR

SEQ ID NO: 51481 - protein, 19 aa, Homo sapiens
SCSGVEFSTSGSSNTDTGK

SEQ ID NO: 51482 - protein, 23 aa, Homo sapiens
TGDFQLHTNVNDGTEFGGSIYQK

SEQ ID NO: 51483 - protein, 21 aa, Homo sapiens
VCEDLDTSVNLAWTSGTNCTR

SEQ ID NO: 51484 - protein, 20 aa, Homo sapiens
VNNSSLIGVGYTQTLRPGVK

SEQ ID NO: 51485 - protein, 11 aa, Homo sapiens
WCEYGLTFTEK

SEQ ID NO: 51486 - protein, 22 aa, Homo sapiens
WNTDNTLGTEIAIEDQICQGLK

SEQ ID NO: 51487 - protein, 12 aa, Homo sapiens
YQLDPTASISAK

SEQ ID NO: 51488 - protein, 11 aa, Homo sapiens
ANQQLNFTEAK

SEQ ID NO: 51489 - protein, 23 aa, Homo sapiens
IETKVVKEEKANDSNPNEESKKT

SEQ ID NO: 51490 - protein, 12 aa, Homo sapiens
KANQQLNFTEAK

SEQ ID NO: 51491 - protein, 13 aa, Homo sapiens
KANQQLNFTEAKE

SEQ ID NO: 51492 - protein, 16 aa, Homo sapiens
KANQQLNFTEAKEACR

SEQ ID NO: 51493 - protein, 27 aa, Homo sapiens
NEAAGFGGVPTALLVLALLFFGAAAGL

SEQ ID NO: 51494 - protein, 9 aa, Homo sapiens
NGVGVLIWK

SEQ ID NO: 51495 - protein, 23 aa, Homo sapiens
ALNYSVFYYEIQNAPEQACHLAK

SEQ ID NO: 51496 - protein, 19 aa, Homo sapiens
ELEAVCQDVLSLLDNYLIK

SEQ ID NO: 51497 - protein, 26 aa, Homo sapiens
LGLALNYSVFYYEIQNAPEQACHLAK

SEQ ID NO: 51498 - protein, 14 aa, Homo sapiens
NVTELNEPLSNEER

SEQ ID NO: 51499 - protein, 28 aa, Homo sapiens
RLGLALNYSVFYYEIQNAPEQACHLAKT

SEQ ID NO: 51500 - protein, 19 aa, Homo sapiens
SVFYYEIQNAPEQACHLAK

SEQ ID NO: 51501 - protein, 19 aa, Homo sapiens
TAFDDAIAELDTLNEDSYK

SEQ ID NO: 51502 - protein, 29 aa, Homo sapiens
TAFDDAIAELDTLNEDSYKDSTLIMQLLR

SEQ ID NO: 51503 - protein, 20 aa, Homo sapiens
YSVFYYEIQNAPEQACHLAK

SEQ ID NO: 51504 - protein, 16 aa, Homo sapiens
YYEIQNAPEQACHLAK

SEQ ID NO: 51505 - protein, 31 aa, Homo sapiens
MNKAGAVMHSGMQINMQAKQNSSKTTSKRRG

SEQ ID NO: 51506 - protein, 33 aa, Homo sapiens
RFHNHTTHMSLVGTFPWMAPEVIQSLPVSETCD

SEQ ID NO: 51507 - protein, 28 aa, Homo sapiens
RQQLPVGTTWGPFPGKMDLNNNSLKTKA

SEQ ID NO: 51508 - protein, 17 aa, Homo sapiens
IFPHLCSLCNVECSHLK

SEQ ID NO: 51509 - protein, 17 aa, Homo sapiens
IPHEPVINSSNVHVGSR

SEQ ID NO: 51510 - protein, 19 aa, Homo sapiens
RIPHEPVINSSNVHVGSRG

SEQ ID NO: 51511 - protein, 29 aa, Homo sapiens
AHHRTHTGEKPYGCHDCGKCFSKSSALNK

SEQ ID NO: 51512 - protein, 20 aa, Homo sapiens
AKSALRENGTNSETFRQRFR

SEQ ID NO: 51513 - protein, 12 aa, Homo sapiens
EYGFLRTLEQCR

SEQ ID NO: 51514 - protein, 8 aa, Homo sapiens
LREYGFLR

SEQ ID NO: 51515 - protein, 22 aa, Homo sapiens
MAKSALRENGTNSETFRQRFRR

SEQ ID NO: 51516 - protein, 40 aa, Homo sapiens
ASPATQPPPLLPPSATGPDATVGGPAPTPLLPPSATASVK

SEQ ID NO: 51517 - protein, 20 aa, Homo sapiens
DSLDPSFTHAMQLLTAEIEK

SEQ ID NO: 51518 - protein, 14 aa, Homo sapiens
KDDEENYLDLFSHK

SEQ ID NO: 51519 - protein, 29 aa, Homo sapiens
PPSATGPDATVGGPAPTPLLPPSATASVK

SEQ ID NO: 51520 - protein, 9 aa, Homo sapiens
PSGAHPSVR

SEQ ID NO: 51521 - protein, 14 aa, Homo sapiens
SGSMDPSGAHPSVR

SEQ ID NO: 51522 - protein, 10 aa, Homo sapiens
EKGLLGEFLR

SEQ ID NO: 51523 - protein, 8 aa, Homo sapiens
GLLGEFLR

SEQ ID NO: 51524 - protein, 12 aa, Homo sapiens
SYYSVYDLGNNR

SEQ ID NO: 51525 - protein, 9 aa, Homo sapiens
THKYDPAWK

SEQ ID NO: 51526 - protein, 7 aa, Homo sapiens
VGFATAA

SEQ ID NO: 51527 - protein, 13 aa, Homo sapiens
EPSSIIAFALSCK

SEQ ID NO: 51528 - protein, 5 aa, Homo sapiens
IVFEK

SEQ ID NO: 51529 - protein, 21 aa, Homo sapiens
KQLLRDLSGLQGMNGSIQAKS

SEQ ID NO: 51530 - protein, 13 aa, Homo sapiens
QFVHIKKIPGGKK

SEQ ID NO: 51531 - protein, 7 aa, Homo sapiens
GLSSGGK

SEQ ID NO: 51532 - protein, 26 aa, Homo sapiens
RTRSTSSAGSNNSAEGAGLTDNGCRR

SEQ ID NO: 51533 - protein, 17 aa, Homo sapiens
YFLEALCGQEEPLLAFK

SEQ ID NO: 51534 - protein, 11 aa, Homo sapiens
EITYGNNKPVK

SEQ ID NO: 51535 - protein, 15 aa, Homo sapiens
IDTCQGDSGGPLMCK

SEQ ID NO: 51536 - protein, 14 aa, Homo sapiens
VQPTNVCAGYPVGK

SEQ ID NO: 51537 - protein, 12 aa, Homo sapiens
DLLPDTNIIANR

SEQ ID NO: 51538 - protein, 12 aa, Homo sapiens
DTGHTHDDDILK

SEQ ID NO: 51539 - protein, 7 aa, Homo sapiens
FSFWQEK

SEQ ID NO: 51540 - protein, 16 aa, Homo sapiens
IYCTGGELSSLLGEDK

SEQ ID NO: 51541 - protein, 12 aa, Homo sapiens
KDFDHVVLLSGK

SEQ ID NO: 51542 - protein, 9 aa, Homo sapiens
KTLVLHLLR

SEQ ID NO: 51543 - protein, 8 aa, Homo sapiens
TLVLHLLR

SEQ ID NO: 51544 - protein, 15 aa, Homo sapiens
TVPGDNESEEDSKIK

SEQ ID NO: 51545 - protein, 11 aa, Homo sapiens
TYEEELLYEIK

SEQ ID NO: 51546 - protein, 18 aa, Homo sapiens
YLIEPVKYSDEGEHLVFK

SEQ ID NO: 51547 - protein, 11 aa, Homo sapiens
YSDEGEHLVFK

SEQ ID NO: 51548 - protein, 31 aa, Homo sapiens
RGTSGQPPEGCAAPTVIVSNHNLTDTVQNKQ

SEQ ID NO: 51549 - protein, 21 aa, Homo sapiens
RNLFNQWKQNATDIMEAMLKR

SEQ ID NO: 51550 - protein, 25 aa, Homo sapiens
RVNRSVHEWAGGGGGGGGATYVFKM

SEQ ID NO: 51551 - protein, 19 aa, Homo sapiens
GAVTGHEECVDALLQHGAK

SEQ ID NO: 51552 - protein, 16 aa, Homo sapiens
GCTPLHYAATSDTDGK

SEQ ID NO: 51553 - protein, 12 aa, Homo sapiens
LLVSHGAEVTCK

SEQ ID NO: 51554 - protein, 26 aa, Homo sapiens
MPVSSSSPLSSLTFNAINRYTNTSKT

SEQ ID NO: 51555 - protein, 10 aa, Homo sapiens
NTALHLACSK

SEQ ID NO: 51556 - protein, 16 aa, Homo sapiens
TPIHAAATNGHSECLR

SEQ ID NO: 51557 - protein, 33 aa, Homo sapiens
TPLHAAAFTDHVECLQLLLSHNAQVNSVDSTGK

SEQ ID NO: 51558 - protein, 16 aa, Homo sapiens
KKSNQLENHTIVGTRS

SEQ ID NO: 51559 - protein, 15 aa, Homo sapiens
AASGFNAMEDAQTLR

SEQ ID NO: 51560 - protein, 9 aa, Homo sapiens
AEIDMLDIR

SEQ ID NO: 51561 - protein, 12 aa, Homo sapiens
DEGNYLDDALVR

SEQ ID NO: 51562 - protein, 7 aa, Homo sapiens
DIEQSIK

SEQ ID NO: 51563 - protein, 8 aa, Homo sapiens
FLTVLCSR

SEQ ID NO: 51564 - protein, 16 aa, Homo sapiens
GAGTDEGCLIEILASR

SEQ ID NO: 51565 - protein, 11 aa, Homo sapiens
GLGTDDNTLIR

SEQ ID NO: 51566 - protein, 16 aa, Homo sapiens
GLGTDEDAIISVLAYR

SEQ ID NO: 51567 - protein, 11 aa, Homo sapiens
NHLLHVFDEYK

SEQ ID NO: 51568 - protein, 12 aa, Homo sapiens
NHLLHVFDEYKR

SEQ ID NO: 51569 - protein, 13 aa, Homo sapiens
QDAQDLYEAGEKK

SEQ ID NO: 51570 - protein, 9 aa, Homo sapiens
SDTSFMFQR

SEQ ID NO: 51571 - protein, 16 aa, Homo sapiens
SETSGSFEDALLAIVK

SEQ ID NO: 51572 - protein, 7 aa, Homo sapiens
SLEDDIR

SEQ ID NO: 51573 - protein, 10 aa, Homo sapiens
VLLVLCGGDD

SEQ ID NO: 51574 - protein, 10 aa, Homo sapiens
VLVSLSAGGR

SEQ ID NO: 51575 - protein, 22 aa, Homo sapiens
VLVSLSAGGRDEGNYLDDALVR

SEQ ID NO: 51576 - protein, 20 aa, Homo sapiens
KNDSLIQNDSILESLLEVLR

SEQ ID NO: 51577 - protein, 23 aa, Homo sapiens
NELCRLGALDILEEVNVSGTRKN

SEQ ID NO: 51578 - protein, 14 aa, Homo sapiens
ASHQQLDTVWENAK

SEQ ID NO: 51579 - protein, 19 aa, Homo sapiens
ISEAQEQTPFYHLFSEAVK

SEQ ID NO: 51580 - protein, 30 aa, Homo sapiens
RITLIPLNEVFQVSQEGAGNNLILQSINKT

SEQ ID NO: 51581 - protein, 19 aa, Homo sapiens
SQGNINNPTPGPVPVPGPK

SEQ ID NO: 51582 - protein, 16 aa, Homo sapiens
TSQGTSFTFGGLNQAR

SEQ ID NO: 51583 - protein, 22 aa, Homo sapiens
RLGAVVAVTGDGVNDSPALKKA

SEQ ID NO: 51584 - protein, 39 aa, Homo sapiens
KIIKSLQKNGSVVAMTGDGVNDAVALKAADIGVAMGQTG

SEQ ID NO: 51585 - protein, 24 aa, Homo sapiens
HFVTISSPLATQIPQAVGAAYAAK

SEQ ID NO: 51586 - protein, 16 aa, Homo sapiens
HLQTYGEHYPLDHFDK

SEQ ID NO: 51587 - protein, 22 aa, Homo sapiens
KPKPNPNLLFSDVYQEMPAQLR

SEQ ID NO: 51588 - protein, 18 aa, Homo sapiens
RIFVGGIDFKTNESDLRK

SEQ ID NO: 51589 - protein, 14 aa, Homo sapiens
FPTKVINLSPFENK

SEQ ID NO: 51590 - protein, 22 aa, Homo sapiens
KEQKAKETILALKEEIVNLTKL

SEQ ID NO: 51591 - protein, 26 aa, Homo sapiens
MWSGLLPPGLNESDAESNSEDEATLE

SEQ ID NO: 51592 - protein, 19 aa, Homo sapiens
RNINGLFLPPSSNITLQKE

SEQ ID NO: 51593 - protein, 27 aa, Homo sapiens
NQGNFSVVGTVLAATQAEKAVANFDRT

SEQ ID NO: 51594 - protein, 21 aa, Homo sapiens
RSMQQQETNLLANLTTNDARD

SEQ ID NO: 51595 - protein, 27 aa, Homo sapiens
KLNLNVAPDSHGTLIPDTNETITLASH

SEQ ID NO: 51596 - protein, 25 aa, Homo sapiens
KLAKIRDNLAISLDNQSSPSPPVLI

SEQ ID NO: 51597 - protein, 33 aa, Homo sapiens
KADNHTAHRIADQTALRVPSQAESSIFSQATNG

SEQ ID NO: 51598 - protein, 19 aa, Homo sapiens
RAWNWSNSITSSPFVSFKP

SEQ ID NO: 51599 - protein, 13 aa, Homo sapiens
RKIINNVTDGWKK

SEQ ID NO: 51600 - protein, 6 aa, Homo sapiens
QFHQIK

SEQ ID NO: 51601 - protein, 9 aa, Homo sapiens
QFHQIKVEK

SEQ ID NO: 51602 - protein, 11 aa, Homo sapiens
STDTDEDNVTR

SEQ ID NO: 51603 - protein, 23 aa, Homo sapiens
KVESMSESDTMNVSNLSQGVMLS

SEQ ID NO: 51604 - protein, 24 aa, Homo sapiens
AAAGIQPPGYLIHESACWSDTLQR

SEQ ID NO: 51605 - protein, 10 aa, Homo sapiens
AEWLAVKDER

SEQ ID NO: 51606 - protein, 12 aa, Homo sapiens
AQEENTWFSYLK

SEQ ID NO: 51607 - protein, 16 aa, Homo sapiens
AVPWVILSDGDGTVEK

SEQ ID NO: 51608 - protein, 18 aa, Homo sapiens
EWTTTTGDVVNENPEWVK

SEQ ID NO: 51609 - protein, 14 aa, Homo sapiens
FIPNTDDQIIVALK

SEQ ID NO: 51610 - protein, 13 aa, Homo sapiens
GMELSDLIVFNGK

SEQ ID NO: 51611 - protein, 16 aa, Homo sapiens
GSVDHENWVSNYNALR

SEQ ID NO: 51612 - protein, 11 aa, Homo sapiens
GYLTLSDSGDK

SEQ ID NO: 51613 - protein, 12 aa, Homo sapiens
IGSVKYEGIEFI

SEQ ID NO: 51614 - protein, 12 aa, Homo sapiens
KGYLTLSDSGDK

SEQ ID NO: 51615 - protein, 7 aa, Homo sapiens
LYSVDDR

SEQ ID NO: 51616 - protein, 8 aa, Homo sapiens
LYVGGLGK

SEQ ID NO: 51617 - protein, 22 aa, Homo sapiens
RLGQAPANWYNDTYPLSPPQRT

SEQ ID NO: 51618 - protein, 11 aa, Homo sapiens
TGVVYQIEGSK

SEQ ID NO: 51619 - protein, 13 aa, Homo sapiens
VASYIMAFTLDGR

SEQ ID NO: 51620 - protein, 19 aa, Homo sapiens
VAVEWDKDHGVLESHLAEK

SEQ ID NO: 51621 - protein, 7 aa, Homo sapiens
YEGIEFI

SEQ ID NO: 51622 - protein, 24 aa, Homo sapiens
KDPRNLLANQTLVYSQDLGEMTKL

SEQ ID NO: 51623 - protein, 10 aa, Homo sapiens
KSEEVYCLQK

SEQ ID NO: 51624 - protein, 22 aa, Homo sapiens
KNSLESMNISSSSSTEENPEKQ

SEQ ID NO: 51625 - protein, 26 aa, Homo sapiens
EFIHLLSNITGAIVNTDNVQFHVDKK

SEQ ID NO: 51626 - protein, 20 aa, Homo sapiens
ENIMAGATVLFLNATDLDRS

SEQ ID NO: 51627 - protein, 11 aa, Homo sapiens
IRVGNATIDRE

SEQ ID NO: 51628 - protein, 22 aa, Homo sapiens
LSVIDNASDLPERSVSVPNAKL

SEQ ID NO: 51629 - protein, 21 aa, Homo sapiens
RVLDINDNDPVLLNLPMNITI

SEQ ID NO: 51630 - protein, 21 aa, Homo sapiens
RYDFDLFANESVPDHVGYAKV

SEQ ID NO: 51631 - protein, 26 aa, Homo sapiens
KYKMVLEENERMNQEIVNLSKEAQKF

SEQ ID NO: 51632 - protein, 22 aa, Homo sapiens
ILDESHSIDKDNGEPVIYYLVK

SEQ ID NO: 51633 - protein, 9 aa, Homo sapiens
PDFSFLAAR

SEQ ID NO: 51634 - protein, 19 aa, Homo sapiens
PVVDQLEVPTTWWDSEADK

SEQ ID NO: 51635 - protein, 17 aa, Homo sapiens
GDKGEQGDQGPRMVFPK

SEQ ID NO: 51636 - protein, 18 aa, Homo sapiens
GEPGLPGAVGQNGIPGPK

SEQ ID NO: 51637 - protein, 36 aa, Homo sapiens
GEPGLPGLPGLPGIKGEPGFIGPQGEPGLPGLPGTK

SEQ ID NO: 51638 - protein, 18 aa, Homo sapiens
GGIGLPGLPGANGMKGEK

SEQ ID NO: 51639 - protein, 19 aa, Homo sapiens
MVFPKINHGFLSADQQLIK

SEQ ID NO: 51640 - protein, 11 aa, Homo sapiens
AVSPPASNMLK

SEQ ID NO: 51641 - protein, 10 aa, Homo sapiens
EIVNKHNELR

SEQ ID NO: 51642 - protein, 19 aa, Homo sapiens
PVGGNVTSSFSGDDLECRE

SEQ ID NO: 51643 - protein, 35 aa, Homo sapiens
KESKKDATKDAKKVAKKDTEKESADSKKDAKKNAK

SEQ ID NO: 51644 - protein, 30 aa, Homo sapiens
KGKDIEKGKEEKLDAKKDSKKGKKDAEKGK

SEQ ID NO: 51645 - protein, 10 aa, Homo sapiens
KPSSTDSDSK

SEQ ID NO: 51646 - protein, 9 aa, Homo sapiens
EIRSQLNEK

SEQ ID NO: 51647 - protein, 19 aa, Homo sapiens
EFESCIQYYLENNWLQHEK

SEQ ID NO: 51648 - protein, 20 aa, Homo sapiens
EGFDALDPFIPILVSNYNPK

SEQ ID NO: 51649 - protein, 11 aa, Homo sapiens
KPALELLHYLK

SEQ ID NO: 51650 - protein, 20 aa, Homo sapiens
NDWHGGAIVSALSQTGSLFK

SEQ ID NO: 51651 - protein, 22 aa, Homo sapiens
NDWHGGAIVSALSQTGSLFKPR

SEQ ID NO: 51652 - protein, 16 aa, Homo sapiens
SIAAHLDNQVPVESPR

SEQ ID NO: 51653 - protein, 28 aa, Homo sapiens
RALNTTQPGSLQLTVGNLKPEAMYTFRV

SEQ ID NO: 51654 - protein, 20 aa, Homo sapiens
RKQQLSNGSLLIQNILHSRH

SEQ ID NO: 51655 - protein, 15 aa, Homo sapiens
HEHCEELLTQALSGR

SEQ ID NO: 51656 - protein, 17 aa, Homo sapiens
LKHEHCEELLTQALSGR

SEQ ID NO: 51657 - protein, 10 aa, Homo sapiens
HILSVLPQIK

SEQ ID NO: 51658 - protein, 11 aa, Homo sapiens
KHILSVLPQIK

SEQ ID NO: 51659 - protein, 23 aa, Homo sapiens
NYLQYGTPNVLNEDVQEMLKPAK

SEQ ID NO: 51660 - protein, 11 aa, Homo sapiens
AEGSLEPGRLK

SEQ ID NO: 51661 - protein, 17 aa, Homo sapiens
MMNNTDFLMLNNPWNKL

SEQ ID NO: 51662 - protein, 35 aa, Homo sapiens
KEPGPPGGSSSFLHKPFPGGPLQVCPQACPSASER

SEQ ID NO: 51663 - protein, 22 aa, Homo sapiens
RPLLPFETEVGPCGVGEASLDK

SEQ ID NO: 51664 - protein, 20 aa, Homo sapiens
VDCTALRPVLILGPLLDVVK

SEQ ID NO: 51665 - protein, 44 aa, Homo sapiens
AITAPQMFGRLDVATNDWTDGIFSTLWRKTLRAKKGEHIWIILD

SEQ ID NO: 51666 - protein, 12 aa, Homo sapiens
NFIKTGSTFKVK

SEQ ID NO: 51667 - protein, 7 aa, Homo sapiens
YLYTLEK

SEQ ID NO: 51668 - protein, 12 aa, Homo sapiens
AVINVLNVAHSK

SEQ ID NO: 51669 - protein, 28 aa, Homo sapiens
MITVVQTYSTLSNSTIEGIDIMAIKFRN

SEQ ID NO: 51670 - protein, 24 aa, Homo sapiens
MLANIFLPAVLATNNWGALNQSKQ

SEQ ID NO: 51671 - protein, 13 aa, Homo sapiens
SYNVTNLTDDLKA

SEQ ID NO: 51672 - protein, 23 aa, Homo sapiens
RLNMTTEQFTGDHTQHFLDGGEM

SEQ ID NO: 51673 - protein, 14 aa, Homo sapiens
ALEVIKPAHILQEK

SEQ ID NO: 51674 - protein, 18 aa, Homo sapiens
DIDIEDLEELDPDFIMAK

SEQ ID NO: 51675 - protein, 14 aa, Homo sapiens
DLYNWLEVEFNPLK

SEQ ID NO: 51676 - protein, 18 aa, Homo sapiens
EDAPIGPHLQSMPSEQIR

SEQ ID NO: 51677 - protein, 35 aa, Homo sapiens
EESQQMVLDIEDLDNIQTPESVLLSAVSGEDTQDR

SEQ ID NO: 51678 - protein, 7 aa, Homo sapiens
FCLQYTR

SEQ ID NO: 51679 - protein, 12 aa, Homo sapiens
FNVLQYVVPEVK

SEQ ID NO: 51680 - protein, 7 aa, Homo sapiens
HCDLQVR

SEQ ID NO: 51681 - protein, 23 aa, Homo sapiens
HHNQSTAINLNNPESQSMHLETR

SEQ ID NO: 51682 - protein, 9 aa, Homo sapiens
ILQEHEQIK

SEQ ID NO: 51683 - protein, 14 aa, Homo sapiens
KPPKPQLMANYYNK

SEQ ID NO: 51684 - protein, 9 aa, Homo sapiens
NICQQVNIK

SEQ ID NO: 51685 - protein, 12 aa, Homo sapiens
NQLTAMSSVLAK

SEQ ID NO: 51686 - protein, 11 aa, Homo sapiens
FGGPVHHQAQR

SEQ ID NO: 51687 - protein, 14 aa, Homo sapiens
NVALLSQLYHSPAR

SEQ ID NO: 51688 - protein, 25 aa, Homo sapiens
SEAEEAITSFNGHKPPGSSEPITVK

SEQ ID NO: 51689 - protein, 18 aa, Homo sapiens
TNLIVNYLPQNMTQDELR

SEQ ID NO: 51690 - protein, 17 aa, Homo sapiens
VAGHSLGYGFVNYVTAK

SEQ ID NO: 51691 - protein, 11 aa, Homo sapiens
VLVDQTTGLSR

SEQ ID NO: 51692 - protein, 15 aa, Homo sapiens
KRPNENSSADISGKT

SEQ ID NO: 51693 - protein, 14 aa, Homo sapiens
HHLSVPCTRPREAR

SEQ ID NO: 51694 - protein, 11 aa, Homo sapiens
QNLVIKDKFIR

SEQ ID NO: 51695 - protein, 14 aa, Homo sapiens
YNIRIPELVQRIEK

SEQ ID NO: 51696 - protein, 24 aa, Homo sapiens
KGDFESQNSSLESSISQVINLEKN

SEQ ID NO: 51697 - protein, 19 aa, Homo sapiens
RVKNISDADVHNAMDNYEC

SEQ ID NO: 51698 - protein, 17 aa, Homo sapiens
MALNNVSLSSGDQRSRV

SEQ ID NO: 51699 - protein, 13 aa, Homo sapiens
RKLFQEILNTSRE

SEQ ID NO: 51700 - protein, 25 aa, Homo sapiens
QQTTNTTSTQMTNIGVYVSNMTDKL

SEQ ID NO: 51701 - protein, 33 aa, Homo sapiens
KADETVTEMNFSNEYNKSELMLQENQMIADGKE

SEQ ID NO: 51702 - protein, 17 aa, Homo sapiens
KITKNFSEVGFPDILKA

SEQ ID NO: 51703 - protein, 20 aa, Homo sapiens
REAYSPLELLDNLSGADVRQ

SEQ ID NO: 51704 - protein, 28 aa, Homo sapiens
RRGSEVISNTTEDTQLTSETQSLTGNKK

SEQ ID NO: 51705 - protein, 7 aa, Homo sapiens
ERELNGK

SEQ ID NO: 51706 - protein, 12 aa, Homo sapiens
QQHQQAVEQIAK

SEQ ID NO: 51707 - protein, 38 aa, Homo sapiens
KLQSINKLENGTSAVTSASEMLLPHTLQNHSVKEKGKL

SEQ ID NO: 51708 - protein, 25 aa, Homo sapiens
KHGNLRNVLILMDQSAWDSNATLRQ

SEQ ID NO: 51709 - protein, 18 aa, Homo sapiens
NVLILMDQSAWDSNATLR

SEQ ID NO: 51710 - protein, 21 aa, Homo sapiens
TMMWDNVNAEDCQEMFNLLQM

SEQ ID NO: 51711 - protein, 25 aa, Homo sapiens
AEVLIHNNADGTYHITYSPAFPGTY

SEQ ID NO: 51712 - protein, 18 aa, Homo sapiens
KNVNQSLLELHALASDKG

SEQ ID NO: 51713 - protein, 18 aa, Homo sapiens
EALGHWLGLLNADGWIGR

SEQ ID NO: 51714 - protein, 18 aa, Homo sapiens
LAGSLLTQALESHAEGFR

SEQ ID NO: 51715 - protein, 27 aa, Homo sapiens
VTVEPQDSGTSALPLVSLFFYVVTDGK

SEQ ID NO: 51716 - protein, 20 aa, Homo sapiens
KEYEDAENTSTQSKVMNKKD

SEQ ID NO: 51717 - protein, 34 aa, Homo sapiens
RLEQQMNSASGSSSNGSSINMSGIDNGEGTRLRN

SEQ ID NO: 51718 - protein, 12 aa, Homo sapiens
KQHSEATNSSNR

SEQ ID NO: 51719 - protein, 18 aa, Homo sapiens
EVLGDAVPDEILIEAVLK

SEQ ID NO: 51720 - protein, 16 aa, Homo sapiens
GLCLLEQIDSFKPPQR

SEQ ID NO: 51721 - protein, 7 aa, Homo sapiens
ACQIFVR

SEQ ID NO: 51722 - protein, 15 aa, Homo sapiens
DKFNECGHVLYADIK

SEQ ID NO: 51723 - protein, 9 aa, Homo sapiens
FESPEVAER

SEQ ID NO: 51724 - protein, 13 aa, Homo sapiens
FNECGHVLYADIK

SEQ ID NO: 51725 - protein, 8 aa, Homo sapiens
GCAVVEFK

SEQ ID NO: 51726 - protein, 37 aa, Homo sapiens
GDFFPPERPQQLPHGLGGIGMGLGPGGQPIDANHLNK

SEQ ID NO: 51727 - protein, 23 aa, Homo sapiens
GNFGGSFAGSFGGAGGHAPGVAR

SEQ ID NO: 51728 - protein, 8 aa, Homo sapiens
KACQIFVR

SEQ ID NO: 51729 - protein, 15 aa, Homo sapiens
MGPLGLDHMASSIER

SEQ ID NO: 51730 - protein, 16 aa, Homo sapiens
VGEVTYVELLMDAEGK

SEQ ID NO: 51731 - protein, 17 aa, Homo sapiens
KSISWDENGTCIVINEE

SEQ ID NO: 51732 - protein, 13 aa, Homo sapiens
AQFEQLCASLLAR

SEQ ID NO: 51733 - protein, 10 aa, Homo sapiens
AVMEQANLQR

SEQ ID NO: 51734 - protein, 14 aa, Homo sapiens
ELDNFCNPIIYKPK

SEQ ID NO: 51735 - protein, 19 aa, Homo sapiens
KPVADCVISIPSFFTDAER

SEQ ID NO: 51736 - protein, 15 aa, Homo sapiens
NFDEALVDYFCDEFK

SEQ ID NO: 51737 - protein, 16 aa, Homo sapiens
QLGQDLLNSYIENEGK

SEQ ID NO: 51738 - protein, 8 aa, Homo sapiens
SQIVTNVR

SEQ ID NO: 51739 - protein, 13 aa, Homo sapiens
VLATTFDPYLGGR

SEQ ID NO: 51740 - protein, 9 aa, Homo sapiens
AFIPQLLSR

SEQ ID NO: 51741 - protein, 12 aa, Homo sapiens
ESLDDLTNLVVK

SEQ ID NO: 51742 - protein, 15 aa, Homo sapiens
FAQFFLCPLFDESCK

SEQ ID NO: 51743 - protein, 15 aa, Homo sapiens
FIIQSEKPPHYLESR

SEQ ID NO: 51744 - protein, 18 aa, Homo sapiens
NVPLPEFPEHPFQEEHLK

SEQ ID NO: 51745 - protein, 15 aa, Homo sapiens
RLHIEALLHGNITKQ

SEQ ID NO: 51746 - protein, 24 aa, Homo sapiens
SNPGHYLGHLIGHEGPGSLLSELK

SEQ ID NO: 51747 - protein, 10 aa, Homo sapiens
AGFTAAYSEK

SEQ ID NO: 51748 - protein, 10 aa, Homo sapiens
ATLITFLCDR

SEQ ID NO: 51749 - protein, 17 aa, Homo sapiens
CDEDEDIGRPQVFSEVR

SEQ ID NO: 51750 - protein, 14 aa, Homo sapiens
DGAGNSFDLSSLSR

SEQ ID NO: 51751 - protein, 11 aa, Homo sapiens
DGGVCLLSGTK

SEQ ID NO: 51752 - protein, 7 aa, Homo sapiens
DGIIVLK

SEQ ID NO: 51753 - protein, 7 aa, Homo sapiens
DPGSQLR

SEQ ID NO: 51754 - protein, 18 aa, Homo sapiens
DQGSFTEVVSISNLGMAK

SEQ ID NO: 51755 - protein, 13 aa, Homo sapiens
EKEDLLCGATDGK

SEQ ID NO: 51756 - protein, 7 aa, Homo sapiens
EPQGFHK

SEQ ID NO: 51757 - protein, 12 aa, Homo sapiens
ETSDCSYLFEWR

SEQ ID NO: 51758 - protein, 12 aa, Homo sapiens
EVPCYVFDEELR

SEQ ID NO: 51759 - protein, 7 aa, Homo sapiens
FISSPMK

SEQ ID NO: 51760 - protein, 13 aa, Homo sapiens
FLHQDIDSGQGIR

SEQ ID NO: 51761 - protein, 13 aa, Homo sapiens
FVCNDDVYSGPLK

SEQ ID NO: 51762 - protein, 9 aa, Homo sapiens
GCDVTFEWK

SEQ ID NO: 51763 - protein, 9 aa, Homo sapiens
GGTPYNNER

SEQ ID NO: 51764 - protein, 11 aa, Homo sapiens
GHQAFDVGQPR

SEQ ID NO: 51765 - protein, 8 aa, Homo sapiens
GPLGCSER

SEQ ID NO: 51766 - protein, 9 aa, Homo sapiens
GTADAFIVR

SEQ ID NO: 51767 - protein, 8 aa, Homo sapiens
GVSMGTPK

SEQ ID NO: 51768 - protein, 21 aa, Homo sapiens
HAEPEQNWEAVDGSQTETEKK

SEQ ID NO: 51769 - protein, 8 aa, Homo sapiens
HDLNPLIK

SEQ ID NO: 51770 - protein, 15 aa, Homo sapiens
HQDEAVVLSYVNGDR

SEQ ID NO: 51771 - protein, 27 aa, Homo sapiens
KEEETDENETEWLMEEIQLPPPRQGKE

SEQ ID NO: 51772 - protein, 9 aa, Homo sapiens
KHDLNPLIK

SEQ ID NO: 51773 - protein, 13 aa, Homo sapiens
KPWTAVDTSVDGR

SEQ ID NO: 51774 - protein, 29 aa, Homo sapiens
KTGPVVEDSGSLLLEYVNGSACTTSDGRQ

SEQ ID NO: 51775 - protein, 21 aa, Homo sapiens
KTNITLVCKPGDLESAPVLRT

SEQ ID NO: 51776 - protein, 7 aa, Homo sapiens
LGVIGDK

SEQ ID NO: 51777 - protein, 22 aa, Homo sapiens
LSGAYLVDDSDPDTSLFINVCR

SEQ ID NO: 51778 - protein, 11 aa, Homo sapiens
LSSDVCPTSDK

SEQ ID NO: 51779 - protein, 13 aa, Homo sapiens
LSYYDGMIQLNYR

SEQ ID NO: 51780 - protein, 9 aa, Homo sapiens
LTYENGLLK

SEQ ID NO: 51781 - protein, 7 aa, Homo sapiens
LVLSYVR

SEQ ID NO: 51782 - protein, 21 aa, Homo sapiens
NPACSGANICQVKPNDQHFSR

SEQ ID NO: 51783 - protein, 26 aa, Homo sapiens
RAACAVKPQEVQMVNGTITNPINGKS

SEQ ID NO: 51784 - protein, 22 aa, Homo sapiens
RDAGVGFPEYQEEDNSTYNFRW

SEQ ID NO: 51785 - protein, 28 aa, Homo sapiens
RDPNSGFVFNLNPLNSSQGYNVSGIGKI

SEQ ID NO: 51786 - protein, 9 aa, Homo sapiens
RGVSMGTPK

SEQ ID NO: 51787 - protein, 28 aa, Homo sapiens
RMDGCTLTDEQLLYSFNLSSLSTSTFKV

SEQ ID NO: 51788 - protein, 19 aa, Homo sapiens
RMSVINFECNKTAGNDGKG

SEQ ID NO: 51789 - protein, 21 aa, Homo sapiens
RSLLEFNTTVSCDQQGTNHRV

SEQ ID NO: 51790 - protein, 17 aa, Homo sapiens
RTTTGDVQVLGLVHTQK

SEQ ID NO: 51791 - protein, 9 aa, Homo sapiens
RYDLSALVR

SEQ ID NO: 51792 - protein, 14 aa, Homo sapiens
SDEKTWNLGLSNAK

SEQ ID NO: 51793 - protein, 22 aa, Homo sapiens
SEGGLGGNWYAMDNSGEHVTWR

SEQ ID NO: 51794 - protein, 26 aa, Homo sapiens
SNEHDDCQVTNPSTGHLFDLSSLSGR

SEQ ID NO: 51795 - protein, 10 aa, Homo sapiens
SYEECIIESR

SEQ ID NO: 51796 - protein, 12 aa, Homo sapiens
TASSVIELTCTK

SEQ ID NO: 51797 - protein, 31 aa, Homo sapiens
TCSLSGEQQDVSIDLTPLAQSGGSSYISDGK

SEQ ID NO: 51798 - protein, 7 aa, Homo sapiens
TSSIIFK

SEQ ID NO: 51799 - protein, 16 aa, Homo sapiens
TTTGDVQVLGLVHTQK

SEQ ID NO: 51800 - protein, 9 aa, Homo sapiens
TVEACPVVR

SEQ ID NO: 51801 - protein, 8 aa, Homo sapiens
TVGRPAFK

SEQ ID NO: 51802 - protein, 10 aa, Homo sapiens
TWNLGLSNAK

SEQ ID NO: 51803 - protein, 11 aa, Homo sapiens
TYHSVGDSVLR

SEQ ID NO: 51804 - protein, 8 aa, Homo sapiens
VAGLLTQK

SEQ ID NO: 51805 - protein, 12 aa, Homo sapiens
VPIDGPPIDIGR

SEQ ID NO: 51806 - protein, 11 aa, Homo sapiens
VQSSIAFLCGK

SEQ ID NO: 51807 - protein, 8 aa, Homo sapiens
VRDGPQWR

SEQ ID NO: 51808 - protein, 7 aa, Homo sapiens
VVVTYSK

SEQ ID NO: 51809 - protein, 8 aa, Homo sapiens
YDLSALVR

SEQ ID NO: 51810 - protein, 23 aa, Homo sapiens
YSDNWEAITGTGDPEHYLINVCK

SEQ ID NO: 51811 - protein, 12 aa, Homo sapiens
YVDGDLCPDGIR

SEQ ID NO: 51812 - protein, 11 aa, Homo sapiens
YVDQVLQLVYK

SEQ ID NO: 51813 - protein, 25 aa, Homo sapiens
KAFHTEISSSDNNTLTSSNAYNSRY

SEQ ID NO: 51814 - protein, 29 aa, Homo sapiens
TVTPVSPSFAHNPKRHNSASVENVSLRKS

SEQ ID NO: 51815 - protein, 11 aa, Homo sapiens
KNSSNWKLFKE

SEQ ID NO: 51816 - protein, 10 aa, Homo sapiens
EVVYEFSTTK

SEQ ID NO: 51817 - protein, 6 aa, Homo sapiens
NVLINK

SEQ ID NO: 51818 - protein, 46 aa, Homo sapiens
VVPSPLQFCAATPKHALPVPGRLPPCASGHAAVGGPQENSVKILDT

SEQ ID NO: 51819 - protein, 18 aa, Homo sapiens
ALVSHNGSLINVGSLLQR

SEQ ID NO: 51820 - protein, 20 aa, Homo sapiens
GEASEDLCEMALDPELLLLR

SEQ ID NO: 51821 - protein, 25 aa, Homo sapiens
QEGLDGGLPEEVLFGNLDLLPPPGK

SEQ ID NO: 51822 - protein, 11 aa, Homo sapiens
VFTGIVTSLHD

SEQ ID NO: 51823 - protein, 11 aa, Homo sapiens
VQTLSNQPLLK

SEQ ID NO: 51824 - protein, 11 aa, Homo sapiens
VRLAEAEETAR

SEQ ID NO: 51825 - protein, 18 aa, Homo sapiens
KKENETLKSDLNNLMELL

SEQ ID NO: 51826 - protein, 20 aa, Homo sapiens
KTFTMMGPSESDNFSHNLRG

SEQ ID NO: 51827 - protein, 20 aa, Homo sapiens
TEEMEACSNGALIPGNLSKE

SEQ ID NO: 51828 - protein, 24 aa, Homo sapiens
RETQAINSSLSTLGLVIMALSNKE

SEQ ID NO: 51829 - protein, 19 aa, Homo sapiens
RTLIAPQGYPNPENFSWTE

SEQ ID NO: 51830 - protein, 14 aa, Homo sapiens
IPLNGTWLFTPVSK

SEQ ID NO: 51831 - protein, 17 aa, Homo sapiens
LIIVSNPVDILTYVAWK

SEQ ID NO: 51832 - protein, 9 aa, Homo sapiens
DYSVTANSK

SEQ ID NO: 51833 - protein, 8 aa, Homo sapiens
FIIPQIVK

SEQ ID NO: 51834 - protein, 17 aa, Homo sapiens
GEMMDLQHGSLFLQTPK

SEQ ID NO: 51835 - protein, 9 aa, Homo sapiens
GLTSVINQK

SEQ ID NO: 51836 - protein, 35 aa, Homo sapiens
GLTSVINQKLKDDEVAQLKKSADTLWDIQKDLKDL

SEQ ID NO: 51837 - protein, 20 aa, Homo sapiens
GMYGIENEVFLSLPCILNAR

SEQ ID NO: 51838 - protein, 20 aa, Homo sapiens
GYTNWAIGLSVADLIESMLK

SEQ ID NO: 51839 - protein, 9 aa, Homo sapiens
IHPVSTMVK

SEQ ID NO: 51840 - protein, 20 aa, Homo sapiens
ITVVGVGQVGMACAISILGK

SEQ ID NO: 51841 - protein, 14 aa, Homo sapiens
IVADKDYSVTANSK

SEQ ID NO: 51842 - protein, 9 aa, Homo sapiens
IVVVTAGVR

SEQ ID NO: 51843 - protein, 11 aa, Homo sapiens
KSADTLWDIQK

SEQ ID NO: 51844 - protein, 16 aa, Homo sapiens
KSADTLWDIQKDLKDL

SEQ ID NO: 51845 - protein, 16 aa, Homo sapiens
LIAPVAEEEATVPNNK

SEQ ID NO: 51846 - protein, 10 aa, Homo sapiens
LKDDEVAQLK

SEQ ID NO: 51847 - protein, 11 aa, Homo sapiens
LKDDEVAQLKK

SEQ ID NO: 51848 - protein, 19 aa, Homo sapiens
LKGEMMDLQHGSLFLQTPK

SEQ ID NO: 51849 - protein, 11 aa, Homo sapiens
MVVESAYEVIK

SEQ ID NO: 51850 - protein, 6 aa, Homo sapiens
NVNVFK

SEQ ID NO: 51851 - protein, 10 aa, Homo sapiens
SADTLWDIQK

SEQ ID NO: 51852 - protein, 15 aa, Homo sapiens
SADTLWDIQKDLKDL

SEQ ID NO: 51853 - protein, 15 aa, Homo sapiens
SLADELALVDVLEDK

SEQ ID NO: 51854 - protein, 17 aa, Homo sapiens
SLADELALVDVLEDKLK

SEQ ID NO: 51855 - protein, 23 aa, Homo sapiens
YSPDCIIIVVSNPVDILTYVTWK

SEQ ID NO: 51856 - protein, 38 aa, Homo sapiens
KDSEGIEMGVAGSVSLLQNVTLSTQPISSLDWSPDKRG

SEQ ID NO: 51857 - protein, 23 aa, Homo sapiens
RYTLVFNSSSERNVSLTEHKKKQ

SEQ ID NO: 51858 - protein, 27 aa, Homo sapiens
RKKKINGSSPDTATSGGYHSPGDSATG

SEQ ID NO: 51859 - protein, 25 aa, Homo sapiens
RTSNGQPVKTAGEITQHNVTELLRD

SEQ ID NO: 51860 - protein, 14 aa, Homo sapiens
HPDPYEFLLLRKIK

SEQ ID NO: 51861 - protein, 12 aa, Homo sapiens
LQLANHSGYIKV

SEQ ID NO: 51862 - protein, 17 aa, Homo sapiens
KLIPLGVFTGLSNLTKL

SEQ ID NO: 51863 - protein, 24 aa, Homo sapiens
RFLNLSYNPISTIEGSMLHELLRL

SEQ ID NO: 51864 - protein, 17 aa, Homo sapiens
KLVPLGVFTGLSNLTKL

SEQ ID NO: 51865 - protein, 21 aa, Homo sapiens
LTSLSVTNTNLSTVPFLAFKH

SEQ ID NO: 51866 - protein, 13 aa, Homo sapiens
RVLNVSQNLLETL

SEQ ID NO: 51867 - protein, 17 aa, Homo sapiens
RSYLCNNLTNLEPFVKL

SEQ ID NO: 51868 - protein, 12 aa, Homo sapiens
ETQGMNYWQGWK

SEQ ID NO: 51869 - protein, 25 aa, Homo sapiens
KTLIPNASNEAIQLMTEMLNWDPKK

SEQ ID NO: 51870 - protein, 35 aa, Homo sapiens
MNRYTTMRQLGDGTYGSVLMGKSNESGELVAIKRM

SEQ ID NO: 51871 - protein, 13 aa, Homo sapiens
SCWVCFATDEDDR

SEQ ID NO: 51872 - protein, 16 aa, Homo sapiens
VACPQCNAEYLIVFPK

SEQ ID NO: 51873 - protein, 9 aa, Homo sapiens
WVHQACLQR

SEQ ID NO: 51874 - protein, 28 aa, Homo sapiens
NAVIGLNLYCGGAGLGAGSGGATRPGGR

SEQ ID NO: 51875 - protein, 20 aa, Homo sapiens
VARPPPIGAEVPDVTATPAR

SEQ ID NO: 51876 - protein, 21 aa, Homo sapiens
SESTDSLGGLSPSEVTAIQCK

SEQ ID NO: 51877 - protein, 5 aa, Homo sapiens
VYFFK

SEQ ID NO: 51878 - protein, 22 aa, Homo sapiens
VYYMVVCLVAFTIVMVLNITRL

SEQ ID NO: 51879 - protein, 10 aa, Homo sapiens
EQARPEQEYK

SEQ ID NO: 51880 - protein, 10 aa, Homo sapiens
LVEVAFESLR

SEQ ID NO: 51881 - protein, 28 aa, Homo sapiens
MFRMLNSSFEDDPFFSESILAHRENMRQ

SEQ ID NO: 51882 - protein, 30 aa, Homo sapiens
RLAVTNLTAVNLLAYVGDLVYSAHLVFVKV

SEQ ID NO: 51883 - protein, 29 aa, Homo sapiens
AASIVLAAGWSRPETATPPSRPPPAEGFR

SEQ ID NO: 51884 - protein, 16 aa, Homo sapiens
SADWLGLFAPHHGPPR

SEQ ID NO: 51885 - protein, 23 aa, Homo sapiens
HHLDLGHNSQAYEALTQIPDSSR

SEQ ID NO: 51886 - protein, 21 aa, Homo sapiens
KFQNCSVLPGGVYVSETQNRV

SEQ ID NO: 51887 - protein, 27 aa, Homo sapiens
LLDVIGLPELVIQLATSAITEAGDDWK

SEQ ID NO: 51888 - protein, 13 aa, Homo sapiens
VQNNLYHHCVINK

SEQ ID NO: 51889 - protein, 22 aa, Homo sapiens
HGAPSPSHPISAPQAAAAAALR

SEQ ID NO: 51890 - protein, 33 aa, Homo sapiens
QTSLWSLSSAVPSQSSIHSFDSDLESLCNALLK

SEQ ID NO: 51891 - protein, 24 aa, Homo sapiens
DIIEHLNTSGAPADTSDPLQQICK

SEQ ID NO: 51892 - protein, 21 aa, Homo sapiens
ILNAHMDSLQWIDQNSALLQR

SEQ ID NO: 51893 - protein, 36 aa, Homo sapiens
RYPIIMNKVVYVLLTSVSWLSGGINSTVQTSLAMRW

SEQ ID NO: 51894 - protein, 14 aa, Homo sapiens
YFWLVVAAFFNVSK

SEQ ID NO: 51895 - protein, 24 aa, Homo sapiens
LSSLSPVNSSNHGPVSTGSLTNRS

SEQ ID NO: 51896 - protein, 20 aa, Homo sapiens
NGCGTGNETDSDGRINHGRI

SEQ ID NO: 51897 - protein, 13 aa, Homo sapiens
AHSSMVGVNLPHK

SEQ ID NO: 51898 - protein, 17 aa, Homo sapiens
ALENPVRPFLAILGGAK

SEQ ID NO: 51899 - protein, 7 aa, Homo sapiens
ASGFLMK

SEQ ID NO: 51900 - protein, 20 aa, Homo sapiens
ASLSKLGDVYVNDAFGTAHR

SEQ ID NO: 51901 - protein, 19 aa, Homo sapiens
AVVLMSHLGRPDGVPMPDK

SEQ ID NO: 51902 - protein, 9 aa, Homo sapiens
DCVGAEVEK

SEQ ID NO: 51903 - protein, 8 aa, Homo sapiens
FHVEEEGK

SEQ ID NO: 51904 - protein, 12 aa, Homo sapiens
IKAEPDKIEAFR

SEQ ID NO: 51905 - protein, 11 aa, Homo sapiens
ILPGVEALSNM

SEQ ID NO: 51906 - protein, 21 aa, Homo sapiens
ITFPVDFVTGDKFDENAQVGK

SEQ ID NO: 51907 - protein, 15 aa, Homo sapiens
LGDVYVNDAFGTAHR

SEQ ID NO: 51908 - protein, 10 aa, Homo sapiens
NHAQVVAQAR

SEQ ID NO: 51909 - protein, 8 aa, Homo sapiens
NQITNNQR

SEQ ID NO: 51910 - protein, 8 aa, Homo sapiens
VDFNVPMK

SEQ ID NO: 51911 - protein, 18 aa, Homo sapiens
VSHVSTGGGASLELLEGK

SEQ ID NO: 51912 - protein, 24 aa, Homo sapiens
WNTEDKVSHVSTGGGASLELLEGK

SEQ ID NO: 51913 - protein, 11 aa, Homo sapiens
YSLAPVAVELK

SEQ ID NO: 51914 - protein, 23 aa, Homo sapiens
RLYQQFNENNSIGETQARKLSKL

SEQ ID NO: 51915 - protein, 17 aa, Homo sapiens
ISTLTIEEGNLDIQRPK

SEQ ID NO: 51916 - protein, 16 aa, Homo sapiens
NPDLCDFTIDHQSCSR

SEQ ID NO: 51917 - protein, 9 aa, Homo sapiens
VHAALVYHK

SEQ ID NO: 51918 - protein, 21 aa, Homo sapiens
VTFSEDDEIINPEDVDPSVGR

SEQ ID NO: 51919 - protein, 23 aa, Homo sapiens
LHAATPPTFGVDLINELVENFGR

SEQ ID NO: 51920 - protein, 16 aa, Homo sapiens
SDLQDELDINELPNCK

SEQ ID NO: 51921 - protein, 14 aa, Homo sapiens
TPLPEIDLDIELEQ

SEQ ID NO: 51922 - protein, 11 aa, Homo sapiens
AASAYAVGDVK

SEQ ID NO: 51923 - protein, 20 aa, Homo sapiens
ADEHVIDQGDDGDNFYVIER

SEQ ID NO: 51924 - protein, 12 aa, Homo sapiens
APASVLPAATPR

SEQ ID NO: 51925 - protein, 15 aa, Homo sapiens
GQYFGELALVTNKPR

SEQ ID NO: 51926 - protein, 14 aa, Homo sapiens
GSFGELALMYNTPR

SEQ ID NO: 51927 - protein, 9 aa, Homo sapiens
GTYDILVTK

SEQ ID NO: 51928 - protein, 8 aa, Homo sapiens
IVDVIGEK

SEQ ID NO: 51929 - protein, 11 aa, Homo sapiens
NISHYEEQLVK

SEQ ID NO: 51930 - protein, 17 aa, Homo sapiens
NLDQEQLSQVLDAMFER

SEQ ID NO: 51931 - protein, 19 aa, Homo sapiens
RPFGISALIVGFDDDGISR

SEQ ID NO: 51932 - protein, 11 aa, Homo sapiens
FEIWDTAGQER

SEQ ID NO: 51933 - protein, 12 aa, Homo sapiens
GVDLTEPTQPTR

SEQ ID NO: 51934 - protein, 11 aa, Homo sapiens
LVLLGESAVGK

SEQ ID NO: 51935 - protein, 10 aa, Homo sapiens
DGTSCVVAVK

SEQ ID NO: 51936 - protein, 12 aa, Homo sapiens
KQNTAVNSSSRN

SEQ ID NO: 51937 - protein, 20 aa, Homo sapiens
MFKEQQLQIFNLMKFDSYTR

SEQ ID NO: 51938 - protein, 13 aa, Homo sapiens
NHSATGEERTLGK

SEQ ID NO: 51939 - protein, 11 aa, Homo sapiens
NMIFENPSLCA

SEQ ID NO: 51940 - protein, 27 aa, Homo sapiens
RAGYGFTLSGQAPCVLSCVMRGSPADF

SEQ ID NO: 51941 - protein, 19 aa, Homo sapiens
IPCDVTEAEIISLGLPFGK

SEQ ID NO: 51942 - protein, 20 aa, Homo sapiens
KIPCDVTEAEIISLGLPFGK

SEQ ID NO: 51943 - protein, 11 aa, Homo sapiens
NLFIEAGCSVK

SEQ ID NO: 51944 - protein, 20 aa, Homo sapiens
NNQFQALLQYADPVNAHYAK

SEQ ID NO: 51945 - protein, 9 aa, Homo sapiens
FTEEIEWLK

SEQ ID NO: 51946 - protein, 7 aa, Homo sapiens
HILDDIR

SEQ ID NO: 51947 - protein, 16 aa, Homo sapiens
QIVSSQNGLSAWTSWR

SEQ ID NO: 51948 - protein, 35 aa, Homo sapiens
KNMALFEEEMDTSPMVSSLLSGLANYTNLPQGSRE

SEQ ID NO: 51949 - protein, 18 aa, Homo sapiens
KVFISNSTNSSNPCERRS

SEQ ID NO: 51950 - protein, 21 aa, Homo sapiens
REDEMEENLTQVGSILGNLKD

SEQ ID NO: 51951 - protein, 20 aa, Homo sapiens
MASCDINGEDEKGGKNRSKS

SEQ ID NO: 51952 - protein, 31 aa, Homo sapiens
AGPELLPQQGGGRGGEMQVEAGGTSPAGERR

SEQ ID NO: 51953 - protein, 14 aa, Homo sapiens
AVASQWPEELASAR

SEQ ID NO: 51954 - protein, 31 aa, Homo sapiens
RAGPELLPQQGGGRGGEMQVEAGGTSPAGER

SEQ ID NO: 51955 - protein, 15 aa, Homo sapiens
RNKEVNISAVVWPSQ

SEQ ID NO: 51956 - protein, 19 aa, Homo sapiens
KVRRPSPNRSKLSNVARKA

SEQ ID NO: 51957 - protein, 8 aa, Homo sapiens
LVSNETLR

SEQ ID NO: 51958 - protein, 22 aa, Homo sapiens
HFNPVCGSDMSTYANECTLCMK

SEQ ID NO: 51959 - protein, 7 aa, Homo sapiens
IIRNGPC

SEQ ID NO: 51960 - protein, 9 aa, Homo sapiens
IREGGHNIK

SEQ ID NO: 51961 - protein, 8 aa, Homo sapiens
TPNCSQYR

SEQ ID NO: 51962 - protein, 10 aa, Homo sapiens
YRTPNCSQYR

SEQ ID NO: 51963 - protein, 24 aa, Homo sapiens
KRYEDGTISSNATHVEHPLCPPKP

SEQ ID NO: 51964 - protein, 22 aa, Homo sapiens
WDENVTGFEIIQSITDTLCVSR

SEQ ID NO: 51965 - protein, 26 aa, Homo sapiens
YEDGTISSNATHVEHPLCPPKPGFVR

SEQ ID NO: 51966 - protein, 12 aa, Homo sapiens
ENLIAELEEKKK

SEQ ID NO: 51967 - protein, 16 aa, Homo sapiens
RQLQQLQEGTLQEYQK

SEQ ID NO: 51968 - protein, 30 aa, Homo sapiens
GPQREALPMDTEVYESPYADPEEIRPKEVY

SEQ ID NO: 51969 - protein, 24 aa, Homo sapiens
THASPADLCHYHSQESDGLVCLLK

SEQ ID NO: 51970 - protein, 26 aa, Homo sapiens
GHGDSVDQLCWHPSNPDLFVTASGDK

SEQ ID NO: 51971 - protein, 18 aa, Homo sapiens
LWEVQCESPTFTVAWHPK

SEQ ID NO: 51972 - protein, 14 aa, Homo sapiens
RPLLAFACDDKDGK

SEQ ID NO: 51973 - protein, 23 aa, Homo sapiens
YFATGSADALVSLWDVDELVCVR

SEQ ID NO: 51974 - protein, 40 aa, Homo sapiens
RSQSSSQSPASHRNPTGAHSSSGHQSQSPNTSPPPKRHKK

SEQ ID NO: 51975 - protein, 17 aa, Homo sapiens
SSPDLTGVVHIYEELKR

SEQ ID NO: 51976 - protein, 23 aa, Homo sapiens
VSNEEVTEELLHVNDDLNNVFLR

SEQ ID NO: 51977 - protein, 36 aa, Homo sapiens
ATAQPPAPLSPDSGSPSPDSGSASPVEEEDVGSSEK

SEQ ID NO: 51978 - protein, 15 aa, Homo sapiens
DKEAELQCTQLDLER

SEQ ID NO: 51979 - protein, 19 aa, Homo sapiens
EQFLQYAYDITFDPDTAHK

SEQ ID NO: 51980 - protein, 18 aa, Homo sapiens
KVITESTVHLIQLLENYK

SEQ ID NO: 51981 - protein, 17 aa, Homo sapiens
VITESTVHLIQLLENYK

SEQ ID NO: 51982 - protein, 17 aa, Homo sapiens
VTNTTPWEHPYPDLPSR

SEQ ID NO: 51983 - protein, 36 aa, Homo sapiens
KELLLTLDDSFNDVGSDNSNQSSPRLRLPSPSMDKI

SEQ ID NO: 51984 - protein, 29 aa, Homo sapiens
RHSNVVILTTSNITEKIDVAFVDRADIKQ

SEQ ID NO: 51985 - protein, 14 aa, Homo sapiens
KALKQYNSTGDYRS

SEQ ID NO: 51986 - protein, 13 aa, Homo sapiens
VSLENYFSLLNEK

SEQ ID NO: 51987 - protein, 14 aa, Homo sapiens
LIGQIVSSITASLR

SEQ ID NO: 51988 - protein, 24 aa, Homo sapiens
KHLSDYCIGPNASINVIMQPLEKM

SEQ ID NO: 51989 - protein, 21 aa, Homo sapiens
KLTKNMLCAGYKNESYDACKG

SEQ ID NO: 51990 - protein, 16 aa, Homo sapiens
HITEEELSVLESCLHR

SEQ ID NO: 51991 - protein, 12 aa, Homo sapiens
LLDWLEDAFQMK

SEQ ID NO: 51992 - protein, 12 aa, Homo sapiens
LPSYSTHELCER

SEQ ID NO: 51993 - protein, 20 aa, Homo sapiens
AQPTPSSSATQSKPTPVKPN

SEQ ID NO: 51994 - protein, 29 aa, Homo sapiens
LQGHTDVVISTACHPTENIIASAALENDK

SEQ ID NO: 51995 - protein, 16 aa, Homo sapiens
TLPAHSDPVSAVHFNR

SEQ ID NO: 51996 - protein, 12 aa, Homo sapiens
WGDIKINIIGEK

SEQ ID NO: 51997 - protein, 28 aa, Homo sapiens
ECEKSFSQSSSLSRHKRIHTREKPYKCE

SEQ ID NO: 51998 - protein, 13 aa, Homo sapiens
YDMSFNQNSASGK

SEQ ID NO: 51999 - protein, 11 aa, Homo sapiens
FFNQQVEILGR

SEQ ID NO: 52000 - protein, 15 aa, Homo sapiens
NAELIDPSFQWYGPK

SEQ ID NO: 52001 - protein, 23 aa, Homo sapiens
KGACNGSVDCEDTTNHNILQARD

SEQ ID NO: 52002 - protein, 20 aa, Homo sapiens
AAAVSSGFDGAIQLVSLGGR

SEQ ID NO: 52003 - protein, 15 aa, Homo sapiens
ALEPQGLLLYNGNAR

SEQ ID NO: 52004 - protein, 21 aa, Homo sapiens
ALGPAGCEADASAPATCAEMR

SEQ ID NO: 52005 - protein, 12 aa, Homo sapiens
ALQSNHFELSLR

SEQ ID NO: 52006 - protein, 15 aa, Homo sapiens
ASGHPCLNGASCVPR

SEQ ID NO: 52007 - protein, 11 aa, Homo sapiens
AYGTGFVGCLR

SEQ ID NO: 52008 - protein, 14 aa, Homo sapiens
EAACLQQTQIEEAR

SEQ ID NO: 52009 - protein, 13 aa, Homo sapiens
EPLYVGGAPDFSK

SEQ ID NO: 52010 - protein, 9 aa, Homo sapiens
ESLLDGGNK

SEQ ID NO: 52011 - protein, 17 aa, Homo sapiens
FDGPCDPCQGALPDPSR

SEQ ID NO: 52012 - protein, 23 aa, Homo sapiens
FDTGSGPAVLTSAVPVEPGQWHR

SEQ ID NO: 52013 - protein, 11 aa, Homo sapiens
FGALCEAETGR

SEQ ID NO: 52014 - protein, 8 aa, Homo sapiens
FNAVCLSR

SEQ ID NO: 52015 - protein, 23 aa, Homo sapiens
GAPEGTVCGSDGADYPGECQLLR

SEQ ID NO: 52016 - protein, 9 aa, Homo sapiens
GDFVSLALR

SEQ ID NO: 52017 - protein, 7 aa, Homo sapiens
GIVTDGR

SEQ ID NO: 52018 - protein, 13 aa, Homo sapiens
GKDFLALALLDGR

SEQ ID NO: 52019 - protein, 11 aa, Homo sapiens
GLYVAAQGACR

SEQ ID NO: 52020 - protein, 12 aa, Homo sapiens
GPSGLLLYNGQK

SEQ ID NO: 52021 - protein, 21 aa, Homo sapiens
HPLHLLEDAVTKPELRPCPTP

SEQ ID NO: 52022 - protein, 18 aa, Homo sapiens
KFDGPCDPCQGALPDPSR

SEQ ID NO: 52023 - protein, 13 aa, Homo sapiens
KNELMLNSSLMRI

SEQ ID NO: 52024 - protein, 12 aa, Homo sapiens
LELGIGPGAATR

SEQ ID NO: 52025 - protein, 8 aa, Homo sapiens
LLDVNNQR

SEQ ID NO: 52026 - protein, 8 aa, Homo sapiens
LRDLGPGK

SEQ ID NO: 52027 - protein, 20 aa, Homo sapiens
QAPVCGDDGVTYENDCVMGR

SEQ ID NO: 52028 - protein, 18 aa, Homo sapiens
RDPCSNVTCSFGSTCARS

SEQ ID NO: 52029 - protein, 33 aa, Homo sapiens
RGPTFAPLPPVAPLHCAQTPYGCCQDNITAARG

SEQ ID NO: 52030 - protein, 8 aa, Homo sapiens
RPLQEHVR

SEQ ID NO: 52031 - protein, 16 aa, Homo sapiens
SADGLTASCLCPATCR

SEQ ID NO: 52032 - protein, 13 aa, Homo sapiens
SAGDVDTLAFDGR

SEQ ID NO: 52033 - protein, 9 aa, Homo sapiens
SELFGETAR

SEQ ID NO: 52034 - protein, 9 aa, Homo sapiens
SFLAFPTLR

SEQ ID NO: 52035 - protein, 15 aa, Homo sapiens
SGCTPCSCDPQGAVR

SEQ ID NO: 52036 - protein, 26 aa, Homo sapiens
SPCPSVVAPVCGSDASTYSNECELQR

SEQ ID NO: 52037 - protein, 12 aa, Homo sapiens
SREPVTLGAWTR

SEQ ID NO: 52038 - protein, 9 aa, Homo sapiens
STVPVNTNR

SEQ ID NO: 52039 - protein, 13 aa, Homo sapiens
TDGKGDFVSLALR

SEQ ID NO: 52040 - protein, 13 aa, Homo sapiens
TEATQGLVLWSGK

SEQ ID NO: 52041 - protein, 14 aa, Homo sapiens
TFVEYLNAVTESEK

SEQ ID NO: 52042 - protein, 8 aa, Homo sapiens
TFVGAGLR

SEQ ID NO: 52043 - protein, 15 aa, Homo sapiens
TPSLDAEGSNCPATK

SEQ ID NO: 52044 - protein, 8 aa, Homo sapiens
TYDSDCWR

SEQ ID NO: 52045 - protein, 16 aa, Homo sapiens
VCGSDGVTYGNECQLK

SEQ ID NO: 52046 - protein, 9 aa, Homo sapiens
VGPTCADEK

SEQ ID NO: 52047 - protein, 12 aa, Homo sapiens
VLGAPVPAFEGR

SEQ ID NO: 52048 - protein, 15 aa, Homo sapiens
VLGESPVPHTVLNLK

SEQ ID NO: 52049 - protein, 28 aa, Homo sapiens
VLGESPVPHTVLNLKEPLYVGGAPDFSK

SEQ ID NO: 52050 - protein, 15 aa, Homo sapiens
VLPEGGAQCECPLGR

SEQ ID NO: 52051 - protein, 11 aa, Homo sapiens
VTYENDCVMGR

SEQ ID NO: 52052 - protein, 22 aa, Homo sapiens
VVISGFGDPLICDNQVSTGDTR

SEQ ID NO: 52053 - protein, 22 aa, Homo sapiens
MTNYSFHCNVCHHSGNTYFLRK

SEQ ID NO: 52054 - protein, 10 aa, Homo sapiens
DPFLGFTDAR

SEQ ID NO: 52055 - protein, 31 aa, Homo sapiens
RRLRELAGNSSTPPPVSPGRGNPMHRLLNPF

SEQ ID NO: 52056 - protein, 12 aa, Homo sapiens
WHGEHLLTNDVK

SEQ ID NO: 52057 - protein, 22 aa, Homo sapiens
KLFSDIENISEETSAEVHPISL

SEQ ID NO: 52058 - protein, 20 aa, Homo sapiens
KLSNNLNVEGGSSENNHSIK

SEQ ID NO: 52059 - protein, 27 aa, Homo sapiens
MNKWAGLLGPISNHSFGGSFRTASNKE

SEQ ID NO: 52060 - protein, 8 aa, Homo sapiens
QATQVSIK

SEQ ID NO: 52061 - protein, 27 aa, Homo sapiens
QLYTYGVSKHCIKINSKNAESFQFHTE

SEQ ID NO: 52062 - protein, 13 aa, Homo sapiens
VYNPSGLNLSIKG

SEQ ID NO: 52063 - protein, 11 aa, Homo sapiens
RGNFSNEEWKE

SEQ ID NO: 52064 - protein, 18 aa, Homo sapiens
KGNFSDKEVAELEEIFRV

SEQ ID NO: 52065 - protein, 11 aa, Homo sapiens
FSFVNQSWARG

SEQ ID NO: 52066 - protein, 18 aa, Homo sapiens
KGNFSNEELSDLELLFRF

SEQ ID NO: 52067 - protein, 25 aa, Homo sapiens
RTDGLAWLGELQTHSWSNDSDTVRS

SEQ ID NO: 52068 - protein, 37 aa, Homo sapiens
RVYLDTVSGSLTIYNLTSSDEDEYEMESPNITDTMKF

SEQ ID NO: 52069 - protein, 11 aa, Homo sapiens
AMALLKSSKYQ

SEQ ID NO: 52070 - protein, 10 aa, Homo sapiens
EGTAGKAKVK

SEQ ID NO: 52071 - protein, 8 aa, Homo sapiens
ELLNLCSG

SEQ ID NO: 52072 - protein, 19 aa, Homo sapiens
KKEPSLESGVHSFEEGSEL

SEQ ID NO: 52073 - protein, 16 aa, Homo sapiens
LEKEERKMEKIRQLKK

SEQ ID NO: 52074 - protein, 22 aa, Homo sapiens
SALNLPYHMPENKTIHDFFKRK

SEQ ID NO: 52075 - protein, 26 aa, Homo sapiens
TNASPEKTTYDSAEEENKENLYAGKN

SEQ ID NO: 52076 - protein, 26 aa, Homo sapiens
KSAMPIEVMMNETAQQNMENHPVIRT

SEQ ID NO: 52077 - protein, 21 aa, Homo sapiens
SISFHPSGDFILVGTQHPTLR

SEQ ID NO: 52078 - protein, 26 aa, Homo sapiens
TLYDHVDEVTCLAFHPTEQILASGSR

SEQ ID NO: 52079 - protein, 22 aa, Homo sapiens
KYRPENSVANDTGFTVVAPGKE

SEQ ID NO: 52080 - protein, 15 aa, Homo sapiens
AVYSTNCPVWEEAFR

SEQ ID NO: 52081 - protein, 15 aa, Homo sapiens
DPPDPYVSLLLLPDK

SEQ ID NO: 52082 - protein, 27 aa, Homo sapiens
GEGTGVLGSLSLPLSELLVADQLCLDR

SEQ ID NO: 52083 - protein, 13 aa, Homo sapiens
GSNPHLQTFTFTR

SEQ ID NO: 52084 - protein, 26 aa, Homo sapiens
GSSVDAPPRPCHTTPDSQFGTEHVLR

SEQ ID NO: 52085 - protein, 16 aa, Homo sapiens
HLSPYATLTVGDSSHK

SEQ ID NO: 52086 - protein, 7 aa, Homo sapiens
IHLLAAR

SEQ ID NO: 52087 - protein, 12 aa, Homo sapiens
KPHTESLELQVR

SEQ ID NO: 52088 - protein, 10 aa, Homo sapiens
KSNSSFMSRE

SEQ ID NO: 52089 - protein, 18 aa, Homo sapiens
SLRAARQLLDDEEQLTAK

SEQ ID NO: 52090 - protein, 23 aa, Homo sapiens
VLQASVLDDWFPLQGGQGQVHLR

SEQ ID NO: 52091 - protein, 14 aa, Homo sapiens
WFTLSSGQGQVLLR

SEQ ID NO: 52092 - protein, 15 aa, Homo sapiens
RFQLSNSGPNSTIKM

SEQ ID NO: 52093 - protein, 11 aa, Homo sapiens
KTNNVNVSSRV

SEQ ID NO: 52094 - protein, 18 aa, Homo sapiens
KERVENYSNVSIHLKNPE

SEQ ID NO: 52095 - protein, 26 aa, Homo sapiens
KHYQTVFLMRSNSTLNKHNENYKQKK

SEQ ID NO: 52096 - protein, 15 aa, Homo sapiens
ISQSNYIPTQQDVLR

SEQ ID NO: 52097 - protein, 11 aa, Homo sapiens
LLLLGAGESGK

SEQ ID NO: 52098 - protein, 32 aa, Homo sapiens
SPLTICYPEYTGSNTYEEAAAYIQCQFEDLNR

SEQ ID NO: 52099 - protein, 17 aa, Homo sapiens
LEGPFNIESVMDPIDVK

SEQ ID NO: 52100 - protein, 15 aa, Homo sapiens
TFAQGLAVAGDVVSK

SEQ ID NO: 52101 - protein, 14 aa, Homo sapiens
TYGHLYMQNSELFK

SEQ ID NO: 52102 - protein, 16 aa, Homo sapiens
VSVVNPTAQCTHALLK

SEQ ID NO: 52103 - protein, 27 aa, Homo sapiens
GNKPDFHLAMPTEQAEGFYNSFLEQLR

SEQ ID NO: 52104 - protein, 24 aa, Homo sapiens
IQNDGPVTIELESPAPGTATSDPK

SEQ ID NO: 52105 - protein, 12 aa, Homo sapiens
AGIATHFVDSEK

SEQ ID NO: 52106 - protein, 6 aa, Homo sapiens
FNAFKR

SEQ ID NO: 52107 - protein, 30 aa, Homo sapiens
INSCFSANTVEEIIENLQQDGSSFALEQLK

SEQ ID NO: 52108 - protein, 13 aa, Homo sapiens
KGCTGVITLNRPK

SEQ ID NO: 52109 - protein, 23 aa, Homo sapiens
GTSLSSESILSLEGSSSTAGGSK

SEQ ID NO: 52110 - protein, 13 aa, Homo sapiens
SQFGSPGPSDAAR

SEQ ID NO: 52111 - protein, 22 aa, Homo sapiens
KCHAGYIGDNCNCSTDISTCRG

SEQ ID NO: 52112 - protein, 21 aa, Homo sapiens
KNFTALIPGTTVEILDGDSKN

SEQ ID NO: 52113 - protein, 21 aa, Homo sapiens
MVNNVTPARAVVSLINGGQRY

SEQ ID NO: 52114 - protein, 11 aa, Homo sapiens
FVSSLLTALFR

SEQ ID NO: 52115 - protein, 33 aa, Homo sapiens
NTVIPLQQGEEEEEEEEAFYEDLDDILESITNR

SEQ ID NO: 52116 - protein, 18 aa, Homo sapiens
KELLNETEEEINKALNKK

SEQ ID NO: 52117 - protein, 10 aa, Homo sapiens
DNAELENLIR

SEQ ID NO: 52118 - protein, 9 aa, Homo sapiens
ETMQFLNDR

SEQ ID NO: 52119 - protein, 15 aa, Homo sapiens
EVEQWFATQTEELNK

SEQ ID NO: 52120 - protein, 12 aa, Homo sapiens
ITNVESQLAEIR

SEQ ID NO: 52121 - protein, 7 aa, Homo sapiens
LASYLEK

SEQ ID NO: 52122 - protein, 9 aa, Homo sapiens
LECEINTYR

SEQ ID NO: 52123 - protein, 21 aa, Homo sapiens
LNVEVDAAPAVDLNQVLNETR

SEQ ID NO: 52124 - protein, 9 aa, Homo sapiens
LVVQIDNAK

SEQ ID NO: 52125 - protein, 11 aa, Homo sapiens
NQYEALVETNR

SEQ ID NO: 52126 - protein, 11 aa, Homo sapiens
QLVESDINSLR

SEQ ID NO: 52127 - protein, 11 aa, Homo sapiens
QNHEQEVNTLR

SEQ ID NO: 52128 - protein, 12 aa, Homo sapiens
QNQEYQVLLDVR

SEQ ID NO: 52129 - protein, 20 aa, Homo sapiens
QVVSSSEQLQSYQAEIIELR

SEQ ID NO: 52130 - protein, 18 aa, Homo sapiens
SDLEAQMESLKEELLSLK

SEQ ID NO: 52131 - protein, 8 aa, Homo sapiens
TIEELQQK

SEQ ID NO: 52132 - protein, 16 aa, Homo sapiens
TVNALEIELQAQHNLR

SEQ ID NO: 52133 - protein, 6 aa, Homo sapiens
VLNETR

SEQ ID NO: 52134 - protein, 13 aa, Homo sapiens
YSLENTLTESEAR

SEQ ID NO: 52135 - protein, 23 aa, Homo sapiens
YSSQLSQVQSLITNVESQLAEIR

SEQ ID NO: 52136 - protein, 20 aa, Homo sapiens
ISAQYANFTGCISNAYFTRV

SEQ ID NO: 52137 - protein, 14 aa, Homo sapiens
ISLDNGTVIMDVKG

SEQ ID NO: 52138 - protein, 33 aa, Homo sapiens
KALDASNVYENIVNYVSEANETAEFALNTTDRI

SEQ ID NO: 52139 - protein, 33 aa, Homo sapiens
KLSNLSNLSHDLVQEAIDHAQDLQQEANELSRK

SEQ ID NO: 52140 - protein, 14 aa, Homo sapiens
KRPASNVSASIQRI

SEQ ID NO: 52141 - protein, 23 aa, Homo sapiens
REQMEVVNMSLSTSADSLTTPRL

SEQ ID NO: 52142 - protein, 26 aa, Homo sapiens
RLTLSELDDIIKNASGIYAEIDGAKS

SEQ ID NO: 52143 - protein, 16 aa, Homo sapiens
RNLTEVVPQLLDQLRT

SEQ ID NO: 52144 - protein, 21 aa, Homo sapiens
RTPADNGLILLMVNGSMFFRL

SEQ ID NO: 52145 - protein, 11 aa, Homo sapiens
AAYEAELGDAR

SEQ ID NO: 52146 - protein, 25 aa, Homo sapiens
AGQVVTIWAAGAGATHSPPTDLVWK

SEQ ID NO: 52147 - protein, 12 aa, Homo sapiens
AQNTWGCGNSLR

SEQ ID NO: 52148 - protein, 16 aa, Homo sapiens
ASSHSSQTQGGGSVTK

SEQ ID NO: 52149 - protein, 13 aa, Homo sapiens
IDSLSAQLSQLQK

SEQ ID NO: 52150 - protein, 9 aa, Homo sapiens
LADALQELR

SEQ ID NO: 52151 - protein, 11 aa, Homo sapiens
LALDMEIHAYR

SEQ ID NO: 52152 - protein, 11 aa, Homo sapiens
LKDLEALLNSK

SEQ ID NO: 52153 - protein, 13 aa, Homo sapiens
LQEKEDLQELNDR

SEQ ID NO: 52154 - protein, 15 aa, Homo sapiens
MQQQLDEYQELLDIK

SEQ ID NO: 52155 - protein, 16 aa, Homo sapiens
NSNLVGAAHEELQQSR

SEQ ID NO: 52156 - protein, 26 aa, Homo sapiens
SVTVVEDDEDEDGDDLLHHHHVSGSR

SEQ ID NO: 52157 - protein, 10 aa, Homo sapiens
TLEGELHDLR

SEQ ID NO: 52158 - protein, 27 aa, Homo sapiens
ASASGSGAQVGGPISSGSSASSVTVTR

SEQ ID NO: 52159 - protein, 13 aa, Homo sapiens
SNEDQSMGNWQIK

SEQ ID NO: 52160 - protein, 17 aa, Homo sapiens
SVGGSGGGSFGDNLVTR

SEQ ID NO: 52161 - protein, 13 aa, Homo sapiens
TVLCGTCGQPADK

SEQ ID NO: 52162 - protein, 39 aa, Homo sapiens
KAQNTWGCGNSLRTALINSTGEGSHCSSSGDPAEYNLRS

SEQ ID NO: 52163 - protein, 8 aa, Homo sapiens
ELFIQQER

SEQ ID NO: 52164 - protein, 12 aa, Homo sapiens
ELSSYEDFLDAR

SEQ ID NO: 52165 - protein, 13 aa, Homo sapiens
FNEVTNQTLDVKR

SEQ ID NO: 52166 - protein, 9 aa, Homo sapiens
GFPLVTVQK

SEQ ID NO: 52167 - protein, 10 aa, Homo sapiens
GKELFIQQER

SEQ ID NO: 52168 - protein, 9 aa, Homo sapiens
GSSLLLMLK

SEQ ID NO: 52169 - protein, 15 aa, Homo sapiens
IIRDEQYTALSNMPK

SEQ ID NO: 52170 - protein, 12 aa, Homo sapiens
ILEALASSEDVR

SEQ ID NO: 52171 - protein, 13 aa, Homo sapiens
ILEALASSEDVRK

SEQ ID NO: 52172 - protein, 11 aa, Homo sapiens
INPYVLSDKDR

SEQ ID NO: 52173 - protein, 32 aa, Homo sapiens
KDSLNSSHPISSSVQSSEQIEEMFDSLSYFKG

SEQ ID NO: 52174 - protein, 26 aa, Homo sapiens
KLFDDWMASNGTQSLPTDVMTTVFKV

SEQ ID NO: 52175 - protein, 16 aa, Homo sapiens
KSGVINLTEEVLWVKV

SEQ ID NO: 52176 - protein, 14 aa, Homo sapiens
KYFAATQFEPLAAR

SEQ ID NO: 52177 - protein, 9 aa, Homo sapiens
LGYMDLASR

SEQ ID NO: 52178 - protein, 20 aa, Homo sapiens
LLQNQIQQQTWTDEGTPSMR

SEQ ID NO: 52179 - protein, 9 aa, Homo sapiens
LPTAVVPLR

SEQ ID NO: 52180 - protein, 18 aa, Homo sapiens
REETLLYDSNTSSMADRK

SEQ ID NO: 52181 - protein, 23 aa, Homo sapiens
RSALLEFACTHNLGNCSTTAMKL

SEQ ID NO: 52182 - protein, 12 aa, Homo sapiens
SAFPCFDEPAFK

SEQ ID NO: 52183 - protein, 9 aa, Homo sapiens
SSLNGDNFR

SEQ ID NO: 52184 - protein, 19 aa, Homo sapiens
SSVVLDDGLVQDEFSESVK

SEQ ID NO: 52185 - protein, 11 aa, Homo sapiens
TDKGWSFLLGK

SEQ ID NO: 52186 - protein, 12 aa, Homo sapiens
VTFMSAVSSQEK

SEQ ID NO: 52187 - protein, 13 aa, Homo sapiens
YFAATQFEPLAAR

SEQ ID NO: 52188 - protein, 10 aa, Homo sapiens
YISIGSEAEK

SEQ ID NO: 52189 - protein, 9 aa, Homo sapiens
YQSVSLLDK

SEQ ID NO: 52190 - protein, 10 aa, Homo sapiens
YQSVSLLDKK

SEQ ID NO: 52191 - protein, 25 aa, Homo sapiens
KGDYNDSVQVVDCGLSLNDTAFEKM

SEQ ID NO: 52192 - protein, 16 aa, Homo sapiens
SHLLDCCPHDILAGTR

SEQ ID NO: 52193 - protein, 17 aa, Homo sapiens
KDGHGTAISNASDVWKK

SEQ ID NO: 52194 - protein, 12 aa, Homo sapiens
KIANISGDGQKW

SEQ ID NO: 52195 - protein, 10 aa, Homo sapiens
KYNVSSLEKY

SEQ ID NO: 52196 - protein, 21 aa, Homo sapiens
RKPLNNTVELTDVWTYSDTRC

SEQ ID NO: 52197 - protein, 24 aa, Homo sapiens
EEGSEQAPLMSEDELINIIDGVLR

SEQ ID NO: 52198 - protein, 24 aa, Homo sapiens
MHDYDGNNLLDGLELSTAITHVHK

SEQ ID NO: 52199 - protein, 18 aa, Homo sapiens
GSYTAQFEHTILLRPTCK

SEQ ID NO: 52200 - protein, 18 aa, Homo sapiens
NLCDLGIVDPYPPLCDIK

SEQ ID NO: 52201 - protein, 21 aa, Homo sapiens
VQTDPPSVPICDLYPNGVFPK

SEQ ID NO: 52202 - protein, 17 aa, Homo sapiens
NLVDFLTGEEVVCHVAR

SEQ ID NO: 52203 - protein, 19 aa, Homo sapiens
QSGGTTALPLYFVGLYCDK

SEQ ID NO: 52204 - protein, 18 aa, Homo sapiens
SEKPNWDYHAEIQAFGHR

SEQ ID NO: 52205 - protein, 21 aa, Homo sapiens
KCSVALLNETESVLSYLDKED

SEQ ID NO: 52206 - protein, 13 aa, Homo sapiens
ALGQNPTNAEVLK

SEQ ID NO: 52207 - protein, 13 aa, Homo sapiens
DQGTYEDYVEGLR

SEQ ID NO: 52208 - protein, 9 aa, Homo sapiens
HVLVTLGEK

SEQ ID NO: 52209 - protein, 27 aa, Homo sapiens
MTEEEVEMLVAGHEDSNGCINYEELVR

SEQ ID NO: 52210 - protein, 16 aa, Homo sapiens
VLDFEHFLPMLQTVAK

SEQ ID NO: 52211 - protein, 17 aa, Homo sapiens
ALIGATNPADAPPGTIR

SEQ ID NO: 52212 - protein, 10 aa, Homo sapiens
LVQASEELLR

SEQ ID NO: 52213 - protein, 11 aa, Homo sapiens
AATSDLEHYDK

SEQ ID NO: 52214 - protein, 18 aa, Homo sapiens
AKLDSLQDIGMDHQALLK

SEQ ID NO: 52215 - protein, 13 aa, Homo sapiens
EHVMNEVDTNKDR

SEQ ID NO: 52216 - protein, 10 aa, Homo sapiens
ELDLVSHHVR

SEQ ID NO: 52217 - protein, 15 aa, Homo sapiens
IEPPDTGLYYDEYLK

SEQ ID NO: 52218 - protein, 16 aa, Homo sapiens
LDSLQDIGMDHQALLK

SEQ ID NO: 52219 - protein, 13 aa, Homo sapiens
LEYHQVIQQMEQK

SEQ ID NO: 52220 - protein, 21 aa, Homo sapiens
LHDVNSDGFLDEQELEALFTK

SEQ ID NO: 52221 - protein, 9 aa, Homo sapiens
LVTLEEFLK

SEQ ID NO: 52222 - protein, 15 aa, Homo sapiens
MREHVMNEVDTNKDR

SEQ ID NO: 52223 - protein, 7 aa, Homo sapiens
QKEELQR

SEQ ID NO: 52224 - protein, 13 aa, Homo sapiens
QVIDVLETDKHFR

SEQ ID NO: 52225 - protein, 11 aa, Homo sapiens
VQNIHPVESAK

SEQ ID NO: 52226 - protein, 18 aa, Homo sapiens
MGMEGLLQNSTNFVLTGL

SEQ ID NO: 52227 - protein, 28 aa, Homo sapiens
KMNELENKAEPGTHLCIDVEDAMNITRK

SEQ ID NO: 52228 - protein, 13 aa, Homo sapiens
RAAGNTSESQSCA

SEQ ID NO: 52229 - protein, 23 aa, Homo sapiens
RLCQTCYPLFQQVVSKMDNISRA

SEQ ID NO: 52230 - protein, 23 aa, Homo sapiens
KGQEMNATGGDDPRNAAGGCERE

SEQ ID NO: 52231 - protein, 27 aa, Homo sapiens
TPVSYPLELSDLQELWDDLCEDYLPLR

SEQ ID NO: 52232 - protein, 16 aa, Homo sapiens
TQEQNIQHLNHSLSHK

SEQ ID NO: 52233 - protein, 13 aa, Homo sapiens
ASYFICHDQETIK

SEQ ID NO: 52234 - protein, 18 aa, Homo sapiens
ELNELVSAIEEHFFQPQK

SEQ ID NO: 52235 - protein, 19 aa, Homo sapiens
FVHTSVHGVGHSFVQSAFK

SEQ ID NO: 52236 - protein, 11 aa, Homo sapiens
IVLANDPDADR

SEQ ID NO: 52237 - protein, 33 aa, Homo sapiens
LAATTFISQGIPVYLFSDITPTPFVPFTVSHLK

SEQ ID NO: 52238 - protein, 21 aa, Homo sapiens
VKFVHTSVHGVGHSFVQSAFK

SEQ ID NO: 52239 - protein, 15 aa, Homo sapiens
VYWDNGAQIISPHDK

SEQ ID NO: 52240 - protein, 18 aa, Homo sapiens
YYAELCAPPGNSDPEQLK

SEQ ID NO: 52241 - protein, 19 aa, Homo sapiens
YYAELCAPPGNSDPEQLKK

SEQ ID NO: 52242 - protein, 19 aa, Homo sapiens
IQDSLYCAAGAWALALAYR

SEQ ID NO: 52243 - protein, 19 aa, Homo sapiens
KYNNGSTELHSSSVGLAKA

SEQ ID NO: 52244 - protein, 18 aa, Homo sapiens
LGLSGRPDRPIGCLGTSK

SEQ ID NO: 52245 - protein, 6 aa, Homo sapiens
QLDFLR

SEQ ID NO: 52246 - protein, 31 aa, Homo sapiens
SHNTDAALLPCISYPAFALDDEVLFSQTLDK

SEQ ID NO: 52247 - protein, 21 aa, Homo sapiens
ICDGIFYTPQYLNPSVISLLK

SEQ ID NO: 52248 - protein, 17 aa, Homo sapiens
NHQDPLAVAYHLIIDNR

SEQ ID NO: 52249 - protein, 25 aa, Homo sapiens
RQLCGLLLGGGGNRSHSTPYCGLRR

SEQ ID NO: 52250 - protein, 8 aa, Homo sapiens
ELMDLYLK

SEQ ID NO: 52251 - protein, 24 aa, Homo sapiens
RIRVDLPLGSPAVNCTVLPGGISV

SEQ ID NO: 52252 - protein, 13 aa, Homo sapiens
ENDSEDQDVAMKS

SEQ ID NO: 52253 - protein, 14 aa, Homo sapiens
KNEVIPGTSNSSRL

SEQ ID NO: 52254 - protein, 18 aa, Homo sapiens
KYSNMSTLGNNGPTHKKL

SEQ ID NO: 52255 - protein, 12 aa, Homo sapiens
MPNSSGLMNRRD

SEQ ID NO: 52256 - protein, 31 aa, Homo sapiens
IIDLEEAEDEIEDIQQEITVLSQCDSSYVTK

SEQ ID NO: 52257 - protein, 15 aa, Homo sapiens
SIAVAEAACPGITDK

SEQ ID NO: 52258 - protein, 17 aa, Homo sapiens
CSSLEQALAVLVTTFHK

SEQ ID NO: 52259 - protein, 16 aa, Homo sapiens
SSLEQALAVLVTTFHK

SEQ ID NO: 52260 - protein, 8 aa, Homo sapiens
YSCQEGDK

SEQ ID NO: 52261 - protein, 10 aa, Homo sapiens
YSCQEGDKFK

SEQ ID NO: 52262 - protein, 20 aa, Homo sapiens
MDYNATTPLEPEVIQAMTKA

SEQ ID NO: 52263 - protein, 32 aa, Homo sapiens
EEHVTCVQSILDEFLQTYGSLIPLSTDEVVEK

SEQ ID NO: 52264 - protein, 27 aa, Homo sapiens
ETIQGTGSWGPEPPGPGIPPAYSSPRR

SEQ ID NO: 52265 - protein, 20 aa, Homo sapiens
NHLSPQQGGATPQVPSPCCR

SEQ ID NO: 52266 - protein, 12 aa, Homo sapiens
CGGAGHIASDCK

SEQ ID NO: 52267 - protein, 13 aa, Homo sapiens
FQRPGDPQSAQDK

SEQ ID NO: 52268 - protein, 26 aa, Homo sapiens
HNLITEMVALNPDFKPPADYKPPATR

SEQ ID NO: 52269 - protein, 11 aa, Homo sapiens
ILRPWQSSETR

SEQ ID NO: 52270 - protein, 14 aa, Homo sapiens
RDNTSVYHISGKKK

SEQ ID NO: 52271 - protein, 11 aa, Homo sapiens
RQNSSPHLPKL

SEQ ID NO: 52272 - protein, 14 aa, Homo sapiens
QPCQPPPQEPCIPK

SEQ ID NO: 52273 - protein, 8 aa, Homo sapiens
VPEPCHPK

SEQ ID NO: 52274 - protein, 17 aa, Homo sapiens
VPEPCPSTVTPAPAQQK

SEQ ID NO: 52275 - protein, 17 aa, Homo sapiens
LQEALGDEASECSELLR

SEQ ID NO: 52276 - protein, 15 aa, Homo sapiens
SHHLLGLEAVDRPLR

SEQ ID NO: 52277 - protein, 21 aa, Homo sapiens
TAQDANPLDSIDLSSAVFDCK

SEQ ID NO: 52278 - protein, 16 aa, Homo sapiens
VQHLHTPGCYQELLSR

SEQ ID NO: 52279 - protein, 21 aa, Homo sapiens
RDLAELKSSLVNESEGAAGGA

SEQ ID NO: 52280 - protein, 30 aa, Homo sapiens
KLPLSHSALPSQALGGIASGLGMQNLNSSR

SEQ ID NO: 52281 - protein, 36 aa, Homo sapiens
KNGSGWDADSNRSGSGWNDTTRSGNSGWGNSTNTKA

SEQ ID NO: 52282 - protein, 29 aa, Homo sapiens
RNNPVIQSSTTTNTTTTTTTTTSNTTHRV

SEQ ID NO: 52283 - protein, 36 aa, Homo sapiens
MRPRGQPADIRQQPGMMPHGQLTTINQSQLSAQLGL

SEQ ID NO: 52284 - protein, 19 aa, Homo sapiens
AGCECLNESDEHGFDNCLR

SEQ ID NO: 52285 - protein, 20 aa, Homo sapiens
AGCECLNESDEHGFDNCLRK

SEQ ID NO: 52286 - protein, 23 aa, Homo sapiens
SEPTQALELTEDDIKEDGIVPLR

SEQ ID NO: 52287 - protein, 22 aa, Homo sapiens
VGVKPVGSDPDFQPELSGAGSR

SEQ ID NO: 52288 - protein, 33 aa, Homo sapiens
YPQAVFLEVDVHQCQGTAATNNISATPTFLFFR

SEQ ID NO: 52289 - protein, 17 aa, Homo sapiens
DFENDPPLSSCGIFQSR

SEQ ID NO: 52290 - protein, 25 aa, Homo sapiens
LKSRSSPSLLEPLLAMGFPVHTALK

SEQ ID NO: 52291 - protein, 27 aa, Homo sapiens
IYHPNVDENGQICLPIISSENWKPCTK

SEQ ID NO: 52292 - protein, 16 aa, Homo sapiens
TCQVLEALNVLVNRPN

SEQ ID NO: 52293 - protein, 18 aa, Homo sapiens
TCQVLEALNVLVNRPNIR

SEQ ID NO: 52294 - protein, 33 aa, Homo sapiens
KKVDAQSSAGKEDMLLSKSPSSLSANISSSPKG

SEQ ID NO: 52295 - protein, 18 aa, Homo sapiens
DTFVEKLATQVIKNVQVK

SEQ ID NO: 52296 - protein, 13 aa, Homo sapiens
FNLDLYPDATEGD

SEQ ID NO: 52297 - protein, 19 aa, Homo sapiens
KEEDTILVFNVTQLGTEAT

SEQ ID NO: 52298 - protein, 10 aa, Homo sapiens
KMSSFNLSRI

SEQ ID NO: 52299 - protein, 18 aa, Homo sapiens
KPLHLISSSDKPGLDLLK

SEQ ID NO: 52300 - protein, 14 aa, Homo sapiens
LSLSLGSGGEESDK

SEQ ID NO: 52301 - protein, 29 aa, Homo sapiens
RQDNGTLLSLEDLNGGILVDVNTAEHSTV

SEQ ID NO: 52302 - protein, 20 aa, Homo sapiens
WNYIASSECLPFWPESLSGK

SEQ ID NO: 52303 - protein, 14 aa, Homo sapiens
AFLFDHLLTLKPVK

SEQ ID NO: 52304 - protein, 20 aa, Homo sapiens
ALKDPNAFLFDHLLTLKPVK

SEQ ID NO: 52305 - protein, 17 aa, Homo sapiens
DPNAFLFDHLLTLKPVK

SEQ ID NO: 52306 - protein, 27 aa, Homo sapiens
EISFDTMQQELQIGADDVEAFVIDAVR

SEQ ID NO: 52307 - protein, 18 aa, Homo sapiens
FLEGELIHDLLTIFVSAK

SEQ ID NO: 52308 - protein, 29 aa, Homo sapiens
GAEISEENSEGGLHVDLAQIIEACDVCLK

SEQ ID NO: 52309 - protein, 10 aa, Homo sapiens
LLYEALVDCK

SEQ ID NO: 52310 - protein, 19 aa, Homo sapiens
VAASCGAIQYIPTELDQVR

SEQ ID NO: 52311 - protein, 28 aa, Homo sapiens
MSGTLVMLLNDSADLRDLATSMDSIVKL

SEQ ID NO: 52312 - protein, 15 aa, Homo sapiens
RTNGDILVLYNLSKH

SEQ ID NO: 52313 - protein, 29 aa, Homo sapiens
RHSSTDSNKASSGDISPYDNNSPVLSERS

SEQ ID NO: 52314 - protein, 19 aa, Homo sapiens
FGFSLPYVQYFGGVSALSK

SEQ ID NO: 52315 - protein, 13 aa, Homo sapiens
GMSISRPNAVVGR

SEQ ID NO: 52316 - protein, 8 aa, Homo sapiens
HISVAMDK

SEQ ID NO: 52317 - protein, 11 aa, Homo sapiens
LLNVGFQEALK

SEQ ID NO: 52318 - protein, 8 aa, Homo sapiens
VAIIIPFR

SEQ ID NO: 52319 - protein, 12 aa, Homo sapiens
YWLYYLHPVLQR

SEQ ID NO: 52320 - protein, 19 aa, Homo sapiens
ASELEQEQEREGSSLDSPR

SEQ ID NO: 52321 - protein, 20 aa, Homo sapiens
ASELEQEQEREGSSLDSPRS

SEQ ID NO: 52322 - protein, 8 aa, Homo sapiens
DMSSDLER

SEQ ID NO: 52323 - protein, 21 aa, Homo sapiens
FRSALESSPADPATLSEDEAR

SEQ ID NO: 52324 - protein, 12 aa, Homo sapiens
ADLEEQLSDEEK

SEQ ID NO: 52325 - protein, 14 aa, Homo sapiens
ADLEEQLSDEEKVR

SEQ ID NO: 52326 - protein, 19 aa, Homo sapiens
EGAAHAFAQYNLDQFTPVK

SEQ ID NO: 52327 - protein, 13 aa, Homo sapiens
EHYPNGVCTVYGK

SEQ ID NO: 52328 - protein, 18 aa, Homo sapiens
FIIHAPPGEFNEVFNDVR

SEQ ID NO: 52329 - protein, 15 aa, Homo sapiens
FTITPSTTQVVGILK

SEQ ID NO: 52330 - protein, 19 aa, Homo sapiens
IDGQQTIIACIESHQFQAK

SEQ ID NO: 52331 - protein, 20 aa, Homo sapiens
IEGYEDQVLITEHGDLGNGK

SEQ ID NO: 52332 - protein, 26 aa, Homo sapiens
IVEAAENEYQTAISENYQTMSDTTFK

SEQ ID NO: 52333 - protein, 20 aa, Homo sapiens
KIDGQQTIIACIESHQFQAK

SEQ ID NO: 52334 - protein, 8 aa, Homo sapiens
TSVETALR

SEQ ID NO: 52335 - protein, 12 aa, Homo sapiens
AAECNIVVTQPR

SEQ ID NO: 52336 - protein, 12 aa, Homo sapiens
ETPFELIEALLK

SEQ ID NO: 52337 - protein, 18 aa, Homo sapiens
FSDHVALLSVFQAWDDAR

SEQ ID NO: 52338 - protein, 13 aa, Homo sapiens
GISHVIVDEIHER

SEQ ID NO: 52339 - protein, 31 aa, Homo sapiens
KEEQEVQATLESEEVDLNAGLHGNWTLENAK

SEQ ID NO: 52340 - protein, 12 aa, Homo sapiens
LAAQSCALSLVR

SEQ ID NO: 52341 - protein, 15 aa, Homo sapiens
LQISHEAAACITGLR

SEQ ID NO: 52342 - protein, 20 aa, Homo sapiens
NELMYQLEQDHDLQAILQER

SEQ ID NO: 52343 - protein, 9 aa, Homo sapiens
NFLYAWCGK

SEQ ID NO: 52344 - protein, 15 aa, Homo sapiens
QVPQFILDDFIQNDR

SEQ ID NO: 52345 - protein, 11 aa, Homo sapiens
TPLHEIALSIK

SEQ ID NO: 52346 - protein, 12 aa, Homo sapiens
YQILPLHSQIPR

SEQ ID NO: 52347 - protein, 10 aa, Homo sapiens
YTQVGPDHNR

SEQ ID NO: 52348 - protein, 17 aa, Homo sapiens
ADIEVACYGYEGIDAVK

SEQ ID NO: 52349 - protein, 19 aa, Homo sapiens
HAVSDPSILDSLDLNEDER

SEQ ID NO: 52350 - protein, 28 aa, Homo sapiens
HAVSDPSILDSLDLNEDEREVLINNINR

SEQ ID NO: 52351 - protein, 20 aa, Homo sapiens
HVAEVLEYTKDEQLESLFQR

SEQ ID NO: 52352 - protein, 19 aa, Homo sapiens
KEALRAGLNCSTENMPIKI

SEQ ID NO: 52353 - protein, 31 aa, Homo sapiens
LSELSRRRIRSINKLIRIGRNECVVVIRVDK

SEQ ID NO: 52354 - protein, 10 aa, Homo sapiens
YVMTTTTLER

SEQ ID NO: 52355 - protein, 27 aa, Homo sapiens
KQHLQINWTGLTNLLDAPGINDVSDSL

SEQ ID NO: 52356 - protein, 9 aa, Homo sapiens
KPPVAPKPK

SEQ ID NO: 52357 - protein, 25 aa, Homo sapiens
KYEGNQSNDYISPMCSCSSECIHKL

SEQ ID NO: 52358 - protein, 38 aa, Homo sapiens
VANNKPAPPPIAPKPDIVISSVPQSTKKMKPAIAPKPK

SEQ ID NO: 52359 - protein, 10 aa, Homo sapiens
SGSSSVAAMK

SEQ ID NO: 52360 - protein, 9 aa, Homo sapiens
VSQAAADLK

SEQ ID NO: 52361 - protein, 10 aa, Homo sapiens
DAGMQLQGYR

SEQ ID NO: 52362 - protein, 29 aa, Homo sapiens
EGSTHNWQHITDQIGMFCFTGLKPEQVER

SEQ ID NO: 52363 - protein, 13 aa, Homo sapiens
EYLPIGGLAEFCK

SEQ ID NO: 52364 - protein, 17 aa, Homo sapiens
HFIEQGINVCLCQSYAK

SEQ ID NO: 52365 - protein, 22 aa, Homo sapiens
IPEQSVLLLHACAHNPTGVDPR

SEQ ID NO: 52366 - protein, 27 aa, Homo sapiens
IPEQSVLLLHACAHNPTGVDPRPEQWK

SEQ ID NO: 52367 - protein, 23 aa, Homo sapiens
ISVAGVTSSNVGYLAHAIHQVTK

SEQ ID NO: 52368 - protein, 17 aa, Homo sapiens
NLDKEYLPIGGLAEFCK

SEQ ID NO: 52369 - protein, 26 aa, Homo sapiens
NLFAFFDMAYQGFASGDGDKDAWAVR

SEQ ID NO: 52370 - protein, 11 aa, Homo sapiens
PTWGNHTPIFR

SEQ ID NO: 52371 - protein, 23 aa, Homo sapiens
SSWWTHVEMGPPDPILGVTEAFK

SEQ ID NO: 52372 - protein, 15 aa, Homo sapiens
TCGFDFTGAVEDISK

SEQ ID NO: 52373 - protein, 23 aa, Homo sapiens
KVLGQSQEPNVNPASAGNQTQKT

SEQ ID NO: 52374 - protein, 25 aa, Homo sapiens
GHKQISSSSTGCLSSPNATVQSPKH

SEQ ID NO: 52375 - protein, 11 aa, Homo sapiens
HIPEINDSIRA

SEQ ID NO: 52376 - protein, 35 aa, Homo sapiens
KISVDVQRPTGSFSIDFLGGFTSYYDNITNVVVKL

SEQ ID NO: 52377 - protein, 11 aa, Homo sapiens
ACNCNPYGTMK

SEQ ID NO: 52378 - protein, 8 aa, Homo sapiens
AFDITYVR

SEQ ID NO: 52379 - protein, 8 aa, Homo sapiens
AHVENTER

SEQ ID NO: 52380 - protein, 8 aa, Homo sapiens
ALAEEAAK

SEQ ID NO: 52381 - protein, 9 aa, Homo sapiens
ALAEEAAKK

SEQ ID NO: 52382 - protein, 15 aa, Homo sapiens
CELCDDGYFGDPLGR

SEQ ID NO: 52383 - protein, 12 aa, Homo sapiens
CIYNTAGFYCDR

SEQ ID NO: 52384 - protein, 14 aa, Homo sapiens
CKPGFFNLESSNPR

SEQ ID NO: 52385 - protein, 15 aa, Homo sapiens
DGFFGNPLAPNPADK

SEQ ID NO: 52386 - protein, 13 aa, Homo sapiens
DGSEASLEWSSER

SEQ ID NO: 52387 - protein, 7 aa, Homo sapiens
DIEEIMK

SEQ ID NO: 52388 - protein, 7 aa, Homo sapiens
DKVADHR

SEQ ID NO: 52389 - protein, 10 aa, Homo sapiens
DNVEGFNCER

SEQ ID NO: 52390 - protein, 9 aa, Homo sapiens
DVDQNLMDR

SEQ ID NO: 52391 - protein, 15 aa, Homo sapiens
EAQDVKDVDQNLMDR

SEQ ID NO: 52392 - protein, 17 aa, Homo sapiens
EAQQALGSAAADATEAK

SEQ ID NO: 52393 - protein, 7 aa, Homo sapiens
EGFVGNR

SEQ ID NO: 52394 - protein, 7 aa, Homo sapiens
EVMDLLR

SEQ ID NO: 52395 - protein, 14 aa, Homo sapiens
EVVCTNCPTGTTGK

SEQ ID NO: 52396 - protein, 7 aa, Homo sapiens
GKELEVK

SEQ ID NO: 52397 - protein, 14 aa, Homo sapiens
GKTEQQTADQLLAR

SEQ ID NO: 52398 - protein, 10 aa, Homo sapiens
HKQEADDIVR

SEQ ID NO: 52399 - protein, 10 aa, Homo sapiens
HNTYGVDCEK

SEQ ID NO: 52400 - protein, 7 aa, Homo sapiens
IASAVQK

SEQ ID NO: 52401 - protein, 16 aa, Homo sapiens
KIPAINQTITEANEKT

SEQ ID NO: 52402 - protein, 11 aa, Homo sapiens
KLLNNLTSIKI

SEQ ID NO: 52403 - protein, 27 aa, Homo sapiens
KQDDADQDMMMAGMASQAAQEAEINAR

SEQ ID NO: 52404 - protein, 11 aa, Homo sapiens
KQEAAIMDYNR

SEQ ID NO: 52405 - protein, 16 aa, Homo sapiens
KQVLSYGQNLSFSFRV

SEQ ID NO: 52406 - protein, 17 aa, Homo sapiens
KTANDTSTEAYNLLLRT

SEQ ID NO: 52407 - protein, 30 aa, Homo sapiens
KVAAANVSVTQPESTGDPNNMTLLAEEARK

SEQ ID NO: 52408 - protein, 10 aa, Homo sapiens
KVSDLENEAK

SEQ ID NO: 52409 - protein, 18 aa, Homo sapiens
LCQCSDNIDPNAVGNCNR

SEQ ID NO: 52410 - protein, 7 aa, Homo sapiens
LIEIASR

SEQ ID NO: 52411 - protein, 8 aa, Homo sapiens
LKDYEDLR

SEQ ID NO: 52412 - protein, 10 aa, Homo sapiens
LNEIEGTLNK

SEQ ID NO: 52413 - protein, 13 aa, Homo sapiens
LNTFGDEVFNDPK

SEQ ID NO: 52414 - protein, 14 aa, Homo sapiens
LSAEDLVLEGAGLR

SEQ ID NO: 52415 - protein, 13 aa, Homo sapiens
MEAENLEQLIDQK

SEQ ID NO: 52416 - protein, 14 aa, Homo sapiens
NTIEETGNLAEQAR

SEQ ID NO: 52417 - protein, 13 aa, Homo sapiens
QDIAVISDSYFPR

SEQ ID NO: 52418 - protein, 7 aa, Homo sapiens
QLQEAEK

SEQ ID NO: 52419 - protein, 10 aa, Homo sapiens
QLQEAEKELK

SEQ ID NO: 52420 - protein, 14 aa, Homo sapiens
RCDQCEENYFYNRS

SEQ ID NO: 52421 - protein, 20 aa, Homo sapiens
RIASAVQKNATSTKAEAERT

SEQ ID NO: 52422 - protein, 17 aa, Homo sapiens
RKIPAINQTITEANEKT

SEQ ID NO: 52423 - protein, 19 aa, Homo sapiens
RTLAGENQTAFEIEELNRK

SEQ ID NO: 52424 - protein, 13 aa, Homo sapiens
RVNNTLSSQISRL

SEQ ID NO: 52425 - protein, 12 aa, Homo sapiens
SQECYFDPELYR

SEQ ID NO: 52426 - protein, 22 aa, Homo sapiens
STGHGGHCTNCQDNTDGAHCER

SEQ ID NO: 52427 - protein, 14 aa, Homo sapiens
SYYYAISDFAVGGR

SEQ ID NO: 52428 - protein, 8 aa, Homo sapiens
TAAEEALR

SEQ ID NO: 52429 - protein, 12 aa, Homo sapiens
TEQQTADQLLAR

SEQ ID NO: 52430 - protein, 17 aa, Homo sapiens
TFAEVTDLDNEVNNMLK

SEQ ID NO: 52431 - protein, 17 aa, Homo sapiens
TGQCECQPGITGQHCER

SEQ ID NO: 52432 - protein, 16 aa, Homo sapiens
TKEVVCTNCPTGTTGK

SEQ ID NO: 52433 - protein, 15 aa, Homo sapiens
TLPSGCFNTPSIEKP

SEQ ID NO: 52434 - protein, 7 aa, Homo sapiens
VHEEAKR

SEQ ID NO: 52435 - protein, 7 aa, Homo sapiens
VSDLDRK

SEQ ID NO: 52436 - protein, 9 aa, Homo sapiens
VSDLENEAK

SEQ ID NO: 52437 - protein, 19 aa, Homo sapiens
VSVPLIAQGNSYPSETTVK

SEQ ID NO: 52438 - protein, 7 aa, Homo sapiens
YFIAPAK

SEQ ID NO: 52439 - protein, 15 aa, Homo sapiens
CDLCQEVLADIGFVK

SEQ ID NO: 52440 - protein, 22 aa, Homo sapiens
GLAYCETHYNQLFGDVCFHCNR

SEQ ID NO: 52441 - protein, 11 aa, Homo sapiens
KCYEKFPLELK

SEQ ID NO: 52442 - protein, 16 aa, Homo sapiens
NDPYHPDHFNCANCGK

SEQ ID NO: 52443 - protein, 24 aa, Homo sapiens
YCEHDFQMLFAPCCHQCGEFIIGR

SEQ ID NO: 52444 - protein, 10 aa, Homo sapiens
SIFSGIQFIK

SEQ ID NO: 52445 - protein, 17 aa, Homo sapiens
KWRLSNNSVVEIASLRF

SEQ ID NO: 52446 - protein, 8 aa, Homo sapiens
AEEQLLSK

SEQ ID NO: 52447 - protein, 20 aa, Homo sapiens
GDQVLNFSDAEDLIDDSKLK

SEQ ID NO: 52448 - protein, 10 aa, Homo sapiens
KSKQPLQVTK

SEQ ID NO: 52449 - protein, 21 aa, Homo sapiens
MDKDSQGLLDSSLMASGTASR

SEQ ID NO: 52450 - protein, 9 aa, Homo sapiens
RPAEIYHCR

SEQ ID NO: 52451 - protein, 8 aa, Homo sapiens
VYCHYFVK

SEQ ID NO: 52452 - protein, 24 aa, Homo sapiens
ALCLLLGPDFFTDVITIETADHAR

SEQ ID NO: 52453 - protein, 17 aa, Homo sapiens
DITPLQVVLPNTALHLK

SEQ ID NO: 52454 - protein, 13 aa, Homo sapiens
GAVASVTFDDFHK

SEQ ID NO: 52455 - protein, 18 aa, Homo sapiens
GPDFFTDVITIETADHAR

SEQ ID NO: 52456 - protein, 11 aa, Homo sapiens
HYCTVANPVSR

SEQ ID NO: 52457 - protein, 18 aa, Homo sapiens
IPPYHYIHVLDQNSNVSR

SEQ ID NO: 52458 - protein, 13 aa, Homo sapiens
LFSVPDFVGDACK

SEQ ID NO: 52459 - protein, 29 aa, Homo sapiens
SFFLQPGEQLEQGIQDVYVLSEQQGLLLR

SEQ ID NO: 52460 - protein, 32 aa, Homo sapiens
STLITDGSTPINLFNTAFGLLGMGPEGQPLGR

SEQ ID NO: 52461 - protein, 13 aa, Homo sapiens
VPHNAAVQVYDYR

SEQ ID NO: 52462 - protein, 12 aa, Homo sapiens
VSHQAGDHWLIR

SEQ ID NO: 52463 - protein, 25 aa, Homo sapiens
VVFGPELVSLGPEEQFTVLSLSAGR

SEQ ID NO: 52464 - protein, 27 aa, Homo sapiens
VVFGPELVSLGPEEQFTVLSLSAGRPK

SEQ ID NO: 52465 - protein, 17 aa, Homo sapiens
DLEEATLQHEATAATLR

SEQ ID NO: 52466 - protein, 12 aa, Homo sapiens
GSSFQTVSALFR

SEQ ID NO: 52467 - protein, 12 aa, Homo sapiens
IEELEEEIEAER

SEQ ID NO: 52468 - protein, 19 aa, Homo sapiens
KKHADSVAELGEQIDNLQR

SEQ ID NO: 52469 - protein, 22 aa, Homo sapiens
KKLETDISQIQGEMEDIIQEAR

SEQ ID NO: 52470 - protein, 22 aa, Homo sapiens
KVKNLTEEMAGLDETIAKLTKE

SEQ ID NO: 52471 - protein, 10 aa, Homo sapiens
LDEAEQLALK

SEQ ID NO: 52472 - protein, 9 aa, Homo sapiens
LINDLTAQR

SEQ ID NO: 52473 - protein, 14 aa, Homo sapiens
LQDAEEHVEAVNAK

SEQ ID NO: 52474 - protein, 15 aa, Homo sapiens
NLTEEMAGLDETIAK

SEQ ID NO: 52475 - protein, 15 aa, Homo sapiens
QAEEAEEQSNVNLSK

SEQ ID NO: 52476 - protein, 14 aa, Homo sapiens
QLDEKDTLVSQLSR

SEQ ID NO: 52477 - protein, 17 aa, Homo sapiens
RENQSILITGESGAGKT

SEQ ID NO: 52478 - protein, 17 aa, Homo sapiens
RQAEEAEEQSNVNLSKF

SEQ ID NO: 52479 - protein, 13 aa, Homo sapiens
VKELTYQTEEDRK

SEQ ID NO: 52480 - protein, 16 aa, Homo sapiens
VLNASAIPEGQFIDSK

SEQ ID NO: 52481 - protein, 14 aa, Homo sapiens
VQAEADSLADAEER

SEQ ID NO: 52482 - protein, 15 aa, Homo sapiens
VQLLHTQNTSLINTK

SEQ ID NO: 52483 - protein, 14 aa, Homo sapiens
VRELEGEVESEQKR

SEQ ID NO: 52484 - protein, 9 aa, Homo sapiens
TSVFVAEPK

SEQ ID NO: 52485 - protein, 28 aa, Homo sapiens
EKSELKMEINDLASNMETVSKAKANFEK

SEQ ID NO: 52486 - protein, 19 aa, Homo sapiens
TKLEQQVDDLEGSLEQEKK

SEQ ID NO: 52487 - protein, 20 aa, Homo sapiens
KNLTEEMAGLDETIAKLSKE

SEQ ID NO: 52488 - protein, 20 aa, Homo sapiens
KRQAEEAEEQSNANLSKFRK

SEQ ID NO: 52489 - protein, 22 aa, Homo sapiens
RLLAEGVCDNDTVPSVSSINRI

SEQ ID NO: 52490 - protein, 17 aa, Homo sapiens
MDQMAVLLVSNINESKG

SEQ ID NO: 52491 - protein, 24 aa, Homo sapiens
DQFPEVYVPTVFENYVADIEVDGK

SEQ ID NO: 52492 - protein, 12 aa, Homo sapiens
MKQEPVKPEEGR

SEQ ID NO: 52493 - protein, 17 aa, Homo sapiens
QVELALWDTAGQEDYDR

SEQ ID NO: 52494 - protein, 31 aa, Homo sapiens
EKSNETNGYLDSAQAGPAAGPGAPGTAAGRA

SEQ ID NO: 52495 - protein, 17 aa, Homo sapiens
KVVTQNSSSGNVTHEKI

SEQ ID NO: 52496 - protein, 17 aa, Homo sapiens
DHPALNYNIVSGPPSHK

SEQ ID NO: 52497 - protein, 18 aa, Homo sapiens
ECINFASFNFLGLLDNPR

SEQ ID NO: 52498 - protein, 34 aa, Homo sapiens
GVTEHYGINIDDIDLISANMENALASIGGFCCGR

SEQ ID NO: 52499 - protein, 21 aa, Homo sapiens
VVGESLSPAFHLQLEESTGSR

SEQ ID NO: 52500 - protein, 34 aa, Homo sapiens
DFAKALETNTHVKCFSLAATRSNDPVATAFAEML

SEQ ID NO: 52501 - protein, 17 aa, Homo sapiens
DLDEDELLGNLSETELK

SEQ ID NO: 52502 - protein, 15 aa, Homo sapiens
ENDAHLVEVNLNNIK

SEQ ID NO: 52503 - protein, 10 aa, Homo sapiens
MLEENTNILK

SEQ ID NO: 52504 - protein, 21 aa, Homo sapiens
QLETVLDDLDPENALLPAGFR

SEQ ID NO: 52505 - protein, 22 aa, Homo sapiens
SLNVESNFITGVGILALIDALR

SEQ ID NO: 52506 - protein, 36 aa, Homo sapiens
VSLDPELEEALTSASDTELCDLAAILGMHNLITNTK

SEQ ID NO: 52507 - protein, 19 aa, Homo sapiens
ILESLMCNESSMQSLRQRK

SEQ ID NO: 52508 - protein, 20 aa, Homo sapiens
KLYNNGFTSVQGYAFNGTKL

SEQ ID NO: 52509 - protein, 18 aa, Homo sapiens
AHDQKVEGCFNQLLYDIR

SEQ ID NO: 52510 - protein, 19 aa, Homo sapiens
KCCGFTNYTDFEDSPYFKE

SEQ ID NO: 52511 - protein, 19 aa, Homo sapiens
KDYGSQEDFTQVWNTTMKG

SEQ ID NO: 52512 - protein, 13 aa, Homo sapiens
VEGCFNQLLYDIR

SEQ ID NO: 52513 - protein, 24 aa, Homo sapiens
KPFPINHGETSDETLLEDAIEVCK

SEQ ID NO: 52514 - protein, 20 aa, Homo sapiens
QTISNACGTIGLIHAIANNK

SEQ ID NO: 52515 - protein, 16 aa, Homo sapiens
WLPLEANPEVTNQFLK

SEQ ID NO: 52516 - protein, 24 aa, Homo sapiens
KEIQDKHLTQTVFFSNKTLITERE

SEQ ID NO: 52517 - protein, 31 aa, Homo sapiens
LYLTNHQRIHTGERPYKCNACGKVFNQNPHL

SEQ ID NO: 52518 - protein, 11 aa, Homo sapiens
MLCDEEAQKRK

SEQ ID NO: 52519 - protein, 11 aa, Homo sapiens
IMFVDPSLTVR

SEQ ID NO: 52520 - protein, 17 aa, Homo sapiens
LYAYEPADTALLLDNMK

SEQ ID NO: 52521 - protein, 18 aa, Homo sapiens
LYAYEPADTALLLDNMKK

SEQ ID NO: 52522 - protein, 26 aa, Homo sapiens
AAVAAVLSPEEFMVLLDSVLPESAHR

SEQ ID NO: 52523 - protein, 15 aa, Homo sapiens
IPLDMVAGFNTPLVK

SEQ ID NO: 52524 - protein, 28 aa, Homo sapiens
KWFNNSAASLTMPTLDNIPFSLIVSQDV

SEQ ID NO: 52525 - protein, 10 aa, Homo sapiens
ELSSFSFSMK

SEQ ID NO: 52526 - protein, 21 aa, Homo sapiens
KALTNGSFSPSGNNGSVNWRT

SEQ ID NO: 52527 - protein, 14 aa, Homo sapiens
SVIEVPAVPEEILK

SEQ ID NO: 52528 - protein, 17 aa, Homo sapiens
FLPPDAFIHVDDFQSPK

SEQ ID NO: 52529 - protein, 17 aa, Homo sapiens
FYLAFENSLHPDYITEK

SEQ ID NO: 52530 - protein, 16 aa, Homo sapiens
NALEAWAVPVVLGPSR

SEQ ID NO: 52531 - protein, 10 aa, Homo sapiens
YYQSLQAHLK

SEQ ID NO: 52532 - protein, 28 aa, Homo sapiens
ATSAMGTISIMGDTSVSTLTPALSNTRK

SEQ ID NO: 52533 - protein, 14 aa, Homo sapiens
DGAATGVDAICTHR

SEQ ID NO: 52534 - protein, 15 aa, Homo sapiens
DPEILSWTIPPSIEK

SEQ ID NO: 52535 - protein, 31 aa, Homo sapiens
EDSTALVMNSTTESNTVFSSVSLDAATEVSR

SEQ ID NO: 52536 - protein, 14 aa, Homo sapiens
EIFPSINTEETNVK

SEQ ID NO: 52537 - protein, 31 aa, Homo sapiens
ENSTLQEMNSTTESNIILSNVSVGAITEATK

SEQ ID NO: 52538 - protein, 15 aa, Homo sapiens
EQLYWELSQLTHGIK

SEQ ID NO: 52539 - protein, 11 aa, Homo sapiens
ESTYSLTPGLR

SEQ ID NO: 52540 - protein, 13 aa, Homo sapiens
ETSFLSPTASTSR

SEQ ID NO: 52541 - protein, 13 aa, Homo sapiens
FCLVTNLTMDSVL

SEQ ID NO: 52542 - protein, 17 aa, Homo sapiens
FCLVTNLTMDSVLVTVK

SEQ ID NO: 52543 - protein, 36 aa, Homo sapiens
FCLVTNLTMDSVLVTVKALFSSNLDPSLVEQVFLDK

SEQ ID NO: 52544 - protein, 27 aa, Homo sapiens
FKTGLPSATTTVSTSATSLSATVMVSK

SEQ ID NO: 52545 - protein, 17 aa, Homo sapiens
FNATERELQGLLKPLFR

SEQ ID NO: 52546 - protein, 15 aa, Homo sapiens
FTSPATSSMEATSIR

SEQ ID NO: 52547 - protein, 24 aa, Homo sapiens
GEPETTPSMATSHGAEASSTVPTV

SEQ ID NO: 52548 - protein, 14 aa, Homo sapiens
IQKESISSLSPKLR

SEQ ID NO: 52549 - protein, 14 aa, Homo sapiens
IQTELASSLTPGLR

SEQ ID NO: 52550 - protein, 15 aa, Homo sapiens
IQTEPTSSLTLGLRK

SEQ ID NO: 52551 - protein, 31 aa, Homo sapiens
ISSSPNLTSPATKAWTITDTTEHSTQLHYTK

SEQ ID NO: 52552 - protein, 35 aa, Homo sapiens
KILATSKDSKDTKEIFPSINTEETNVKANNSGHES

SEQ ID NO: 52553 - protein, 22 aa, Homo sapiens
KTNELPSDSSSSSDLINTSIAS

SEQ ID NO: 52554 - protein, 21 aa, Homo sapiens
KVPTGTITEVSSTGVNSSSKI

SEQ ID NO: 52555 - protein, 22 aa, Homo sapiens
LRETSTSEETSLATEANTVLSK

SEQ ID NO: 52556 - protein, 33 aa, Homo sapiens
MAAGPLLVPFTLNFTITNLQYGEDMGHPGSRKF

SEQ ID NO: 52557 - protein, 22 aa, Homo sapiens
MLKPSGLPGSSSPTRSLMTGSR

SEQ ID NO: 52558 - protein, 44 aa, Homo sapiens
NSPPSSLVSSSSVTSPSPLYSTPSGSSHSSPVPVTSLFTSIMMK

SEQ ID NO: 52559 - protein, 21 aa, Homo sapiens
NTSVGPLYSGCRLTLLRPEKD

SEQ ID NO: 52560 - protein, 19 aa, Homo sapiens
REPGTSSTSNLSSTSHERL

SEQ ID NO: 52561 - protein, 24 aa, Homo sapiens
RKTNELPSDSSSSSDLINTSIASS

SEQ ID NO: 52562 - protein, 13 aa, Homo sapiens
SQSSVLADSETSK

SEQ ID NO: 52563 - protein, 10 aa, Homo sapiens
SSSASVLDNK

SEQ ID NO: 52564 - protein, 31 aa, Homo sapiens
TFADSTASKENAPVSMTPAETTVTDSHTPGR

SEQ ID NO: 52565 - protein, 22 aa, Homo sapiens
TKATAPMDTTSTMGHTTVSTSM

SEQ ID NO: 52566 - protein, 13 aa, Homo sapiens
TNLTMDSVLVTVK

SEQ ID NO: 52567 - protein, 33 aa, Homo sapiens
TQHFYLNFTITNLPYSQDKAQPGTTNYQRNKRN

SEQ ID NO: 52568 - protein, 26 aa, Homo sapiens
TSSSPNLSSTSVEIPATSEIMTDTEK

SEQ ID NO: 52569 - protein, 24 aa, Homo sapiens
TSSTTETNTAFSYVPTGAITQASR

SEQ ID NO: 52570 - protein, 34 aa, Homo sapiens
TTDMLRTSSEPETSSPPNLSSTSAEILATSEVTK

SEQ ID NO: 52571 - protein, 12 aa, Homo sapiens
VAIYEEFLRMTR

SEQ ID NO: 52572 - protein, 14 aa, Homo sapiens
VIALRSVKNGAETR

SEQ ID NO: 52573 - protein, 19 aa, Homo sapiens
VPTGTITEVSSTGVNSSSK

SEQ ID NO: 52574 - protein, 27 aa, Homo sapiens
VPTGTITEVSSTGVNSSSKISTPDHDK

SEQ ID NO: 52575 - protein, 20 aa, Homo sapiens
VPTVLPEVPGMVTSLVASSR

SEQ ID NO: 52576 - protein, 28 aa, Homo sapiens
KIYYWEADSQNETEKMKVLFLPEPVVRL

SEQ ID NO: 52577 - protein, 19 aa, Homo sapiens
FYQTSVESVDFANAPEESR

SEQ ID NO: 52578 - protein, 10 aa, Homo sapiens
GLVLSGVLHK

SEQ ID NO: 52579 - protein, 10 aa, Homo sapiens
MNSLSEANTK

SEQ ID NO: 52580 - protein, 10 aa, Homo sapiens
SGNVHHQFQK

SEQ ID NO: 52581 - protein, 9 aa, Homo sapiens
TNSILFYGR

SEQ ID NO: 52582 - protein, 13 aa, Homo sapiens
TYLFLQEYLDAIK

SEQ ID NO: 52583 - protein, 27 aa, Homo sapiens
RERSGSMDNTSARGGLLEGMRQADIRY

SEQ ID NO: 52584 - protein, 25 aa, Homo sapiens
RDATGNVNDTIVTELTNCTSAACKL

SEQ ID NO: 52585 - protein, 24 aa, Homo sapiens
KTTVSCTKIMSKNISIVDNEKCKY

SEQ ID NO: 52586 - protein, 30 aa, Homo sapiens
LFNGSLLLQNVSLENEGTYVCIATNALGKA

SEQ ID NO: 52587 - protein, 18 aa, Homo sapiens
RHTACQHNSSDSNCDDRK

SEQ ID NO: 52588 - protein, 31 aa, Homo sapiens
RNMSQLMETGEVSDDLASQLIYQLVAELAKA

SEQ ID NO: 52589 - protein, 15 aa, Homo sapiens
FFQPTEMAAQDFFQR

SEQ ID NO: 52590 - protein, 17 aa, Homo sapiens
FFQPTEMAAQDFFQRWK

SEQ ID NO: 52591 - protein, 14 aa, Homo sapiens
LLQCYPPPEDAAVK

SEQ ID NO: 52592 - protein, 11 aa, Homo sapiens
LVECLETVLNK

SEQ ID NO: 52593 - protein, 16 aa, Homo sapiens
NNGVLFENQLLQIGVK

SEQ ID NO: 52594 - protein, 18 aa, Homo sapiens
NPTFMCLALHCIANVGSR

SEQ ID NO: 52595 - protein, 19 aa, Homo sapiens
PGPEDIGPPIPEADELLNK

SEQ ID NO: 52596 - protein, 18 aa, Homo sapiens
RDENSSRSFRITILPQKL

SEQ ID NO: 52597 - protein, 8 aa, Homo sapiens
AIDGINQR

SEQ ID NO: 52598 - protein, 11 aa, Homo sapiens
CMGTVTLNQAR

SEQ ID NO: 52599 - protein, 9 aa, Homo sapiens
FALLGDFFR

SEQ ID NO: 52600 - protein, 10 aa, Homo sapiens
FALLGDFFRK

SEQ ID NO: 52601 - protein, 9 aa, Homo sapiens
GSFDISCDK

SEQ ID NO: 52602 - protein, 12 aa, Homo sapiens
GSFDISCDKDNK

SEQ ID NO: 52603 - protein, 13 aa, Homo sapiens
GSFDISCDKDNKR

SEQ ID NO: 52604 - protein, 7 aa, Homo sapiens
IGKEFKR

SEQ ID NO: 52605 - protein, 25 aa, Homo sapiens
LLDLDPRPTMDGDPDTPKPVSFTVK

SEQ ID NO: 52606 - protein, 12 aa, Homo sapiens
RCMGTVTLNQAR

SEQ ID NO: 52607 - protein, 8 aa, Homo sapiens
SSDANLYR

SEQ ID NO: 52608 - protein, 12 aa, Homo sapiens
TTQQSPEDCDFK

SEQ ID NO: 52609 - protein, 13 aa, Homo sapiens
TTQQSPEDCDFKK

SEQ ID NO: 52610 - protein, 25 aa, Homo sapiens
AHITLGCAADVEAVQTGLDLLEILR

SEQ ID NO: 52611 - protein, 14 aa, Homo sapiens
APGAEEYAQQDVLK

SEQ ID NO: 52612 - protein, 23 aa, Homo sapiens
DKPELQFPFLQDEDTVATLLECK

SEQ ID NO: 52613 - protein, 10 aa, Homo sapiens
GKPVPTQGSR

SEQ ID NO: 52614 - protein, 11 aa, Homo sapiens
ILVLDDTNHER

SEQ ID NO: 52615 - protein, 9 aa, Homo sapiens
LSPTDNLPR

SEQ ID NO: 52616 - protein, 11 aa, Homo sapiens
RLDEDLAAYCR

SEQ ID NO: 52617 - protein, 11 aa, Homo sapiens
RPPGVLHCTTK

SEQ ID NO: 52618 - protein, 17 aa, Homo sapiens
VELSEQQLQLWPSDVDK

SEQ ID NO: 52619 - protein, 8 aa, Homo sapiens
DRNRDRDR

SEQ ID NO: 52620 - protein, 26 aa, Homo sapiens
VCTELDNHLGINDKDLAEFVISLAEK

SEQ ID NO: 52621 - protein, 15 aa, Homo sapiens
KHMPPPNMTTNERRV

SEQ ID NO: 52622 - protein, 14 aa, Homo sapiens
AQVARPGGDTIFGK

SEQ ID NO: 52623 - protein, 9 aa, Homo sapiens
CAADLGLNK

SEQ ID NO: 52624 - protein, 20 aa, Homo sapiens
CLAFHDISPQAPTHFLVIPK

SEQ ID NO: 52625 - protein, 24 aa, Homo sapiens
HISQISVAEDDDESLLGHLMIVGK

SEQ ID NO: 52626 - protein, 24 aa, Homo sapiens
MVVNEGSDGGQSVYHVHLHVLGGR

SEQ ID NO: 52627 - protein, 18 aa, Homo sapiens
LFTMHNNRSLTIHQAMRG

SEQ ID NO: 52628 - protein, 27 aa, Homo sapiens
RGENAYSTVLNISQSANLQFASLIQKE

SEQ ID NO: 52629 - protein, 21 aa, Homo sapiens
EVSQVDTICECLLEHEEQVLR

SEQ ID NO: 52630 - protein, 18 aa, Homo sapiens
IHQHILPQGQGMLSGIGR

SEQ ID NO: 52631 - protein, 18 aa, Homo sapiens
MIFETTTKNETIAQEDKI

SEQ ID NO: 52632 - protein, 23 aa, Homo sapiens
NIVTEQLVALIDCFLDGYVSQLK

SEQ ID NO: 52633 - protein, 22 aa, Homo sapiens
SDLLSPLLSLGQYLWAASLAEK

SEQ ID NO: 52634 - protein, 10 aa, Homo sapiens
TTVYVVEDQR

SEQ ID NO: 52635 - protein, 21 aa, Homo sapiens
LSNLPTVDPIAVCHELYNTIR

SEQ ID NO: 52636 - protein, 11 aa, Homo sapiens
NLETAKKAEYE

SEQ ID NO: 52637 - protein, 22 aa, Homo sapiens
RRRKNMSEFLGEASIPGQEPPT

SEQ ID NO: 52638 - protein, 33 aa, Homo sapiens
NLFQQQAAAAANNTASQQAASQAQPGQQQVLRA

SEQ ID NO: 52639 - protein, 17 aa, Homo sapiens
KSNQSYPTPVTVEKDRI

SEQ ID NO: 52640 - protein, 16 aa, Homo sapiens
GDQLSNLSNLLQQYKT

SEQ ID NO: 52641 - protein, 24 aa, Homo sapiens
KELVNAGCNLSTLNITLLSWSKKR

SEQ ID NO: 52642 - protein, 7 aa, Homo sapiens
AAVPSIK

SEQ ID NO: 52643 - protein, 17 aa, Homo sapiens
ACANPAAGSVILLENLR

SEQ ID NO: 52644 - protein, 10 aa, Homo sapiens
AEPAKIEAFR

SEQ ID NO: 52645 - protein, 13 aa, Homo sapiens
AHSSMVGVNLPQK

SEQ ID NO: 52646 - protein, 17 aa, Homo sapiens
ALESPERPFLAILGGAK

SEQ ID NO: 52647 - protein, 8 aa, Homo sapiens
ALMDEVVK

SEQ ID NO: 52648 - protein, 12 aa, Homo sapiens
ALMDEVVKATSR

SEQ ID NO: 52649 - protein, 7 aa, Homo sapiens
ELNYFAK

SEQ ID NO: 52650 - protein, 8 aa, Homo sapiens
FCLDNGAK

SEQ ID NO: 52651 - protein, 10 aa, Homo sapiens
FHVEEEGKGK

SEQ ID NO: 52652 - protein, 28 aa, Homo sapiens
FHVEEEGKGKDASGNKVKAEPAKIEAFR

SEQ ID NO: 52653 - protein, 17 aa, Homo sapiens
GCITIIGGGDTATCCAK

SEQ ID NO: 52654 - protein, 10 aa, Homo sapiens
IQLINNMLDK

SEQ ID NO: 52655 - protein, 12 aa, Homo sapiens
ITLPVDFVTADK

SEQ ID NO: 52656 - protein, 18 aa, Homo sapiens
ITLPVDFVTADKFDENAK

SEQ ID NO: 52657 - protein, 9 aa, Homo sapiens
LTLDKLDVK

SEQ ID NO: 52658 - protein, 9 aa, Homo sapiens
NNQITNNQR

SEQ ID NO: 52659 - protein, 13 aa, Homo sapiens
PAAGSVILLENLR

SEQ ID NO: 52660 - protein, 15 aa, Homo sapiens
PVDFVTADKFDENAK

SEQ ID NO: 52661 - protein, 18 aa, Homo sapiens
QIVWNGPVGVFEWEAFAR

SEQ ID NO: 52662 - protein, 19 aa, Homo sapiens
SVVLMSHLGRPDGVPMPDK

SEQ ID NO: 52663 - protein, 20 aa, Homo sapiens
SVVLMSHLGRPDGVPMPDKY

SEQ ID NO: 52664 - protein, 30 aa, Homo sapiens
SVVLMSHLGRPDGVPMPDKYSLEPVAVELK

SEQ ID NO: 52665 - protein, 25 aa, Homo sapiens
TGQATVASGIPAGWMGLDCGPESSK

SEQ ID NO: 52666 - protein, 26 aa, Homo sapiens
TGQATVASGIPAGWMGLDCGPESSKK

SEQ ID NO: 52667 - protein, 18 aa, Homo sapiens
VLNNMEIGTSLFDEEGAK

SEQ ID NO: 52668 - protein, 11 aa, Homo sapiens
VLPGVDALSNI

SEQ ID NO: 52669 - protein, 7 aa, Homo sapiens
YAEAVTR

SEQ ID NO: 52670 - protein, 11 aa, Homo sapiens
YSLEPVAVELK

SEQ ID NO: 52671 - protein, 11 aa, Homo sapiens
AVYLVCNYAPK

SEQ ID NO: 52672 - protein, 9 aa, Homo sapiens
FLGQNLSVR

SEQ ID NO: 52673 - protein, 21 aa, Homo sapiens
GKVFPPAANMEYMVWDENLAK

SEQ ID NO: 52674 - protein, 19 aa, Homo sapiens
IGCAIHTCQNMNVWGSVWR

SEQ ID NO: 52675 - protein, 20 aa, Homo sapiens
SAEAWAATCIWDHGPSYLLR

SEQ ID NO: 52676 - protein, 14 aa, Homo sapiens
SILQLVKPWYDEVK

SEQ ID NO: 52677 - protein, 19 aa, Homo sapiens
VFPPAANMEYMVWDENLAK

SEQ ID NO: 52678 - protein, 18 aa, Homo sapiens
YISQNDMIAILDYHNQVR

SEQ ID NO: 52679 - protein, 26 aa, Homo sapiens
KCPYSQEAMQRALIGRCQNVSALPKG

SEQ ID NO: 52680 - protein, 8 aa, Homo sapiens
ALDYCHSK

SEQ ID NO: 52681 - protein, 14 aa, Homo sapiens
DVKPHNVMIDHQQK

SEQ ID NO: 52682 - protein, 20 aa, Homo sapiens
EQSQPCADNAVLSSGLTAAR

SEQ ID NO: 52683 - protein, 19 aa, Homo sapiens
RGKYSEVFEAINITNNERV

SEQ ID NO: 52684 - protein, 18 aa, Homo sapiens
YHIDLDPHFNDILGQHSR

SEQ ID NO: 52685 - protein, 20 aa, Homo sapiens
AVAAGTPNTSGSIHENPPKA

SEQ ID NO: 52686 - protein, 25 aa, Homo sapiens
KYKDQWGQQGLYHCPNFSDVMGNKT

SEQ ID NO: 52687 - protein, 19 aa, Homo sapiens
KGTENHLLAIVNGTKGSRW

SEQ ID NO: 52688 - protein, 19 aa, Homo sapiens
KGQTEIQVNCPPAVTENKT

SEQ ID NO: 52689 - protein, 11 aa, Homo sapiens
TVTATFGYPFR

SEQ ID NO: 52690 - protein, 17 aa, Homo sapiens
GPHHLDNSSPGPGSEAR

SEQ ID NO: 52691 - protein, 18 aa, Homo sapiens
KGPPQSPVFEGVYNNSRM

SEQ ID NO: 52692 - protein, 31 aa, Homo sapiens
RGPHHLDNSSPGPGSEARGINGGPSRMSPKA

SEQ ID NO: 52693 - protein, 23 aa, Homo sapiens
TLSSPSNRPSGETSVPPPPAVGR

SEQ ID NO: 52694 - protein, 19 aa, Homo sapiens
AVLALHQDLFSLAQQCIDK

SEQ ID NO: 52695 - protein, 24 aa, Homo sapiens
ELLEPMLAVGLSPALTAVLYDLSR

SEQ ID NO: 52696 - protein, 21 aa, Homo sapiens
FYDQLNHHIFELVSSSDANER

SEQ ID NO: 52697 - protein, 32 aa, Homo sapiens
LKDPDPDPNPGVINNVLATIGELAQVSGLEMR

SEQ ID NO: 52698 - protein, 30 aa, Homo sapiens
SIELALTSQDIAEVTQTLLNLAEFMEHSDK

SEQ ID NO: 52699 - protein, 29 aa, Homo sapiens
SRNEETRAKAAKELQHYVTMELREMSQEE

SEQ ID NO: 52700 - protein, 8 aa, Homo sapiens
FYNIGDQR

SEQ ID NO: 52701 - protein, 30 aa, Homo sapiens
KSIQMTNQTFSTVENLKPNTSYEFQVKPKN

SEQ ID NO: 52702 - protein, 13 aa, Homo sapiens
TGQQLTSDQLPIK

SEQ ID NO: 52703 - protein, 19 aa, Homo sapiens
RTVYLYPNQTGLPDPLSRH

SEQ ID NO: 52704 - protein, 17 aa, Homo sapiens
FSPLTTNLINLLAENGR

SEQ ID NO: 52705 - protein, 22 aa, Homo sapiens
GEVPCTVTSASPLEEATLSELK

SEQ ID NO: 52706 - protein, 14 aa, Homo sapiens
LVRPPVQVYGIEGR

SEQ ID NO: 52707 - protein, 11 aa, Homo sapiens
YATALYSAASK

SEQ ID NO: 52708 - protein, 23 aa, Homo sapiens
AEVTVPDVEVSLPSVEVDVQAPR

SEQ ID NO: 52709 - protein, 20 aa, Homo sapiens
DVDPSLSSATAGGSFQDTEK

SEQ ID NO: 52710 - protein, 15 aa, Homo sapiens
EVQCPEANIDTALCK

SEQ ID NO: 52711 - protein, 23 aa, Homo sapiens
LDLTGPHFESSILSPCEDVTLTK

SEQ ID NO: 52712 - protein, 19 aa, Homo sapiens
LEVAQTQAPAATGGEAAAK

SEQ ID NO: 52713 - protein, 18 aa, Homo sapiens
SAPIQTQPEARPEAELPK

SEQ ID NO: 52714 - protein, 25 aa, Homo sapiens
TDVTAPDVEVSQPGMEVDVEAPGAK

SEQ ID NO: 52715 - protein, 36 aa, Homo sapiens
TTHLSIQPPSADLEVQAGQEDVKLPEGPVHEGAGLK

SEQ ID NO: 52716 - protein, 9 aa, Homo sapiens
EIHQDWANR

SEQ ID NO: 52717 - protein, 8 aa, Homo sapiens
RIEYIEAR

SEQ ID NO: 52718 - protein, 28 aa, Homo sapiens
LMQNQSSTNHPGASIALSRPSLNKDFRD

SEQ ID NO: 52719 - protein, 12 aa, Homo sapiens
LPVDLAEELGHR

SEQ ID NO: 52720 - protein, 22 aa, Homo sapiens
VAELLLLHGAEPNCADPATLTR

SEQ ID NO: 52721 - protein, 22 aa, Homo sapiens
DEFTNTCPSDKEVEIAYSDVAK

SEQ ID NO: 52722 - protein, 14 aa, Homo sapiens
HPESNTAGMDIFAK

SEQ ID NO: 52723 - protein, 13 aa, Homo sapiens
IEEFLEEVLCPPK

SEQ ID NO: 52724 - protein, 9 aa, Homo sapiens
IGNCPFSQR

SEQ ID NO: 52725 - protein, 24 aa, Homo sapiens
KPADLQNLAPGTHPPFITFNSEVK

SEQ ID NO: 52726 - protein, 22 aa, Homo sapiens
LDEYLNSPLPDEIDENSMEDIK

SEQ ID NO: 52727 - protein, 25 aa, Homo sapiens
RKPADLQNLAPGTHPPFITFNSEVK

SEQ ID NO: 52728 - protein, 18 aa, Homo sapiens
TDVNKIEEFLEEVLCPPK

SEQ ID NO: 52729 - protein, 20 aa, Homo sapiens
AMNEPQCFYNESIAFFYNRS

SEQ ID NO: 52730 - protein, 14 aa, Homo sapiens
APIICVLGHVDTGK

SEQ ID NO: 52731 - protein, 8 aa, Homo sapiens
HIAVFPCK

SEQ ID NO: 52732 - protein, 31 aa, Homo sapiens
HTHVQDGEAGGITQQIGATNVPLEAINEQTK

SEQ ID NO: 52733 - protein, 19 aa, Homo sapiens
IPGMLIIDTPGHESFSNLR

SEQ ID NO: 52734 - protein, 25 aa, Homo sapiens
KKQDFDEDDILKELEELSLEAQGIK

SEQ ID NO: 52735 - protein, 10 aa, Homo sapiens
QDFDEDDILK

SEQ ID NO: 52736 - protein, 25 aa, Homo sapiens
SEDSTKDDIDLDALAAEIEGAGAAK

SEQ ID NO: 52737 - protein, 28 aa, Homo sapiens
TLAGLPLLVAYKEDEIPVLKDELIHELK

SEQ ID NO: 52738 - protein, 26 aa, Homo sapiens
EFKNNFLNIDPITMAYSLNSSAQERL

SEQ ID NO: 52739 - protein, 10 aa, Homo sapiens
ESDHSSLNNK

SEQ ID NO: 52740 - protein, 16 aa, Homo sapiens
IPETLDNDTTQNLLTK

SEQ ID NO: 52741 - protein, 22 aa, Homo sapiens
MREPLESSNTKSFHSAVEIKNR

SEQ ID NO: 52742 - protein, 7 aa, Homo sapiens
YIQDPNK

SEQ ID NO: 52743 - protein, 24 aa, Homo sapiens
AFVDVDLLLGEIDPDQADITYEGR

SEQ ID NO: 52744 - protein, 19 aa, Homo sapiens
EVHDQLLQLHSIQLQLHAK

SEQ ID NO: 52745 - protein, 18 aa, Homo sapiens
EENFFNPKEEVKLEAHIR

SEQ ID NO: 52746 - protein, 23 aa, Homo sapiens
ENSGAAEKPVTIHATPEGTSEAC

SEQ ID NO: 52747 - protein, 24 aa, Homo sapiens
ENSGAAEKPVTIHATPEGTSEACR

SEQ ID NO: 52748 - protein, 25 aa, Homo sapiens
KENSGAAEKPVTIHATPEGTSEACR

SEQ ID NO: 52749 - protein, 27 aa, Homo sapiens
KRNTELETLLAKLIQTCQHVEVNASRQ

SEQ ID NO: 52750 - protein, 16 aa, Homo sapiens
LQDSVPENKGISLRSR

SEQ ID NO: 52751 - protein, 27 aa, Homo sapiens
SMTDEKTTKIACKSPPPESVDTPTSTK

SEQ ID NO: 52752 - protein, 12 aa, Homo sapiens
EWYGYHFPELVK

SEQ ID NO: 52753 - protein, 9 aa, Homo sapiens
GLTDLSACK

SEQ ID NO: 52754 - protein, 15 aa, Homo sapiens
IDCFSEVPTSVFGEK

SEQ ID NO: 52755 - protein, 24 aa, Homo sapiens
IGAAIQEELGYNCQTGGVIAEILR

SEQ ID NO: 52756 - protein, 8 aa, Homo sapiens
LHFHNLVK

SEQ ID NO: 52757 - protein, 13 aa, Homo sapiens
LIAHAGSLTNLAK

SEQ ID NO: 52758 - protein, 17 aa, Homo sapiens
VDNMIIQSISLLDQLDK

SEQ ID NO: 52759 - protein, 25 aa, Homo sapiens
VDNMIIQSISLLDQLDKDINTFSMR

SEQ ID NO: 52760 - protein, 13 aa, Homo sapiens
YPASTVQILGAEK

SEQ ID NO: 52761 - protein, 15 aa, Homo sapiens
GFSLLATEDKEALKK

SEQ ID NO: 52762 - protein, 17 aa, Homo sapiens
NREELGFRPEYSASQLK

SEQ ID NO: 52763 - protein, 29 aa, Homo sapiens
KYSSEFCSTPACSEGNSDCYFGNGSAYRG

SEQ ID NO: 52764 - protein, 30 aa, Homo sapiens
RGTWSTAESGAECTNWNSSALAQKPYSGRR

SEQ ID NO: 52765 - protein, 20 aa, Homo sapiens
DDQEQQLEFGAVYTATITEI

SEQ ID NO: 52766 - protein, 19 aa, Homo sapiens
GQTQVLCTVTFDSLESGIK

SEQ ID NO: 52767 - protein, 10 aa, Homo sapiens
TLHGSALFQR

SEQ ID NO: 52768 - protein, 12 aa, Homo sapiens
AVASQLDCNFLK

SEQ ID NO: 52769 - protein, 8 aa, Homo sapiens
IHAGPITK

SEQ ID NO: 52770 - protein, 17 aa, Homo sapiens
TLMELLNQMDGFDTLHR

SEQ ID NO: 52771 - protein, 16 aa, Homo sapiens
VADSKKLESKLDYKPV

SEQ ID NO: 52772 - protein, 23 aa, Homo sapiens
EGSYTNASTNSTSVTSSTATVVS

SEQ ID NO: 52773 - protein, 7 aa, Homo sapiens
YVKIVEK

SEQ ID NO: 52774 - protein, 16 aa, Homo sapiens
DYFLFNPVTDIEEIIR

SEQ ID NO: 52775 - protein, 24 aa, Homo sapiens
GYVPNLLGIIPYAGIDLAVYELLK

SEQ ID NO: 52776 - protein, 9 aa, Homo sapiens
HEGLGAFYK

SEQ ID NO: 52777 - protein, 23 aa, Homo sapiens
HSTGIDIGDSLTIPDEFTEDEKK

SEQ ID NO: 52778 - protein, 16 aa, Homo sapiens
NGDGVVDIGELQEGLR

SEQ ID NO: 52779 - protein, 20 aa, Homo sapiens
DQELYFFHELSPGSCFFLPK

SEQ ID NO: 52780 - protein, 14 aa, Homo sapiens
FNLTYVSHDGDDKK

SEQ ID NO: 52781 - protein, 20 aa, Homo sapiens
FQQDDAHIFCAMEQIEDEIK

SEQ ID NO: 52782 - protein, 17 aa, Homo sapiens
QVMVVPVGPTCDEYAQK

SEQ ID NO: 52783 - protein, 22 aa, Homo sapiens
TTPYQIACGISQGLADNTVIAK

SEQ ID NO: 52784 - protein, 22 aa, Homo sapiens
VNNVVWDLDRPLEEDCTLELLK

SEQ ID NO: 52785 - protein, 18 aa, Homo sapiens
EYCISSDDLFSLPYCPGK

SEQ ID NO: 52786 - protein, 23 aa, Homo sapiens
FGEENIEVYHSYFWPLEWTIPSR

SEQ ID NO: 52787 - protein, 36 aa, Homo sapiens
IPVTDEEQTNVPYIYAIGDILEDKVELTPVAIQAGR

SEQ ID NO: 52788 - protein, 23 aa, Homo sapiens
VVGFHVLGPNAGEVTQGFAAALK

SEQ ID NO: 52789 - protein, 14 aa, Homo sapiens
AVTEQGHELSNEER

SEQ ID NO: 52790 - protein, 28 aa, Homo sapiens
AVTEQGHELSNEERNLLSVAYKNVVGAR

SEQ ID NO: 52791 - protein, 22 aa, Homo sapiens
DNLTLWTSENQGDEGDAGEGEN

SEQ ID NO: 52792 - protein, 20 aa, Homo sapiens
EKIEAELQDICNDVLELLDK

SEQ ID NO: 52793 - protein, 18 aa, Homo sapiens
IEAELQDICNDVLELLDK

SEQ ID NO: 52794 - protein, 19 aa, Homo sapiens
QTTVSNSQQAYQEAFEISK

SEQ ID NO: 52795 - protein, 19 aa, Homo sapiens
TAFDEAIAELDTLNEESYK

SEQ ID NO: 52796 - protein, 29 aa, Homo sapiens
TAFDEAIAELDTLNEESYKDSTLIMQLLR

SEQ ID NO: 52797 - protein, 12 aa, Homo sapiens
YLIPNATQPESK

SEQ ID NO: 52798 - protein, 11 aa, Homo sapiens
YLSEVASGDNK

SEQ ID NO: 52799 - protein, 11 aa, Homo sapiens
KALMNGSESRF

SEQ ID NO: 52800 - protein, 20 aa, Homo sapiens
KILLTCSLNDSATEVTGHRW

SEQ ID NO: 52801 - protein, 15 aa, Homo sapiens
AAGTVFTTVEDLGSK

SEQ ID NO: 52802 - protein, 18 aa, Homo sapiens
ILLTCSLNDSATEVTGHR

SEQ ID NO: 52803 - protein, 18 aa, Homo sapiens
SELHIENLNMEADPGQYR

SEQ ID NO: 52804 - protein, 16 aa, Homo sapiens
SSEHINEGETAMLVCK

SEQ ID NO: 52805 - protein, 31 aa, Homo sapiens
VDSDDQWGEYSCVFLPEPMGTANIQLHGPPR

SEQ ID NO: 52806 - protein, 17 aa, Homo sapiens
AQLGVQAFADALLIIPK

SEQ ID NO: 52807 - protein, 21 aa, Homo sapiens
DGNVLLHEMQIQHPTASLIAK

SEQ ID NO: 52808 - protein, 9 aa, Homo sapiens
GLVLDHGAR

SEQ ID NO: 52809 - protein, 17 aa, Homo sapiens
KQDEPIDLFMIEIMEMK

SEQ ID NO: 52810 - protein, 23 aa, Homo sapiens
LTLACGGVALNSFDDLSPDCLGH

SEQ ID NO: 52811 - protein, 36 aa, Homo sapiens
LTLACGGVALNSFDDLSPDCLGHAGLVYEYTLGEEK

SEQ ID NO: 52812 - protein, 25 aa, Homo sapiens
NAIDDGCVVPGAGAVEVAMAEALIK

SEQ ID NO: 52813 - protein, 13 aa, Homo sapiens
QADLYISEGLHPR

SEQ ID NO: 52814 - protein, 18 aa, Homo sapiens
RVEDAYILTCNVSLEYEK

SEQ ID NO: 52815 - protein, 10 aa, Homo sapiens
TLNPKAEVAR

SEQ ID NO: 52816 - protein, 25 aa, Homo sapiens
VATAQDDITGDGTTSNVLIIGELLK

SEQ ID NO: 52817 - protein, 21 aa, Homo sapiens
VHAELADVLTEAVVDSILAIK

SEQ ID NO: 52818 - protein, 10 aa, Homo sapiens
KGFNASYIRV

SEQ ID NO: 52819 - protein, 21 aa, Homo sapiens
KTIDELAFKIDLNSTSHVNIT

SEQ ID NO: 52820 - protein, 18 aa, Homo sapiens
ILSSSDSDLLESSSEALK

SEQ ID NO: 52821 - protein, 11 aa, Homo sapiens
NSHTDSASMDK

SEQ ID NO: 52822 - protein, 11 aa, Homo sapiens
THFGVLMDLPR

SEQ ID NO: 52823 - protein, 16 aa, Homo sapiens
VILPQTSDAYQVSVAK

SEQ ID NO: 52824 - protein, 15 aa, Homo sapiens
CFYNSDGDFLIVPQK

SEQ ID NO: 52825 - protein, 10 aa, Homo sapiens
FSIDVFEETR

SEQ ID NO: 52826 - protein, 11 aa, Homo sapiens
GNLLIYTEFGK

SEQ ID NO: 52827 - protein, 18 aa, Homo sapiens
KVDFVSGLHTLCGAGDIK

SEQ ID NO: 52828 - protein, 30 aa, Homo sapiens
KYQGKLFAAKQDVSPFNVVAWHGNYTPYKY

SEQ ID NO: 52829 - protein, 13 aa, Homo sapiens
MLVQPNEICVIQR

SEQ ID NO: 52830 - protein, 19 aa, Homo sapiens
QDVSPFNVVAWHGNYTPYK

SEQ ID NO: 52831 - protein, 17 aa, Homo sapiens
SVRPGVAIADFVIFPPR

SEQ ID NO: 52832 - protein, 8 aa, Homo sapiens
WKPFEIPK

SEQ ID NO: 52833 - protein, 19 aa, Homo sapiens
KVLGSSTSATNSTSVSSRK

SEQ ID NO: 52834 - protein, 14 aa, Homo sapiens
KLQTTNTTRSVLKD

SEQ ID NO: 52835 - protein, 10 aa, Homo sapiens
LAVAKNELEK

SEQ ID NO: 52836 - protein, 23 aa, Homo sapiens
LAVAKNELEKAALDRESQMKAMK

SEQ ID NO: 52837 - protein, 13 aa, Homo sapiens
LQMPPCSECEVKK

SEQ ID NO: 52838 - protein, 16 aa, Homo sapiens
DTINTSCDIELLAACR

SEQ ID NO: 52839 - protein, 23 aa, Homo sapiens
EGLGVNEVHYVDNQDCIDLIEAK

SEQ ID NO: 52840 - protein, 21 aa, Homo sapiens
FAPFLNNSPQQNPAAQIPARQ

SEQ ID NO: 52841 - protein, 16 aa, Homo sapiens
HFAGAVCYETTQFVEK

SEQ ID NO: 52842 - protein, 20 aa, Homo sapiens
SAQSLEYCAELLGLDQDDLR

SEQ ID NO: 52843 - protein, 15 aa, Homo sapiens
SLGTRPPHVFAIADK

SEQ ID NO: 52844 - protein, 13 aa, Homo sapiens
TVYSHLFDHVVNR

SEQ ID NO: 52845 - protein, 26 aa, Homo sapiens
VVAGVLHLGNIDFEEAGSTSGGCNLK

SEQ ID NO: 52846 - protein, 15 aa, Homo sapiens
YLTESYGTGQDIDDR

SEQ ID NO: 52847 - protein, 21 aa, Homo sapiens
LAERPYIIAGLHFDQEVNHYK

SEQ ID NO: 52848 - protein, 19 aa, Homo sapiens
YNCDFCVHGNDITLTVDGR

SEQ ID NO: 52849 - protein, 14 aa, Homo sapiens
KYKPLNTTPNATKE

SEQ ID NO: 52850 - protein, 14 aa, Homo sapiens
ADPEEELSLTFALR

SEQ ID NO: 52851 - protein, 18 aa, Homo sapiens
AYPDVAALSDGYWVVSNR

SEQ ID NO: 52852 - protein, 14 aa, Homo sapiens
ILSGRPPLGFLNPR

SEQ ID NO: 52853 - protein, 21 aa, Homo sapiens
KFLSSSPHLPPSSYFNASGRA

SEQ ID NO: 52854 - protein, 14 aa, Homo sapiens
LFGGNFAHQASVAR

SEQ ID NO: 52855 - protein, 18 aa, Homo sapiens
LSELVQAVSDPSSPQYGK

SEQ ID NO: 52856 - protein, 14 aa, Homo sapiens
LYQQHGAGLFDVTR

SEQ ID NO: 52857 - protein, 25 aa, Homo sapiens
QAELLLPGAEFHHYVGGPTETHVVR

SEQ ID NO: 52858 - protein, 23 aa, Homo sapiens
QRPEPQVTGTVGLHLGVTPSVIR

SEQ ID NO: 52859 - protein, 24 aa, Homo sapiens
RKRYNLTSQDVGSGTSNNSQACAQ

SEQ ID NO: 52860 - protein, 23 aa, Homo sapiens
SPHPYQLPQALAPHVDFVGGLHR

SEQ ID NO: 52861 - protein, 7 aa, Homo sapiens
VNTELMK

SEQ ID NO: 52862 - protein, 27 aa, Homo sapiens
VPIPWVSGTSASTPVFGGILSLINEHR

SEQ ID NO: 52863 - protein, 9 aa, Homo sapiens
WLLAAGAQK

SEQ ID NO: 52864 - protein, 23 aa, Homo sapiens
YLTLENVADLVRPSPLTLHTVQK

SEQ ID NO: 52865 - DNA, 1416 bp, Homo sapiens
acgggctatttaaaggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtgagaaaaaaaaaaaaaaaaaa

SEQ ID NO: 52866 - DNA, 2353 bp, Homo sapiens
gatgcccccctaccaccggcgagtcggcatggtccaggagctgctgcggatggtgcgccagggccggcgggaggaggcggggacgctgctgcagcacctgcgccaggacctgggcatggagtcgacctcgctagacgacgttctgtatcgctacgccagcttccggaacctggtggaccccatcacacacgacctcatcatcagcctggcacgctacatccactgtcccaagccgcctcaaggctgtcctggccggaagccccccagacaacacagtggacctgtcgggaatcccactgacctcccgagacctggagcgggtgaccagctacctacagcgctgtggggagcaggtagacagcgtggagctgggcttcacaggcctcacggacgacatggtcctgcagctgctgccagcactcagcaccctgccccgcctcaccacactggcactcaatggcaaccggttgacccgggccgtgctgcgcgacctcactgacatccttaaggatcccagcaagttccccaatgtcacgtggattgacctgggcaacaacgtggacatcttctccttgccccagcccttcctgctcagcctgcgcaagcgctccccaaagcagggccacctacccaccatcctggagctgggtgagggcccaggcagtggggaggaggtccgggaagggacagtaggccaggaggaccctggagggggccctgtggcacctgccgaagaccaccatgagggaaaggagactgtagctgcagctcagacgtgacatggaagtgaagggcctcaccagggagtccttgttgggtagaatgggcaaggcaggcaggggagggcgcttctcctatcaggtgggttaaggatattgccaaaaattggcctgggccacccacctacagaaaggcaaaccatagcatctggggaaggggatttgtgttaaaacttcccgttggtcctctgcatctgccccctatcccattatctgccatttggttctcaagtcatcccaggccccagagaaccctctcagctcagctcatggccttccccaaagacttgtggaaatgggcacatggctggaggtactgtaagcctgagccattgtgaacaccaagagctttcccccagaaaaagaatacagtagggcccctacatgtactgcattacatttttcatttaggggaacgagctccaaccagaggaatgtgtccccactcaaggaaggtgggaatctttagcaaaattcctgtaactcctggttgcccgagaccccagttccatctatgctaggggtggactgaacgtggcctacctccttatggagacccagccctatttctgaggcccaccttgattctaggcatctgcccataggaccagctatcgctatatcctttgacagagcagcctacgatgccatgtggtagtgctcaggacagacatggtgcccatgcatacaggcataaagtcctgttcagaaatcccctatccaccttccctacccactgctggctgaaaaactaccagacttctatgtgggctctgatgtccttagcatgcagggtaagtgacaaacctggcttccttcttgtcacttgccagtatgacttcactgacctagacaggccgtaagaactctttccccataactcttaagtaatccaccaacacattccagaaaaccgactgcagaaggtgggctttaaaaccttaaaaacctaggacaatgaaggagtccaatcccttggcagatccaacaagatggctggggagagggagaaacaaactggaggctcccaaaggaacctaacttagcaaaggttctcatcttataccctccccttacccaaatactgtcctactgaaagggccctaccagttaagggatctcttctaaataacaggcaacccctagatccaagtagttcagtccaggaagactgggagccaatcactcttgaaccttgtgggcaaacagtatgggggaggaccctcttgacaggccttggtaggcaagattccaacacaggaagacagcaagatggggcctagagtatggggccctacatgctgttaaggttgtggttaggaatggtgcaatgctgcaggagctggaacaaagctacaccaaggaacagagcacagagcagcaggggccgaaattgaggaggccttaaatgctttgagcttttgccttcagtctaaagctgtagaatagggggttaagagcttaggctgaccacagggaagtttacaagctagagcgaatatctggactgctaatatctgacaacagtaggcgaaatttactttttcttcaaatacacattttcaagaattgac

SEQ ID NO: 52867 - DNA, 2114 bp, Homo sapiens
tgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacctgctgcagcccgacctccccatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctc

SEQ ID NO: 52868 - DNA, 2569 bp, Homo sapiens
agcctgcgtggggggaggggagaagagggcaaggggaggggacaagagagctagcggtcccgcccggtgatgtaggcagcccggggaggtggagccgcgacgcctgaaggagtccccaccgcagccgcgctctcggtctgccccactaagcagccgccagcggctccggcgacccaaattgcggcggcagggaccgcggaaatcccaccgtttgggcttggtggacgtccagcccacctcacccccagccccggcccctcctcgcttcccagacggctggagacactcccgggaaaagcggtcctcagccactcggccgccgtccgcacctcggctgctggcccggctgggcaccgggcatctgcgaagctagccctgcctggcactgggcatctccaggcaacgactgtccccggccctgcccagcttctcgcgactccagggcggtggacttctgcgcgccttccctcccccggtctcccgacaggacgccggtgagctccctgcgcccccagcccctttcgccgccgccgcgatgctgccctggagacgtaacaaattcgtgctggtggaggacgaggccaagtgcaaggcgaagagcctgagtccggggctcgcctacacgtcgctgctctccagcttcctgcgctcctgcccggacctgctgcccgactggccgctggagcgcttgggccgtgtgttccgcagccggcgccagaaagtggagctcaacaaggaggacccgacctacaccgtgtggtacctgggcaacgccgtcaccctgcacgccaagggcgacggctgcaccgacgacgccgtgggcaagatctgggctcgctgcgggcctggcgggggcactaagatgaagctgacgctggggccgcacggcatccgcatgcagccgtgcgagcgcagcgccgccgggggttcggggggccgcaggccggcgcacgcctacctgctgccgcgcatcacctactgcacggcggacgggcgccacccgcgcgtcttcgcctgggtctaccgccaccaggcgcgccacaaggccgtggtgctgcgctgccacgctgtgctgctggcgcgggcgcacaaggcgcgcgccctggcccgcctgctccgccagaccgcgctggcggccttcagcgacttcaagcgcctgcagcgccagagcgacgcgcgccacgtgcgccagcagcatctccgcgctgggggcgccgccgcctcggtgccccgcgccccactgcgccgcctgctcaatgccaagtgcgcctaccggccgccgccgagcgagcgcagccgcggggcgccgcgcctcagcagcatccaggaggaggacgaggaggaggaggaggacgacgcggaggagcaagagggaggagtcccccagcgcgagcggccggaggtgctcagcctggcccgggagctgaggacgtgcagcctgcggggcgccccggcgcccccgccgcccgcgcagccccgccgctggaaggccggccccagggagcgggcgggccaggcgcgctgagagccgaaggacaggactcgcagccccaggcccgacccgccagactcacagcctccaaccccggccctgcccgcttcggctgccccggcccccggcccgtgtctcccccgtggtctccgtgttgtccgccccgccgcctcattttggctcagggtgatgcctgatacgcccttggttattggggggtgttcctctctccccacacccggagtttcccgggcctgccattgtggacccgccccctatgctttacacctagtctctttgcccacagacctcctcattccctcccaaaacatcctctcaagagaagggaggagaagtttcaagaaatcaggaggggtgggtttggaccctgggcagggtggaggcagtgaccttgcccttggtccctctagccttcttccctgtgcaaaaaaaaatgaccctggagaggcattcttgtaggagaagaatctagcggccggggagaattggggccgggccggcggtgggcagagtccgctgctatacacacagggaggaattctcacgcccaagccccgcctctctacgccttggaggactcctgtgacttcactgctctgcctctggagaacactgggagagtcctaccgacgttcaaacaacaggttaggccaggtaacagccctgcaccaggccgctgcccacgcctctgccctggcacccccaggggattccttgcccatcccatctctctgcagacggatgtgtgtggccccctcctaggtgccccacaaccaggaccaagatggggctcccaaaggaggtaaggagaacctttggcaggtgcttaggacactgactacctagaaagtagacgcagcagagttgctcccaagtcgaggctcctcagagcaggtgggtcctgacagcagtggattctcccagcaggatgaggaaggagggtgtgttaaccaaccaagggagtgggccccccacccaggtgtctccgcaagaccacaaaaagcccaaagatctatgtgtcactgatcattgtaaataaagtggacctgcttttac

SEQ ID NO: 52869 - DNA, 5762 bp, Homo sapiens
gctctaaaggaagaggcagaaaaacaagagataacaaaggctccgtttcctttctgtgagagaaggcttttgtctttcctcctgctacgatgtcagtgtctggcaagaaagagtttgatgtgaaacagatcctaaggctacgctggaggtggtttagtcatccttttcaaggttccaccaacactggaagctgtcttcagcaggaaggatatgagcatagagggaccccggttcagggcaggttgaagagccactctcgggacagaaacggactgaagaaaagcaacagtcctgtccaccacaatatactggcaccagtgccaggaccggcccctgcccatcagagagccgttcagaatttgcagcaacataatctgatagtacattttcaagcaaatgaagatactcctaaatcagttccagagaagaatttattcaaagaagcttgtgagaaacgcgcacaagatttggagatgatggctgatgacaatatagaagattctacagcaagattagatacacaacactctgaagacatgaatgccaccagatctgaagagcagttccatgttataaaccacgcagagcaaactcttcgtaaaatggagaactacttgaaagagaaacaactatgtgatgtgctactgattgcaggacacctccgcatcccagcccataggttggttctcagcgcagtgtctgattattttgctgcaatgtttactaatgatgtgcttgaagccaaacaagaagaggtcaggatggaaggagtagatccaaatgcactaaattccttggtgcagtatgcttacacaggagtcctgcaattgaaagaagataccattgaaagtttgctggctgcagcttgtcttctgcagctgactcaggtcattgatgtttgctccaattttctcataaagcagctccatccttcaaactgcttagggattcgatcatttggagatgcccaaggctgtacagaacttctgaacgtggcacacaaatacactatggaacacttcattgaggtaataaaaaaccaagaattcctcctgcttccagctaatgaaatttcaaaacttctgtgcagtgatgacattaatgtgcctgatgaagagaccatttttcatgctctaatgcagtgggtggggcatgatgtgcagaataggcaaggagaactggggatgctgctttcttacatcagactgccattactcccaccacagttactggcagatcttgaaaccagttccatgtttactggtgatcttgagtgtcagaagctcctgatggaagctatgaagtatcatcttttgcctgagagaagatccatgatgcaaagccctcggacaaagcctagaaaatcaactgtgggggcactttatgctgtaggaggcatggatgctatgaaaggtactactactattgaaaaatatgacctcaggaccaacagttggctacatattggcaccatgaatggccgtaggcttcaatttggagtcgcagttattgataataagctctatgtcgtgggaggaagagacggtttaaaaactttgaatacagtggaatgttttaatccagttggcaaaatctggactgtgatgcctcccatgtcaacacatcggcacggcttaggtgtagccactcttgaaggaccaatgtatgctgtaggtggtcatgatggatggagctatctaaatactgtagaaagatgggaccctgagggacgacagtggaattacgtagccagtatgtcaactcctagaagcacagttggtgttgttgcattaaacaacaaattatatgctattggtggacgtgatggaagttcctgcctcaaatcaatggaatactttgacccacacactaacaagtggagtttgtgtgctccaatgtccaaaagacgtggaggtgtgggagttgccacatacaatggattcttatatgttgtaggggggcatgatgcccctgcttccaaccattgctccaggctttctgactgtgtggaacggtatgatccaaaaggtgattcatggtcaactgtggcacctctgagtgttcctcgagatgctgttgctgtgtgccctcttggagacaaactctacgtggttggaggatatgacggacatacttatttgaacacagttgagtcatatgatgcacagagaaatgaatggaaagaggaagttcctgttaacattggaagagctggtgcatgtgttgtagtggtgaagctaccctaaagctatctatctttatcaaatggaatgaaactagataatttcaagaaactgagtaggacaaagggagaaagaaatacatgttctttttcctgcaattaataatcagactggaaaattgttgtatcattttaatttgtagttacaattgctttcattcgtgaagccgaaacgtttttaaacatgaattacatatgaattattaagcatatgtgctttcgcagctgataatataaaaggaaatcccacagtctagatatagccccattactacaaaatgctaaaatatttaatgaaaattgatggtggccacagtgtgcaggttataaaagcattaatacatttcaaggtaagagccttaaaagttaaaaacattttcagtttttttttaaaaaacgtactcttattatctggaacatagaaatataaaaggtaacatctaaagcttagaatagtgtgatttttagtaagccattattctcctattcaaataatatcccaaagagctaaacaattccttacatttaccaagaggaaagcttttactgtgttgaagctaaaaaaataatggctctttgacaaaacttgttatgttgatcgcggtatgtcaaaatttttacaggtttgctcatctgccagagcacacatataaatttggtatttcttaacatattatcttgttagatttgttaccagtaaaatattactgtaatttcatatacacagtctatacaatgaaataatgaatatttatcatattgatacaaactgtgacctcagcttcagagtgtcagggcctcacttgtatagaatgtaatgttctcctcaaacatttatgttaactctataaacaaatatcgttaagttaaacaagttttcaaaaacaaaacaatttttaaagtaccttaaaattgaggatgttactcagtgttaacacatgggaacaccaaaatattcaataagcctggtcaattctatagttatcttttttgtaccaacacatgcttttctgttactgttatattatccagtagaaaatgttaggatatgtgtgctatataaaaaaaaaaaaagacttgttaagttttaaaataacaaaaatggctagttgaatagtattttatgtgtaattcttccatttattctgtttaattatacaactaagatgaaatattgaaaaaccctttgtgaaagtaacttttcaagtaaatgcacaactttagaatttctacaaataagttcttttaaacagtctttttattgtggattgtgaaatcaaaatctggagaaatgcttataaaatatactactagcttttaagttttaagaaagaagaacgtaagttgtacaaagatatttgtactttgacaaactgaatttaaataaactttatttcctctcactatagtgtggctttagaatatatcaagtacaacctgaatggactttttgattttacatttcctatatcactaaaatacttaaacacaaaaataaaattccactcctttatttcttcttacacctgccattgtctctaattctaaagagagagctatagatttctgcagttctagaggtgaagatagagacatagagaggctgtgaaacacacatacagccctgttaggtcttttgaattcacaccttattgaaatcagtgtagaagtagagttacctaaacctttatcgccaatgcacagcttggcctgttaagttaaatgtgggtgtcaaccagtggaaaagatcaaaggaccttttgcagcctagcttgccaatcttccagtaacaacgaggtgctaccaataggcagactgtgtctagagtcatgcatggacaagaggaaagtgaaagttgaatactctcttctcaatggcatagctggacttgattaagtattgactcatagaagagacatgtatgtttcccggggctaccccttcatagctgcatttaaaaatggtgttcaggccactatggctgctgtggtttgaatatttttttccctcgaaaactcatgttgaaacttaactcctaatgtagcagtactgagaggcagggcccttaagaggtgattgggccatgaggtctgtgccctcctgaatggattaatccattcatggattaatggattattatgagtgggggactggtgactttatatgaaaaggaaggaagagtgacctaagctagcatgctcagggtgcaccgtatgtcccctggtcatgtgatgctatgtgttaccttgggacttacctgacagctcttaccaacaagaaggccatcccagatatggcctctcaacctcagacttctcagcctgcctaactgtaagaaattaattctttttctttataaattacccaggttctgttttaagcctcagaaaatgaactaagacaatgccctagatgagctgccaaaatctgagcagatatgagccatcagaatagagacctgcagaggcccagggcactcaaacataactgtgcttgtctcagtcaaacttaattgggaaaaggaggagtaagagcaggccctttctgacatgctttagcagagataacttatcagggctagtttaaacaaatgtgtataggaaaggatgttatttatatattcttacaagagtgtaagggctcacacatttactgtactcagatctgaaagacaatgttgcttcttgatttttttctataatcactatgaccgtgttcacgattccctactctgcaactctcagcatgcatcatgatgattctctaacactgtctgtcaccttcctgtatttccacagagcatgcaagaacttctacaaaacttctataccacacagaagctgaaagagactctggggcactaaattcagatcctttctccacacagcaatgacatttatcaatctgactcaggtgtggctgttgcccctttttgatatggagggaacactgaaagacagtttccttctggagttccaaatgcaatatagaaaaaaaaaccctgtgactctggattttattttaagttctctaacaagactcctaccttgagatcttagtctaggtaaagaaaaaaaaaaaaaggtcatgaaacacaaatgtcctcaactgtcatcattctatgtttactttctcccaatcacatcacctgaggtagaagagatttttcagttgctatttctcttcgtaatgaattttctttacatcctgtccacactgctggagatactaagtcccaacctaaatgatggaaggagcatctcccctcttgtctgtggaagatatcacatgaactacctaattttcaagcatggatctccatatttcaaaggaaagtttttaaaatgtttttaaaacttcaaatatctcaccacagtgaattatgggtaaggtgataatatgtttaattagcttgatttaatcatcccacactgtatacatatgccaaaatatcattttgtatgccataatatatatgatttatgaattatagtaatattaataaaagtgttaaagcttt

SEQ ID NO: 52870 - DNA, 1525 bp, Homo sapiens
atgacaggctggagctgccttgtgacaggagcaggagggtttctgggttagaggatcatccgcctcttggtggaggagaaggagctgaaggagatcagggccttggacaaggccttcagaccaaagctgagggaggaattttctgagctccagaacaagaccaagctgacagtgctggaaggagacattctggatgagccattcctgaagagagcctgccaggacatgtcggtcatcatccacactgcctctatcatatatgtcatcggtgtcactcacagagtccatcatgaatgtcaatgtgaaaggtacccagcttctgttggaggcctgtgtccaagctacagtgccaatcttcatctacaccagtaccctagaggtagccaggcccaattcctacaaggaaatcattcagaacggtcatgaagaagagcctctggaaaacacatggtacgctccatacccacacagcaaaaagcttgctgagaaggctgtgctggcggctaatgggctgactctgaaaaacggtggcaccttgtacacttgtgccgtaagaccaatgtttatctatggggaaggaagcccaatcctttctgccggtataaatgaggccctaaacaaccatggaatcctgtcaagtttcagcaagttctccagagtcaacccagtctatgttggcaacatagcctgggcccacattctggccttgagggccctgcgggagcccaagaaggccccaagtgtccgaggacagttctactatatctcagatgacacgcctcaccaaagctatgataaccttagttacaccttgagcaaagagttcggcctctgccttgattccagttggagcctgcctttatccctgacgtactggattggcttcctgctggaaatagtgagcttcctgccgaggccagtttacacctgtcgaccgcccttcaaccaccacagagtgacattgtcaaatagcgtgttcaccttctcttacaagaaggctcagcaagatctggcatataagtcactttacagctgggaggaagccaagcagaaaaccatggagtgggttggttcccttgtggactggcacaaggagaccctgaagtccaagactcagtgatcgaaggatgacagagatgtgcatgtgggtattgttaggagatgtcgtcaagctccatcctcctggcttcatacaggtgacaagggcaaaagtccaggtcctgctgcctccctttcacataatagccaacttattgtcttcctcatgtcatcaaaacctgcccagtccctggcccaaccagaagctttttgtcctaatcatataccagaggaaagacaatgtgatttgctttttccatatctcagtggctgattccgaacaattgtagtctcttctaacttgaggtcatttttaactactagagctccatttctactcttaaatgagaaaggatttcttttcttttaaatctcctatttcttcacgcagtccaatgtaaagagcaataaatgttttaatccttaa

SEQ ID NO: 52871 - DNA, 1525 bp, Homo sapiens
atgacaggctggagctgccttgtgacaggagcaggagggtttctgggttagaggatcatccgcctcttggtggaggagaaggagctgaaggagatcagggccttggacaaggccttcagaccaaagctgagggaggaattttctgagctccagaacaagaccaagctgacagtgctggaaggagacattctggatgagccattcctgaagagagcctgccaggacatgtcggtcatcatccacactgcctctatcatatatgtcatcggtgtcactcacagagtccatcatgaatgtcaatgtgaaaggtacccagcttctgttggaggcctgtgtccaagctacagtgccaatcttcatctacaccagtaccctagaggtagccaggcccaattcctacaaggaaatcattcagaacggtcatgaagaagagcctctggaaaacacatggtacgctccatacccacacagcaaaaagcttgctgagaaggctgtgctggcggctaatgggctgactctgaaaaacggtggcaccttgtacacttgtgccgtaagaccaatgtttatctatggggaaggaagcccaatcctttctgccggtataaatgaggccctaaacaaccatggaatcctgtcaagtttcagcaagttctccagagtcaacccagtctatgttggcaacatagcctgggcccacattctggccttgagggccctgcgggagcccaagaaggccccaagtgtccgaggacagttctactatatctcagatgacacgcctcaccaaagctatgataaccttagttacaccttgagcaaagagttcggcctctgccttgattccagttggagcctgcctttatccctgacgtactggattggcttcctgctggaaatagtgagcttcctgccgaggccagtttacacctgtcgaccgcccttcaaccaccacagagtgacattgtcaaatagcgtgttcaccttctcttacaagaaggctcagcaagatctggcatataagtcactttacagctgggaggaagccaagcagaaaaccatggagtgggttggttcccttgtggactggcacaaggagaccctgaagtccaagactcagtgatcgaaggatgacagagatgtgcatgtgggtattgttaggagatgtcgtcaagctccatcctcctggcttcatacaggtgacaagggcaaaagtccaggtcctgctgcctccctttcacataatagccaacttattgtcttcctcatgtcatcaaaacctgcccagtccctggcccaaccagaagctttctgtcctaatcatataccagaggaaagacaatgtgatttgctttttccatatctcagtggctgattccgaacaattgtagtctcttctaacttgaggtcatttttaactactagagctccatttctactcttaaatgagaaaggatttcttttcttttaaatctcctatttcttcacgcagtccaatgtaaagagcaataaatgttttaatccttaa

SEQ ID NO: 52872 - DNA, 2006 bp, Homo sapiens
ggcttgggcacaagatggccgctgcgcgcccagaggcccagagtcggagctcaccgactccggagtcgcgatcccaggagccactggacctggtcctggtgcctgatgactgccggcctggcacacccccgagtgacctcatcgagatccaggtggtgaaggtgacggacaccacgctggtccctgagcccccggagccaggttctttccactgtgccttgtgccctgctgccttccggctggtttccgagctgctgttccacgaacatggccacttggctggggccgagggaggcgggcagggtggggacccgagccggtgccacgtgtgcggccacagctgcccgggccccgccagcctgcgcgcgcactacagcttgcacacgggggagcggccctaccgctgcgcgctctgcccccgcgccttcaaggccttggcgcccctgctccggcaccagcaccggcacggggtggagccgggcacctctcggaggcctccggacacagcggccgttgcagaacagaggcccggggtggccccggagagggcggaggtggtgatggcggcggcggcggcgggcgcagcggtggggaagccttttgcctgcaggttctgcgccaagcccttccgccgctcctcagacatgcgagaccacgagcgcgtgcacactggcgagcggccataccattgcggcatctgcggcaagggcttcacccagtcctcggtgcttagcggccacgcccgcatccacactggcgagcgcccgttccgctgcacgctctgcgaccgcaccttcaacaactcctccaacttccgcaagcaccagcgcacccacttccacgggccggggccggggctgggagactctggaggccagctgggctcgtcggcggctgaggggtcggggagcgggtgtggggtaggggaccctgcggaggaggggcggggggagaccgcgaaggtgaaggtggaggccgaccagtaggctgcagaccagggacatgggttagttaaggcggaggtacgaggccgacccggggagggggacggggtggggaaacggaggcaggggacagaagaggggagattgggggagagatgacagctgcagggatggttgtgagccgctagtgatggagagcagagggagagggccaggctccagactcccacacgcccacacagcacctctgccaggcctaggagaggacaggtgcagctcttgcagctctgcgggtgtgcggccaaaggcaaggcccacgggctggatgtcacttccccgactgtctcttggttggcttgtccttgtgcaagacccagcctgtcacgacagagcctgggcacttcagaggaggagccaggatcgaatggaaggggggaattggggtccaccatagtcttctgctctggtcctccacgggtggaccaggatggagtctcctgcctacctcactgcattgcactggacctgggatgcctatccaccctctggcagaagacactcaccaggttatctgtgaagagactctgggatcccatcacctcaaagccagagggtccccaagtcaccgctgagagcacttgagcctcaaggatgtaagcctgaccataggatcttgactccaacagcggcaacccccacccccattgtggtccgtccttaacccatccactcttcttcggaggcaactgagaacacataaagcaagcagctacctagcatccccctcctaaagctttagactcagagcccagggtcccccacaagcctcaaggtagcctcaggtttctctaatttcctccactcccagttcgaagcaaacagcttactgcctagtccccgccaatcccaagggcgggctggctgatggcagcatggtgggctggcctgggtgtggagtgaaagagtcactgtggtgggggcgagaggaggacttgggagctggaggtgtgacaccttcagttctgttcctattaaaggaccttctgaagggcaaaaaaaaaa

SEQ ID NO: 52873 - DNA, 2398 bp, Homo sapiens
ggcgggactgcgcggcggcgactacagacgtgtcgggggtccggggcctgtcgcggttgccaagcgctcggcgcctggcgctggcgctggccaaggcgtggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggccggctttgcgagctgcatttggcctttccgaggcagagtttgatacagcatgtgttaccaagctgtttcctaccaggtcacacactgttgcagcgcaggttggaatcaatgctgctctggggaacatggaggaggacaactggaggtggcatttctatgacaccgtgaagggctccgactggctgggggaccaggatgccatccactacgtgacggagcaggcccccactgccatggtcgcggtagaaaattatggcatgccgtttagcagaactgaagatgggaagatttatcagcgtgcatttggcggacacagcctcaagtttggaaagggcgggcaggcccatgggtgctgctgtgtggctgatcggaccggccactcaatattgcacaccttatacgggaggtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacagggtaggaatctaatttctactttatttcctttgtaaaaatgaataaattccatttagagtgtctttattttaaggaaaatagaggcattgtagaatagcagttcagacacaggccttgatataaccgtgtgagggtgatggcctttcccagccgtggttcctcacctgtaaagggtgaggacagcagcacctgcctcagggggtgagaaagcatggccctcagtagtcggtagtggctgccgtcaggttcacagcgtacctctcccgattttagatgaggaaactgtggcccgaagagtcacatggggttttctggcaaaatccctcttgttttagtgggttctatgtttatactgattcctgggatagataagtctgtcttctccacataatgaaaataaaaaactttaattttatacagtggcagttactttagccactttaaaagttaagaagtgtcagtacagccaagaaaaaaaatcagcaaaactacaggttgggaaaaaaatattttccaaaccatatatctaatgatatcttagtatctaaaatagcaaaaaaaataaaaaataaaaaaaagccctactaaaaccaacctactaaaccctactaaaaaacaaccctactaaaaatgggcaaaggacttgaatagatatttttccagagaagacatacaaatggccagttgatgtatgaaaaaatgctcaacatcaccaagcaccagagaaatgcaaattaaaaccccaatgagtatcatctcatctcgctccagttagagtggctgttaccaagaggacaaaagatagtgttggtgaggatgtggagaaaagggaaccctgtgtgctgttggtgggaatgtaaattagtacaactattgtggaaaactctggaggttcctcaaaagtcacaggactaccatgtgctccagcaacctcatttctgggtgtatatccaaagggcatgaaatcagaagctcaaagagacacctggacccccatgttcattgcagcgttattcacaatacccgagatatggaaacaacctaaaaatttttggtgtttaatgacaatgtggtgtgtgtacacaactgaatattattcagctatgaaaacgaaggaaatcctgtcatgtgtgacaacgtggatgaacccaaagtcattatgttaagtgaaacgacccaggcacagaaagacagatactgcatgtcactcatatgtggatctaaaactgtcacaactcacagaaacagagtaggacagtggttgccaggggctgggggaatgcagactgtggcgatgctgattaaaggtgtaacttcccgtcacaaggtgaagttctgaaggtctgataaacagcatggtggctagagttaatgttatagagcatggtggccagagttaacattatacagcatggtggctacagttaaaatcatacagtacggtggctatcattaatataacttgaaatttgcgaagagagtagaccttaggtgtctgtatctccaaaaaaaaaggataattgtatgaggtgatagatgtgtattaagttgattgtgtcatcagttcacaaaataaatcatcacgttgtacac

SEQ ID NO: 52874 - DNA, 2389 bp, Homo sapiens
gggaaggcgagcagtgccaatctacagcgaagaaagtctcgtttggtaaaagcgagaggggaaagcctgagcatgcagagtgtgcagagcacgagcttttgtctccgaaagcagtgcctttgcctgaccttcctgcttctccatctcctgggacaggtcgctgcgactcagcgctgccctccccagtgcccgggccggtgccctgcgacgccgccgacctgcgcccccggggtgcgcgcggtgctggacggctgctcatgctgtctggtgtgtgcccgccagcgtggcgagagctgctcagatctggagccatgcgacgagagcagtggcctctactgtgatcgcagcgcggaccccagcaaccagactggcatctgcacggcggtagagggagataactgtgtgttcgatggggtcatctaccgcagtggagagaaatttcagccaagctgcaaattccagtgcacctgcagagatgggcagattggctgtgtgccccgctgtcagctggatgtgctactgcctgagcctaactgcccagctccaagaaaagttgaggtgcctggagagtgctgtgaaaagtggatctgtggcccagatgaggaggattcactgggaggccttacccttgcagcttacaggccagaagccaccctaggagtagaagtctctgactcaagtgtcaactgcattgaacagaccacagagtggacagcatgctccaagagctgtggtatggggttctccacccgggtcaccaataggaaccgtcaatgtgagatgctgaaacagactcggctctgcatggtgcggccctgtgaacaagagccagagcagccaacagataagaaaggaaaaaagtgtctccgcaccaagaagtcactcaaagccatccacctgcagttcaagaactgcaccagcctgcacacctacaagcccaggttctgtggggtctgcagtgatggccgctgctgcactccccacaataccaaaaccatccaggcagagtttcagtgctccccagggcaaatagtcaagaagccagtgatggtcattgggacctgcacctgtcacaccaactgtcctaagaacaatgaggccttcctccaggagctggagctgaagactaccagagggaaaatgtaacctatcactcaagaagcacacctacagagcacctgtagctgctgcgccacccaccatcaaaggaatataagaaaagtaatgaagaatcacgatttcatccttgaatcctatgtattttcctaatgtgatcatatgaggacctttcatatctgtcttttatttaacaaaaaatgtaattaactgtaaacttggaatcaaggtaagctcaggatatggcttaggaatgacttactttcctgtggttttattacaaatgcaaatttctataaatttaagaaaacaagtatataatttactttgtagactgtttcacattgcactcatcatattttgttgtgcactagtgcaattccaagaaaatatcactgtaatgagtcagtgaagtctagaatcatacttaacatttcattgtacaagtattacaaccatatattgaggttcattgggaagattctctattggctccctttttgggtaaaccagctctgaacttccaagctccaaatccaaggaaacatgcagctcttcaacatgacatccagagatgactattacttttctgtttagttttacactaggaaacgtgttgtatctacagtaatgaaatgtttactaagtggactggtgtcataaactttctccatttaagacacattgactcctttccaatagaaagaaactaaacagaaaactcccaatacaaagatgactggtccctcatagccctcagacatttatatattggaagctgctgaggcccccaagttttttaattaagcagaaacagcatattagcagggattctctcatctaactgatgagtaaactgaggcccaaagcacttgcttacatcctctgatagctgtttcaaatgtgcattttgtggaattttgagaaaaatagagcaaaatcaacatgactggtggtgagagaccacacattttatgagagtttggaattattgtagacatgcccaaaacttatccttgggccataattatgaaaactcatgatcaagatatatgtgtatacatacatgtatctggtttgtcaggctacaaggtaggctgcaaaattaaatctagacattcttttaatgccaccacacgtgttccgcttctctcttttaaagtatttataaaaatataaattgtacattttgtaaaatattatgtttgatttctctacttgtcatatcactaaataaacacgattttattgctgaaaaaaaaaaaaaaaaaaa

SEQ ID NO: 52875 - DNA, 2245 bp, Homo sapiens
ctcagctacgggacacatttcaggtatccaaggcagcagaggtgagtgggtcccccgagctctgtgaccttatgctccacactaactctggcagagcctccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatcttcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattagcactgagatccagagaggctggatgacttgctcaagttcaccagcatggtagtggcaaagagaggtccagagtcctggcccttgatgcccagctcagtgccacaaagctcagtaggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtgtcagttgcaggtgccaatgactaactttttgaattctatgttggcattaacaataaagcattttgcaaacaaaaaaaaaaaaaaaaaaa

SEQ ID NO: 52876 - DNA, 3645 bp, Homo sapiens
agtttgaggccaacactaggaagtgtctggaaccggatccggaggcttcacaatctatatgttgcctccaaaggacctgcagagaaacgcctcctgattttgtcttacaatggaacttaaaaagtcgcctgacggtggatggggctgggtgattgtgtttgtctccttccttactcagtttttgtgttacggatccccactagctgttggagtcctgtacatagaatggctggatgcctttggtgaaggaaaaggaaaaacagcctgggttggatccctggcaagtggagttggcttgcttgcaagtcctgtctgcagtctctgtgtctcatcttttggagcaagacctgtcacaatcttcagtggcttcatggtggctggaggcctgatgttgagcagttttgctcccaatatctactttctgtttttttcctatggcattgttgtaggtcttggatgtggtttattatacactgcaacagtgaccattacgtgccagtattttgacgatcgccgaggcctagcgcttggcctgatttcaacaggttcaagcgttggccttttcatatatgctgctctgcagaggatgctggttgagttctatggactggatggatgcttgctgattgtgggtgctttagctttaaatatattagcctgtggcagtctgatgagacccctccaatcttctgattgtcctttgcctaaaaaaatagctccagaagatctaccagataaatactccatttacaatgaaaaaggaaagaatctggaagaaaacataaacattcttgacaagagctacagtagtgaggaaaaatgcaggatcacgttagccaatggtgactggaaacaagacagcctacttcataaaaaccccacagtgacacacacaaaagagcctgaaacgtacaaaaagaaagttgcagaacagacatatttttgcaaacagcttgccaagaggaagtggcagttatataaaaactactgtggtgaaactgtggctctttttaaaaacaaagtattttcagcccttttcattgctatcttactctttgacatcggagggtttccaccttcattacttatggaagatgtagcaagaagttcaaacgtgaaagaagaagagtttattatgccacttatttccattataggcattatgacagcagttggtaaactgcttttagggatactggctgacttcaagtggattaataccttgtatctttatgttgctaccttaatcatcatgggcctagccttgtgtgcaattccatttgccaaaagctatgtcacattggcgttgctttctgggatcctagggtttcttactggtaattggtccatctttccatatgtgaccacgaagactgtgggaattgaaaaattagcccatgcctatgggatattaatgttctttgctggacttggaaatagcctaggaccacccatcgttggttggttttatgactggacccagacctatgatattgcattttattttagtggcttctgcgtcctgctgggaggttttattctgctgctggcagccttgccctcttgggatacatgcaacaagcaactccccaagccagctccaacaactttcttgtacaaagttgcctctaatgtttagaagaatattggaagacactatttttgctattttataccatatagcaacgatattttaacagattctcaagcaaattttctagagtcaagactattttctcatagcaaaatttcacaatgactgactctgaatgaattatttttttttatatatcctattttttatgtagtgtatgcgtagcctctatctcgtatttttttctatttctcctccccacaccatcaatgggactattctgttttgctgttatacactagttcttaacattgtaaaaagtttgaccagcctcagaaggctttctctgtgtaaagaagtataatttctctgccgactccatttaatccactgcaaggcacctagagagactgctcctattttaaaagtgatgcaagcatcatgataagatatgtgtgaagcccactaggaaataaatcattctcttctctatgtttgacttgctagtaaacagaagacttcaagccagccaggaaattaaagtggcgactaaaacagccttaagaattgcagtggagcaaattggtcattttttaaaaaaatatattttaacctacagtcaccagttttcattattctatttacctcactgaagtactcgcatgttgtttggtacccactgagcaactgtttcagttcctaaggtatttgctgagatgtgggtgaactccaaatggagaagtagtcactgtagactttcttcatggttgaccactccaaccttgctcacttttgcttcttggccatccactcagctgatgtttcctgggaagtgctaattttacctgtttccaaattggaaacacatttctcaatcattccgttctggcaaatgggaaacatccatttgctttgggcacagtggggatgggctgcaagttcttgcatatcctcccagtgaagcatttatttgctactatcagattttaccactatcaaatataattcaagggcagaattaaacgtgagtgtgtgtgtgtgtgtgtgtgtgtgctatgcatgctctaagtctgcatgggatatgggaatggaaaagggcaataagaaattaatacccttatgcagttgcatttaaccttaagaaaaatgtccttgggataaactccaatgtttaatacattgattttttttctaaagaaatgggttttaaactttggtatgcatcagaattccctatagatctttttgaaaatataggtacctgggtatcacacatagaacttttaattctgctggtgtaggctgttgcccaaacatctataattttactgagctcttcaagtgattctgataacacagcctggattgagaatttttataagattggcaatggaaaaacatttattcttttaaataataatttttttaaaacccaagaggtcaggggattttataaaccaatagccaagtgttctttaaataggaggcacccttcccattgtgccaaaatcatcttttcatttattttgaaatttgtatgattattttatacttgtatgttgcctttcttcgaaggcgcctgaagcactttataaacacaaatcctcacaatacctctgtgaggtaggtaaatagtacttttctatgtagtaaacctggaatatggagaatttcataacagttcattctacttaataatgcaataatggagctccaagttgtcttggacttctacaccacactcagacttctggaaagttttctgtacctcattctttagtccctgtcaaggttagtaaataaaataagtgacataaaaaaaaaaaaactaaactacttgttgtgttgaaagttcctttttgccagttatgttcaggaaacccaataacctgaaaaagtttgactttgatgtgacatcttcatattcatcaatgctgataattgtccaaaggcatcttcactatgtctgctaaataacatccaatgtgggcgttatctgttgtctaggggatgaattttaagttacaataaaatatttttctttgttttgc

SEQ ID NO: 52877 - DNA, 1509 bp, Homo sapiens
ggcgaatctgctgctaccaatgtaaaggtcaggccgaggccggcgcggagaatctgctgtcgcctgcagctgctcgcctgtctccgtcggaagggagcccaagctttgcagagagacagggagtcgcccaggctggagagcggtggcgcgatctcggctcactgcagcgtcgacatttcgggtcaagcgatcctccagcctcggcctctcaaagtgctggtattacaggcgtgagccagcgcgtgcctggccaaaaattttctaaatttgtataataatttataattgtaatgcatttttatagacaccatatgatctaatcttcacaaaaacctagtgaagtgacatttagctacatttcacaataagaatcctgaagctcaaaatttactgacctcaaataatcccagcactttgggaggctgaggcaggcgggtcatctgacatcaggagtttgagaccagcttggccaacatggtgaaatcctgtctgtactaaaaatgcaaaaattagctgggcgtggtggtgtgtgtctgtaatcccagctactcggcctcccaaagtgctgggattacaggcgtgagccaccgcgtctggcctcagccaaggtttttaagtaacatatttcagcattggctctacagcgttgcagaacatgaacgattggatgcccatcgccaaggagtatgatccactcaaagcgggcagcattgatggcaccgatgaagacccacacgaccgcgcggtctggagggcaatgctggcacgatatgtccccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaggaggagcgtgccgtgatcaaagcttaccgagatgctgatggcctggttattgaccagcatgagatatttgtggactacgagctggaaaggactctcaaagggtggatccctcggcgacttggaggcggtcttgggggaaaaaaggagtctgggcaactgagatttgggggacgggaccggccttttcgaaaacctattaacttgccagttgttaaaaacgacctctatagagagggaaaacgggaaaggcgggagcgatctcgatcccgagaaagacactgggactcgaggacaagggatcgagaccatgacaggggccgggagaagagatggcaagaaagagagccgaccagggtgtggcccgacaatgactgggagagagagagggacttcagagatgacaggatcaaggggagggagaagaaggaaagaggcaagtagaggcccaacagcagaaccccaaagtgaagttacagtggaaatgagtggagggggattgtctttcaacgcagcgtgagtctaatggttgaataaaacttactgatgatcaaaaa

SEQ ID NO: 52878 - DNA, 1638 bp, Homo sapiens
ggcgaatctgctgctaccaatgtaaaggtcaggccgaggccggcgcggagaatctgctgtcgcctgcagctgctcgcctgtctccgtcggaagggagcccaagctttgcagagagacagggagtcgcccaggctggagagcggtggcgcgatctcggctcactgcagcgtcgacatttcgggtcaagcgatcctccagcctcggcctctcaaagtgctggtattacaggcgtgagccagcgcgtgcctggccaaaaattttctaaatttgtataataatttataattgtaatgcatttttatagacaccatatgatctaatcttcacaaaaacctagtgaagtgacatttagctacatttcacaataagaatcctgaagctcaaaatttactgacctcaaataatcccagcactttgggaggctgaggcaggcgggtcatctgacatcaggagtttgagaccagcttggccaacatggtgaaatcctgtctgtactaaaaatgcaaaaattagctgggcgtggtggtgtgtgtctgtaatcccagctactcgggaggctgaggcaggagaatcacttgaacctgggaggcagaggttgcagtgagccgagattggccattgcactccagcctgggtgacagagtgagactttgtctcgagtaaaaaaagagaatgtaaaaatcgaaagagattgttgtaggaaatctcaacctaatgctgccggggaggaagtgcacctagaaagattaatgagaaacaatgaaaccagctaacatgaacgattggatgcccatcgccaaggagtatgatccactcaaagcgggcagcattgatggcaccgatgaagacccacacgaccgcgcggtctggagggcaatgctggcacgatatgtccccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaggaggagcgtgccgtgatcaaagcttaccgagatgctgatggcctggttattgaccagcatgagatatttgtggactacgagctggaaaggactctcaaagggtggatccctcggcgacttggaggcggtcttgggggaaaaaaggagtctgggcaactgagatttgggggacgggaccggccttttcgaaaacctattaacttgccagttgttaaaaacgacctctatagagagggaaaacgggaaaggcgggagcgatctcgatcccgagaaagacactgggactcgaggacaagggatcgagaccatgacaggggccgggagaagagatggcaagaaagagagccgaccagggtgtggcccgacaatgactgggagagagagagggacttcagagatgacaggatcaaggggagggagaagaaggaaagaggcaagtagaggcccaacagcagaaccccaaagtgaagttacagtggaaatgagtggagggggattgtctttcaacgcagcgtgagtctaatggttgaataaaacttactgatgatcaaaaaaaaaaaaaaa

SEQ ID NO: 52879 - DNA, 1556 bp, Homo sapiens
ggcgaatctgctgctaccaatgtaaaggtcaggccgaggccggcgcggagaatctgctgtcgcctgcagctgctcgcctgtctccgtcggaagggagcccaagctttgcagagagacagggagtcgcccaggctggagagcggtggcgcgatctcggctcactgcagcgtcgacatttcgggtcaagcgatcctccagcctcggcctctcaaagtgctggtattacaggcgtgagccagcgcgtgcctggccaaaaattttctaaatttgtataataatttataattgtaatgcatttttatagacaccatatgatctaatcttcacaaaaacctagtgaagtgacatttagctacatttcacaataagaatcctgaagctcaaaatttactgacctcaaataatcccagcactttgggaggctgaggcaggcgggtcatctgacatcaggagaatcacttgaacctgggaggcagaggttgcagtgagccgagattggccattgcactccagcctgggtgacagagtgagactttgtctcgagtaaaaaaagagaatgtaaaaatcgaaagagattgttgtaggaaatctcaacctaatgctgccggggaggaagtgcacctagaaagattaatgagaaacaatgaaaccagctaacatgaacgattggatgcccatcgccaaggagtatgatccactcaaagcgggcagcattgatggcaccgatgaagacccacacgaccgcgcggtctggagggcaatgctggcacgatatgtccccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaggaggagcgtgccgtgatcaaagcttaccgagatgctgatggcctggttattgaccagcatgagatatttgtggactacgagctggaaaggactctcaaagggtggatccctcggcgacttggaggcggtcttgggggaaaaaaggagtctgggcaactgagatttgggggacgggaccggccttttcgaaaacctattaacttgccagttgttaaaaacgacctctatagagagggaaaacgggaaaggcgggagcgatctcgatcccgagaaagacactgggactcgaggacaagggatcgagaccatgacaggggccgggagaagagatggcaagaaagagagccgaccagggtgtggcccgacaatgactgggagagagagagggacttcagagatgacaggatcaaggggagggagaagaaggaaagaggcaagtagaggcccaacagcagaaccccaaagtgaagttacagtggaaatgagtggagggggattgtctttcaacgcagcgtgagtctaatggttgaataaaacttactgatgatcatgggaaaaaaaaaaaaaaaaaaaaaaaaaaaaaaaaaaaaaaaaaaaa

SEQ ID NO: 52880 - protein, 316 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWAKPEDPSLLEDPRIKAIAAKHNKTTAQVLIRFPMQRNLVVIPKSVTPERIAENFKVFDFELSSQDMTTLLSYNRNWRVCALLSCTSHKDYPFHEEF

SEQ ID NO: 52881 - protein, 165 aa, Homo sapiens
MPPYHRRVGMVQELLRMVRQGRREEAGTLLQHLRQDLGMESTSLDDVLYRYASFRNLVDPITHDLIISLARYIHCPKPPQGCPGRKPPRQHSGPVGNPTDLPRPGAGDQLPTALWGAGRQRGAGLHRPHGRHGPAAAASTQHPAPPHHTGTQWQPVDPGRAARPH

SEQ ID NO: 52882 - protein, 495 aa, Homo sapiens
MLLLGLLLLLPLLAGARLLWNWWKLRSLHLPPLAPGFLHLLQPDLPIYLLGLTQKFGPIYRLHLGLQDVVVLNSKRTIEEAMVKKWADFAGRPEPLTYKLVSRNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQSQ

SEQ ID NO: 52883 - protein, 329 aa, Homo sapiens
MLPWRRNKFVLVEDEAKCKAKSLSPGLAYTSLLSSFLRSCPDLLPDWPLERLGRVFRSRRQKVELNKEDPTYTVWYLGNAVTLHAKGDGCTDDAVGKIWARCGPGGGTKMKLTLGPHGIRMQPCERSAAGGSGGRRPAHAYLLPRITYCTADGRHPRVFAWVYRHQARHKAVVLRCHAVLLARAHKARALARLLRQTALAAFSDFKRLQRQSDARHVRQQHLRAGGAAASVPRAPLRRLLNAKCAYRPPPSERSRGAPRLSSIQEEDEEEEEDDAEEQEGGVPQRERPEVLSLARELRTCSLRGAPAPPPPAQPRRWKAGPRERAGQAR

SEQ ID NO: 52884 - protein, 718 aa, Homo sapiens
MSVSGKKEFDVKQILRLRWRWFSHPFQGSTNTGSCLQQEGYEHRGTPVQGRLKSHSRDRNGLKKSNSPVHHNILAPVPGPAPAHQRAVQNLQQHNLIVHFQANEDTPKSVPEKNLFKEACEKRAQDLEMMADDNIEDSTARLDTQHSEDMNATRSEEQFHVINHAEQTLRKMENYLKEKQLCDVLLIAGHLRIPAHRLVLSAVSDYFAAMFTNDVLEAKQEEVRMEGVDPNALNSLVQYAYTGVLQLKEDTIESLLAAACLLQLTQVIDVCSNFLIKQLHPSNCLGIRSFGDAQGCTELLNVAHKYTMEHFIEVIKNQEFLLLPANEISKLLCSDDINVPDEETIFHALMQWVGHDVQNRQGELGMLLSYIRLPLLPPQLLADLETSSMFTGDLECQKLLMEAMKYHLLPERRSMMQSPRTKPRKSTVGALYAVGGMDAMKGTTTIEKYDLRTNSWLHIGTMNGRRLQFGVAVIDNKLYVVGGRDGLKTLNTVECFNPVGKIWTVMPPMSTHRHGLGVATLEGPMYAVGGHDGWSYLNTVERWDPEGRQWNYVASMSTPRSTVGVVALNNKLYAIGGRDGSSCLKSMEYFDPHTNKWSLCAPMSKRRGGVGVATYNGFLYVVGGHDAPASNHCSRLSDCVERYDPKGDSWSTVAPLSVPRDAVAVCPLGDKLYVVGGYDGHTYLNTVESYDAQRNEWKEEVPVNIGRAGACVVVVKLP

SEQ ID NO: 52885 - protein, 373 aa, Homo sapiens
  VARIANT 17,142,162,169,203,258,265,266,268,280,324,340: Xaa = Any Amino Acid
MTGWSCLVTGAGGFLGXRIIRLLVEEKELKEIRALDKAFRPKLREEFSELQNKTKLTVLEGDILDEPFLKRACQDMSVIIHTASIIYVIGVTHRVHHECQCERYPASVGGLCPSYSANLHLHQYPRGSQAQFLQGNHSERSXRRASGKHMVRSIPTQQKACXEGCAGGXWADSEKRWHLVHLCRKTNVYLWGRKPNPFCRYKXGPKQPWNPVKFQQVLQSQPSLCWQHSLGPHSGLEGPAGAQEGPKCPRTVLLYLRXHASPKLXXPXLHLEQRVRPLPXFQLEPAFIPDVLDWLPAGNSELPAEASLHLSTALQPPQSDIVKXRVHLLLQEGSARSGIXVTLQLGGSQAENHGVGWFPCGLAQGDPEVQDSV

SEQ ID NO: 52886 - protein, 373 aa, Homo sapiens; identical to SEQ ID NO: 52885
  VARIANT 17,142,162,169,203,258,265,266,268,280,324,340: Xaa = Any Amino Acid

SEQ ID NO: 52887 - protein, 323 aa, Homo sapiens
MAAARPEAQSRSSPTPESRSQEPLDLVLVPDDCRPGTPPSDLIEIQVVKVTDTTLVPEPPEPGSFHCALCPAAFRLVSELLFHEHGHLAGAEGGGQGGDPSRCHVCGHSCPGPASLRAHYSLHTGERPYRCALCPRAFKALAPLLRHQHRHGVEPGTSRRPPDTAAVAEQRPGVAPERAEVVMAAAAAGAAVGKPFACRFCAKPFRRSSDMRDHERVHTGERPYHCGICGKGFTQSSVLSGHARIHTGERPFRCTLCDRTFNNSSNFRKHQRTHFHGPGPGLGDSGGQLGSSAAEGSGSGCGVGDPAEEGRGETAKVKVEADQ

SEQ ID NO: 52888 - protein, 144 aa, Homo sapiens
MEEDNWRWHFYDTVKGSDWLGDQDAIHYVTEQAPTAMVAVENYGMPFSRTEDGKIYQRAFGGHSLKFGKGGQAHGCCCVADRTGHSILHTLYGRSLRYDTSCFVEYFALDLLMENGECRGVFALCIQDGSIHRIRAKNTIVATG

SEQ ID NO: 52889 - protein, 357 aa, Homo sapiens
MQSVQSTSFCLRKQCLCLTFLLLHLLGQVAATQRCPPQCPGRCPATPPTCAPGVRAVLDGCSCCLVCARQRGESCSDLEPCDESSGLYCDRSADPSNQTGICTAVEGDNCVFDGVIYRSGEKFQPSCKFQCTCRDGQIGCVPRCQLDVLLPEPNCPAPRKVEVPGECCEKWICGPDEEDSLGGLTLAAYRPEATLGVEVSDSSVNCIEQTTEWTACSKSCGMGFSTRVTNRNRQCEMLKQTRLCMVRPCEQEPEQPTDKKGKKCLRTKKSLKAIHLQFKNCTSLHTYKPRFCGVCSDGRCCTPHNTKTIQAEFQCSPGQIVKKPVMVIGTCTCHTNCPKNNEAFLQELELKTTRGKM

SEQ ID NO: 52890 - protein, 406 aa, Homo sapiens
MQLFLLLCLVLLSPQGASLHRHHPREMKKRVEDLHVGATVAPSSRRDFTFDLYRALASAAPSQNIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVFTSHADLSGISNHSNIQVSEMVHKAVVEVDESGTRAAAATGTIFTFRSARLNSQRLVFNRPFLMFIVDNNILFLGKVNRP

SEQ ID NO: 52891 - protein, 509 aa, Homo sapiens
MELKKSPDGGWGWVIVFVSFLTQFLCYGSPLAVGVLYIEWLDAFGEGKGKTAWVGSLASGVGLLASPVCSLCVSSFGARPVTIFSGFMVAGGLMLSSFAPNIYFLFFSYGIVVGLGCGLLYTATVTITCQYFDDRRGLALGLISTGSSVGLFIYAALQRMLVEFYGLDGCLLIVGALALNILACGSLMRPLQSSDCPLPKKIAPEDLPDKYSIYNEKGKNLEENINILDKSYSSEEKCRITLANGDWKQDSLLHKNPTVTHTKEPETYKKKVAEQTYFCKQLAKRKWQLYKNYCGETVALFKNKVFSALFIAILLFDIGGFPPSLLMEDVARSSNVKEEEFIMPLISIIGIMTAVGKLLLGILADFKWINTLYLYVATLIIMGLALCAIPFAKSYVTLALLSGILGFLTGNWSIFPYVTTKTVGIEKLAHAYGILMFFAGLGNSLGPPIVGWFYDWTQTYDIAFYFSGFCVLLGGFILLLAALPSWDTCNKQLPKPAPTTFLYKVASNV

SEQ ID NO: 52892 - protein, 246 aa, Homo sapiens
MNDWMPIAKEYDPLKAGSIDGTDEDPHDRAVWRAMLARYVPNKGVIGDPLLTLFVARLNLQTKEDKLKEVFSRYGDIRRLRLVRDLVTGFSKGYAFIEYKEERAVIKAYRDADGLVIDQHEIFVDYELERTLKGWIPRRLGGGLGGKKESGQLRFGGRDRPFRKPINLPVVKNDLYREGKRERRERSRSRERHWDSRTRDRDHDRGREKRWQEREPTRVWPDNDWERERDFRDDRIKGREKKERGK

SEQ ID NO: 52893 - protein, 251 aa, Homo sapiens
MKPANMNDWMPIAKEYDPLKAGSIDGTDEDPHDRAVWRAMLARYVPNKGVIGDPLLTLFVARLNLQTKEDKLKEVFSRYGDIRRLRLVRDLVTGFSKGYAFIEYKEERAVIKAYRDADGLVIDQHEIFVDYELERTLKGWIPRRLGGGLGGKKESGQLRFGGRDRPFRKPINLPVVKNDLYREGKRERRERSRSRERHWDSRTRDRDHDRGREKRWQEREPTRVWPDNDWERERDFRDDRIKGREKKERGK

SEQ ID NO: 52894 - protein, 251 aa, Homo sapiens; identical to SEQ ID NO: 52893

SEQ ID NO: 52895 - DNA, 20 bp, Homo sapiens
gatcaccaccaagttcctct

SEQ ID NO: 52896 - DNA, 20 bp, Homo sapiens
gatcatctccacctggagat

SEQ ID NO: 52897 - DNA, 20 bp, Homo sapiens
gatccaacatcaagctagac

SEQ ID NO: 52898 - DNA, 20 bp, Homo sapiens
gatcctccaggagagaaggg

SEQ ID NO: 52899 - DNA, 20 bp, Homo sapiens
gatctcaagagccctgtcag

SEQ ID NO: 52900 - DNA, 20 bp, Homo sapiens
gatcttaaacaaacctggct

SEQ ID NO: 52901 - DNA, 20 bp, Homo sapiens
gatctgcatgttttttaacc

SEQ ID NO: 52902 - DNA, 20 bp, Homo sapiens
gatcttttgcatagcacctt

SEQ ID NO: 52903 - DNA, 20 bp, Homo sapiens
gatctcttctaaataacagg

SEQ ID NO: 52904 - DNA, 20 bp, Homo sapiens
gatctgaccccaaaagcttc

SEQ ID NO: 52905 - DNA, 20 bp, Homo sapiens
gatcactgctgggttgcttc

SEQ ID NO: 52906 - DNA, 20 bp, Homo sapiens
gatcagagaggatggcctgc

SEQ ID NO: 52907 - DNA, 20 bp, Homo sapiens
gatcccctctcctggtgaca

SEQ ID NO: 52908 - DNA, 20 bp, Homo sapiens
gatccgccgtcccagacact

SEQ ID NO: 52909 - DNA, 20 bp, Homo sapiens
gatcgctgagctagagatga

SEQ ID NO: 52910 - DNA, 20 bp, Homo sapiens
gatcaaggtgtcagcaggtt

SEQ ID NO: 52911 - DNA, 20 bp, Homo sapiens
gatcagagcatttgttcccc

SEQ ID NO: 52912 - DNA, 20 bp, Homo sapiens
gatccaggacgccctgcagg

SEQ ID NO: 52913 - DNA, 20 bp, Homo sapiens
gatcccagcatctcagagtc

SEQ ID NO: 52914 - DNA, 20 bp, Homo sapiens
gatcccgcttaatgactctg

SEQ ID NO: 52915 - DNA, 20 bp, Homo sapiens
gatcgtgtcagcctcatgcc

SEQ ID NO: 52916 - DNA, 20 bp, Homo sapiens
gatctgcagcagcctcagcc

SEQ ID NO: 52917 - DNA, 20 bp, Homo sapiens
gatctggagggagcagggtt

SEQ ID NO: 52918 - DNA, 20 bp, Homo sapiens
gatcttagccttctaagcct

SEQ ID NO: 52919 - DNA, 20 bp, Homo sapiens
gatcttccccagctgtgccc

SEQ ID NO: 52920 - DNA, 20 bp, Homo sapiens
gatcttgctgaccttgtccc

SEQ ID NO: 52921 - DNA, 20 bp, Homo sapiens
gatctttgccctgatgaaaa

SEQ ID NO: 52922 - DNA, 20 bp, Homo sapiens
gatcctaaaataaaccttgg

SEQ ID NO: 52923 - DNA, 20 bp, Homo sapiens
gatcaaggagatgacattgg

SEQ ID NO: 52924 - DNA, 20 bp, Homo sapiens
gatcaaggtgcgccaggcct

SEQ ID NO: 52925 - DNA, 20 bp, Homo sapiens
gatcagaaagaccaccttgg

SEQ ID NO: 52926 - DNA, 20 bp, Homo sapiens
gatcatttcgtattttaaca

SEQ ID NO: 52927 - DNA, 20 bp, Homo sapiens
gatcatttgtcaggaaatca

SEQ ID NO: 52928 - DNA, 20 bp, Homo sapiens
gatccggctggtgccactcc

SEQ ID NO: 52929 - DNA, 20 bp, Homo sapiens
gatcgactctttcaaagtga

SEQ ID NO: 52930 - DNA, 20 bp, Homo sapiens
gatcgccatccttgaacagg

SEQ ID NO: 52931 - DNA, 20 bp, Homo sapiens
gatctcacctatacaggagc

SEQ ID NO: 52932 - DNA, 20 bp, Homo sapiens
gatctgctgaataaaatact

SEQ ID NO: 52933 - DNA, 20 bp, Homo sapiens
gatctgcttcaatacctcct

SEQ ID NO: 52934 - DNA, 20 bp, Homo sapiens
gatctgggccagcattgcca

SEQ ID NO: 52935 - DNA, 20 bp, Homo sapiens
gatcttcactttgaaagagt

SEQ ID NO: 52936 - DNA, 20 bp, Homo sapiens
gatcacatcgtggagatgca

SEQ ID NO: 52937 - DNA, 20 bp, Homo sapiens
gatcaggccagaactcatgt

SEQ ID NO: 52938 - DNA, 20 bp, Homo sapiens
gatcgctggcagagaaggct

SEQ ID NO: 52939 - DNA, 20 bp, Homo sapiens
gatcgcttcctggagccagg

SEQ ID NO: 52940 - DNA, 20 bp, Homo sapiens
gatcggtggcactgagacca

SEQ ID NO: 52941 - DNA, 20 bp, Homo sapiens
gatcttgtctccgaaggtga

SEQ ID NO: 52942 - DNA, 20 bp, Homo sapiens
gatctgcaaggccgccaggc

SEQ ID NO: 52943 - DNA, 20 bp, Homo sapiens
gatcgacatgaccaccttca

SEQ ID NO: 52944 - DNA, 20 bp, Homo sapiens
gatcgtggccaacagctgca

SEQ ID NO: 52945 - DNA, 20 bp, Homo sapiens
gatctaagcagcgttcccac

SEQ ID NO: 52946 - DNA, 20 bp, Homo sapiens
gatctcctcgtcgccggcct

SEQ ID NO: 52947 - DNA, 20 bp, Homo sapiens
gatcttctcggggaagatga

SEQ ID NO: 52948 - DNA, 20 bp, Homo sapiens
gatctttgggctttttgtgg

SEQ ID NO: 52949 - DNA, 20 bp, Homo sapiens
gatccaccagcttctccctg

SEQ ID NO: 52950 - DNA, 20 bp, Homo sapiens
gatcggcccacacctccacc

SEQ ID NO: 52951 - DNA, 20 bp, Homo sapiens
gatctaaccccttacccatc

SEQ ID NO: 52952 - DNA, 20 bp, Homo sapiens
gatcccattgttgttcaggg

SEQ ID NO: 52953 - DNA, 20 bp, Homo sapiens
gatcctgtcaagtgttggaa

SEQ ID NO: 52954 - DNA, 20 bp, Homo sapiens
gatcagggccttggacaagg

SEQ ID NO: 52955 - DNA, 20 bp, Homo sapiens
gatcgtccgcctgttggtgg

SEQ ID NO: 52956 - DNA, 20 bp, Homo sapiens
gatctcgctgagccttcttg

SEQ ID NO: 52957 - DNA, 20 bp, Homo sapiens
gatctgattctagcgtgacc

SEQ ID NO: 52958 - DNA, 20 bp, Homo sapiens
gatctgctctccagcatctt

SEQ ID NO: 52959 - DNA, 20 bp, Homo sapiens
gatctggcgtataagccact

SEQ ID NO: 52960 - DNA, 20 bp, Homo sapiens
gatctgctgtacattgtata

SEQ ID NO: 52961 - DNA, 20 bp, Homo sapiens
gatctaaaaatgtgcttagt

SEQ ID NO: 52962 - DNA, 20 bp, Homo sapiens
gatcttttttcaaatggctt

SEQ ID NO: 52963 - DNA, 20 bp, Homo sapiens
gatctccatatttcaaagga

SEQ ID NO: 52964 - DNA, 20 bp, Homo sapiens
gatcccatcacctcaaagcc

SEQ ID NO: 52965 - DNA, 20 bp, Homo sapiens
gatctaaaactgtcacaact

SEQ ID NO: 52966 - DNA, 20 bp, Homo sapiens
gatcgtggagctcaggagga

SEQ ID NO: 52967 - DNA, 20 bp, Homo sapiens
gatctatggactcattcatg

SEQ ID NO: 52968 - DNA, 20 bp, Homo sapiens
gatctgggagtcagtcaagg

SEQ ID NO: 52969 - DNA, 20 bp, Homo sapiens
gatcccaccagctagtgttt

SEQ ID NO: 52970 - DNA, 20 bp, Homo sapiens
gatcgcagcgcggaccccag

SEQ ID NO: 52971 - DNA, 20 bp, Homo sapiens
gatctgagcagctctcgcca

SEQ ID NO: 52972 - DNA, 20 bp, Homo sapiens
gatcagaatatgacattgca

SEQ ID NO: 52973 - DNA, 20 bp, Homo sapiens
gatctcagacagtagaagag

SEQ ID NO: 52974 - DNA, 20 bp, Homo sapiens
gatctccaaccgcagaagtg

SEQ ID NO: 52975 - DNA, 20 bp, Homo sapiens
gatctgtccggcatcagcaa

SEQ ID NO: 52976 - DNA, 20 bp, Homo sapiens
gatctatagggaattctgat

SEQ ID NO: 52977 - DNA, 20 bp, Homo sapiens
gatctttttgaaaatatagg

SEQ ID NO: 52978 - DNA, 20 bp, Homo sapiens
gatcctggtaacagagtcta

SEQ ID NO: 52979 - DNA, 20 bp, Homo sapiens
gatcggaaaagatacattca

SEQ ID NO: 52980 - DNA, 20 bp, Homo sapiens
gatctccatctggtgacagt

SEQ ID NO: 52981 - DNA, 20 bp, Homo sapiens
gatctccttgacattggggt

SEQ ID NO: 52982 - DNA, 20 bp, Homo sapiens
gatcttagacttgcaggctt

SEQ ID NO: 52983 - DNA, 20 bp, Homo sapiens
gatctttcataaaaatttaa

SEQ ID NO: 52984 - DNA, 20 bp, Homo sapiens
gatcgcgccaccgctctcca

SEQ ID NO: 52985 - DNA, 20 bp, Homo sapiens
gatcaatgaagttccctggg

SEQ ID NO: 52986 - DNA, 1848 bp, Homo sapiens
aggaaaccaaggcaagctccccctgtcaaagcaccttggcccataagaagaaaagggggagccccagatgtgatgagcgcttccaggcttcaggctcagaaggcgcccccagctctcctgtaactcagaggccagtgtgatgggagttcctccactcagcacacttcccctgtaaacacgcctgtggtgggcaaaagggctttggaacggttgcttgtcttttctctcctgcgtaatttccactttcattcatgataatgtcgaacacgcacaaagctcggctggaacgccgggtcactggctcaaccaaccggtggcgtttgcccaaacagcctttctctggggacctgctctcactttcccagatgtgcaaggctctgagcatagactttgaggaagctttgaggaacccagacaggttatgcatttcacaaatccagaagtttttctttgagaatttcaagaacaaggacatccaaagtggggaagcagatgtgattctcgagtgcctgggcttcaaatgggagctccatcagccccagctttttcagtctgagaccttggccaagctctacctgaaagccctggcgcagggcaccacacaccccctgagggagctggaggagcttctgcgagctcaatcacctaagaagaccaaagaaaaatcccctgcaaagaggatcatcatttccttgaagatcaatgacccactggtcactaaagtcgccttcgccacggccctgaagaacctctacatgagtgaggtggagattaacttggaagacctactgggagtgctggcttccgcccacatcctccagttcagtggcctgtttcaaaggtgcgtggatgtgatgatagccagactcaagccaagcaccatcaagaaattctacgaggccggctgcaagtacaaggaagagcagctcaccaccggctgcgagaagtggctggaaatgaacttggttcctctaggggggacgcagatccacctccacaaaatcccacaggacctgctccacaaagtgctgaagtcccccaggttatttacctttagtgaattccatcttctgaaaacaatgcttttgtgggtcttcttgcaactgaactacaagattcaggcaattccgacttatgaaaccgtgatgacattttttaagagctttcctgagaactgttgctttctggaccgggacataggacggagcttgaggccgctcttcctctgcttgcgtctgcacggcatcaccaaaggcaaggatctggaggtgctgcggcaccttaacttcttcccagagtcatggctcgaccaggttacagtcaaccattaccacgcactggagaatgggggcgacatggtccacctgaaagatcttaacacccaggctgtgagatttgggctgctctttaaccaggagaatacaacttattcgaaaacgattgctctatatggattcttctttaagataaagggactcaaacatgatactacctcttatagtttttacatgcagagaataaagcacacagacctggaatctccctctgcggtctacgagcacaaccacgtcagcctgcgagcggcacgcctggtgaagtatgagatcagagcagaggccctggttgacggcaagtggcaggagttcaggacaaaccagatcaagcagaagtttgggttgaccacgtcatcctgcaaaagccataccttgaaaatccaaactgtgggcatcccaatctatgtaagttttgcattcatcttcccagcatcttgacagtttccagaagaatctatgggattttccccccactggtctgcataaaagaaaataaaatgacataaaagggagc

SEQ ID NO: 52987 - DNA, 8079 bp, Homo sapiens
cgaggccgccgccgtcgcctccgccgggcgagccggagccggagtcgagccgcggccgggagccgggcgggctggggacgcgggccgggggcggaggcgctgggggccggggccggggccgggggcggaggcgctgggggccggggccggggccgggcgccgagcggggtccgcggtgaccgcgccgcccgggcgatgcccgcggggacgccgccggccagcagagcgaggtgctgccggccgccaccatgaccgagggcgcacgggccgccgacgaggtccgggtgcccctgggcgcgccgccccctggccctgcggcgttggtgggggcgtccccggagagccccggggcgccgggacgcgaggcggagcgggggtccgagctcggcgtgtcaccctccgagagcccggcggccgagcgcggcgcggagctgggtgccgacgaggagcagcgcgtcccgtacccggccttggcggccacggtcttcttctgcctcggtcagaccacgcggccgcgcagctggtgcctccggctggtctgcaacccatggttcgagcacgtgagcatgctggtaatcatgctcaactgcgtgaccctgggcatgttccggccctgtgaggacgttgagtgcggctccgagcgctgcaacatcctggaggcctttgacgccttcattttcgccttttttgcggtggagatggtcatcaagatggtggccttggggctgttcgggcagaagtgttacctgggtgacacgtggaacaggctggatttcttcatcgtcgtggcgggcatgatggagtactcgttggacggacacaacgtgagcctctcggctatcaggaccgtgcgggtgctgcggcccctccgcgccatcaaccgcgtgcctagcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggaacaacaacctgaccttcctgcggccgtactaccagacggaggagggcgaggagaacccgttcatctgctcctcacgccgagacaacggcatgcagaagtgctcgcacatccccggccgccgcgagctgcgcatgccctgcaccctgggctgggaggcctacacgcagccgcaggccgagggggtgggcgctgcacgcaacgcctgcatcaactggaaccagtactacaacgtgtgccgctcgggtgactccaacccccacaacggtgccatcaacttcgacaacatcggctacgcctggattgccatcttccaggtgatcacgctggaaggctgggtggacatcatgtactacgtcatggacgcccactcattctacaacttcatctatttcatcctgctcatcatcgtgggctccttcttcatgatcaacctgtgcctggtggtgattgccacgcagttctcggagacgaagcagcgggagagtcagctgatgcgggagcagcgggcacgccacctgtccaacgacagcacgctggccagcttctccgagcctggcagctgctacgaagagctgctgaagtacgtgggccacatattccgcaaggtcaagcggcgcagcttgcgcctctacgcccgctggcagagccgctggcgcaagaaggtggaccccagtgctgtgcaaggccagggtcccgggcaccgccagcgccgggcaggcaggcacacagcctcggtgcaccacctggtctaccaccaccatcaccaccaccaccaccactaccatttcagccatggcagcccccgcaggcccggccccgagccaggcgcctgcgacaccaggctggtccgagctggcgcgcccccctcgccaccttccccaggccgcggaccccccgacgcagagtctgtgcacagcatctaccatgccgactgccacatagaggggccgcaggagagggcccgggtggcacatgccgcagccactgccgctgccagcctcagactggccacagggctgggcaccatgaactaccccacgatcctgccctcaggggtgggcagcggcaaaggcagcaccagccccggacccaaggggaagtgggccggtggaccgccaggcaccggggggcacggcccgttgagcttgaacagccctgatccctacgagaagatcccgcatgtggtcggggagcatggactgggccaggcccctggccatctgtcgggcctcagtgtgccctgccccctgcccagccccccagcgggcacactgacctgtgagctgaagagctgcccgtactgcacccgtgccctggaggacccggagggtgagctcagcggctcggaaagtggagactcagatggccgtggcgtctatgaattcacgcaggacgtccggcacggtgaccgctgggaccccacgcgaccaccccgtgcgacggacacaccaggcccaggcccaggcagcccccagcggcgggcacagcagagggcagccccgggcgagccaggctggatgggccgcctctgggttaccttcagcggcaagctgcgccgcatcgtggacagcaagtacttcagccgtggcatcatgatggccatccttgtcaacacgctgagcatgggcgtggagtaccatgagcagcccgaggagctgactaatgctctggagatcagcaacatcgtgttcaccagcatgtttgccctggagatgctgctgaagctgctggcctgcggccctctgggctacatccggaacccgtacaacatcttcgacggcatcatcgtggtcatcagcgtctgggagatcgtggggcaggcggacggtggcttgtctgtgctgcgcaccttccggctgctgcgtgtgctgaagctggtgcgctttctgccagccctgcggcgccagctcgtggtgctggtgaagaccatggacaacgtggctaccttctgcacgctgctcatgctcttcattttcatcttcagcatcctgggcatgcaccttttcggctgcaagttcagcctgaagacagacaccggagacaccgtgcctgacaggaagaacttcgactccctgctgtgggccatcgtcaccgtgttccagatcctgacccaggaggactggaacgtggtcctgtacaacggcatggcctccacctcctcctgggccgccctctacttcgtggccctcatgaccttcggcaactatgtgctcttcaacctgctggtggccatcctcgtggagggcttccaggcggagggcgatgccaacagatccgacacggacgaggacaagacgtcggtccacttcgaggaggacttccacaagctcagagaactccagaccacagagctgaagatgtgttccctggccgtgacccccaacgggcacctggagggacgaggcagcctgtcccctcccctcatcatgtgcacagctgccacgcccatgcctacccccaagagctcaccattcctggatgcagcccccagcctcccagactctcggcgtggcagcagcagctccggggacccgccactgggagaccagaagcctccggccagcctccgaagttctccctgtgccccctggggccccagtggcgcctggagcagccggcgctccagctggagcagcctgggccgtgcccccagcctcaagcgccgcggccagtgtggggaacgtgagtccctgctgtctggcgagggcaagggcagcaccgacgacgaagctgaggacggcagggccgcgcccgggccccgtgccaccccactgcggcgggccgagtccctggacccacggcccctgcggccggccgccctcccgcctaccaagtgccgcgatcgcgacgggcaggtggtggccctgcccagcgacttcttcctgcgcatcgacagccaccgtgaggatgcagccgagcttgacgacgactcggaggacagctgctgcctccgcctgcataaagtgctggagccctacaagccccagtggtgccggagccgcgaggcctgggccctctacctcttctccccacagaaccggttccgcgtctcctgccagaaggtcatcacacacaagatgtttgatcacgtggtcctcgtcttcatcttcctcaactgcgtcaccatcgccctggagaggcctgacattgatcccggcagcaccgagcgggtcttcctcagcgtctccaattacatcttcacggccatcttcgtggcggagatgatggtgaaggtggtggccctggggctgctgtccggcgagcacgcctacctgcagagcagctggaacctgctggatgggctgctggtgctggtgtccctggtggacattgtcgtggccatggcctcggctggtggcgccaagatcctgggtgttctgcgcgtgctgcgtctgctgcggaccctgcggcctctgagggtcatcagccgggccccgggcctcaagctggtggtggagacgctgatatcatcactcaggcccattgggaacatcgtcctcatctgctgcgccttcttcatcatttttggcattttgggtgtgcagctcttcaaagggaagttctactactgcgagggccccgacaccaggaacatctccaccaaggcacagtgccgggccgcccactaccgctgggtgcgacgcaagtacaacttcgacaacctgggccaggccctgatgtcgctgttcgtgctgtcatccaaggatggatgggtgaacatcatgtacgacgggctggatgccgtgggtgtcgaccagcagcctgtgcagaaccacaacccctggatgctgctgtacttcatctccttcctgctcatcgtcagcttcttcgtgctcaacatgttcgtgggcgtcgtggtcgagaacttccacaagtgccggcagcaccaggaggcggaggaggcgcggcggcgagaggagaagcggctgcggcgcctagagaggaggcgcaggaaggcccagcgccggccctactatgccgactactcgcccacgcgccgctccattcactcgctgtgcaccagccactatctcgacctcttcatcaccttcatcatctgtgtcaacgtcatcaccatgtccatggagcactataaccaacccaagtcgctggacgaggccctcaagtactgcaactacgtcttcaccatcgtgtttgtcttcgaggctgcactgaagctggtagcatttgggttccgtcggttcttcaaggacaggtggaaccagctggacctggccatcgtgctgctgtcactcatgggcatcacgctggaggagatagagatgagcgccgcgctgcccatcaaccccaccatcatccgcatcatgcgcgtgcttcgcattgcccgtgtgctgaagctgctgaagatggctacgggcatgcgcgccctgctggacactgtggtgcaagctctcccccaggtggggaacctgggccttcttttcatgctcctgttttttatctatgctgcgctgggagtggagctgttcgggaggctggagtgcagtgaagacaacccctgcgagggcctgagcaggcacgccaccttcagcaacttcggcatggccttcctcacgctgttccgcgtgtccacgggggacaactggaacgggatcatgaaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgctctcgctgcccaacgacagctacatgttcaggcccgtggtgcctgcctcggcgccccacccccgcccgctgcaggaggtggagatggagacctatggggccggcacccccttgggctccgttgcctctgtgcactctccgcccgcagagtcctgtgcctccctccagatcccattggctgtgtcgtccccagccaggagcggcgagcccctccacgccctgtcccctcggggcacagcccgctcccccagtctcagccggctgctctgcagacaggaggctgtgcacaccgattccttggaagggaagattgacagccctagggacaccctggatcctgcagagcctggtgagaaaaccccggtgaggccggtgacccaggggggctccctgcagtccccaccacgctccccacggcccgccagcgtccgcactcgtaagcataccttcggacagcgctgcgtctccagccggccggcggccccaggcggagaggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggatgctcagggcttcctggacaagccgggccgggcagacgagcagtggcggccctcggcggagctgggcagcggggagcctggggaggcgaaggcctggggccctgaggccgagcccgctctgggtgcgcgcagaaagaagaagatgagccccccctgcatctcggtggaaccccctgcggaggacgagggctctgcgcggccctccgcggcagagggcggcagcaccacactgaggcgcaggaccccgtcctgtgaggccacgcctcacagggactccctggagcccacagagggctcaggcgccgggggggaccctgcagccaagggggagcgctggggccaggcctcctgccgggctgagcacctgaccgtccccagctttgcctttgagccgctggacctcggggtccccagtggagaccctttcttggacggtagccacagtgtgaccccagaatccagagcttcctcttcaggggccatagtgcccctggaacccccagaatcagagcctcccatgcccgtcggtgaccccccagagaagaggcgggggctgtacctcacagtcccccagtgtcctctggagaaaccagggtccccctcagccacccctgccccagggggtggtgcagatgaccccgtgtagctcggggcttggtgccgcccacggctttggccctggggtctgggggccccgctggggtggaggcccaggcagaaccctgcatggaccctgacttgggtcccgtcgtgagcagaaaggcccggggaggatgacggcccaggccctggttctctgcccagcgaagcaggagtagctgccgggccccacgagcctccgtccgttctggttcgggtttctccgagttttgctaccagccgaggctgtgcgggcaactgggtcagcctcccgtcaggagagaagccgcgtctgtgggacgaagaccgggcacccgccagagaggggaaggtaccaggttgcgtcctttcaggccccgcgttgttacaggacactcgctgggggccctgtgcccttgccggcggcaggttgcagccaccgcggcccaatgtcaccttcactcacagtctgagttcttgtccgcctgtcacgccctcaccaccctccccttccagccaccaccctttccgttccgctcgggccttcccagaagcgtcctgtgactctgggagaggtgacacctcactaaggggccgaccccatggagtaacgcgcccggccccgatgcgaatcaggcctcccctacatctgggggcgttggccgcgagattcccattgacacctttgtttcgtgtgcttttaaattcaggttaaatgttgcaataatctgatgcagaagactcagcttctcaagggagagggagggggcggagcggaataaatagtaacttatttaagaaatgcaaaaaaaaaa

SEQ ID NO: 52988 - DNA, 8097 bp, Homo sapiens
cgaggccgccgccgtcgcctccgccgggcgagccggagccggagtcgagccgcggccgggagccgggcgggctggggacgcgggccgggggcggaggcgctgggggccggggccggggccgggggcggaggcgctgggggccggggccggggccgggcgccgagcggggtccgcggtgaccgcgccgcccgggcgatgcccgcggggacgccgccggccagcagagcgaggtgctgccggccgccaccatgaccgagggcgcacgggccgccgacgaggtccgggtgcccctgggcgcgccgccccctggccctgcggcgttggtgggggcgtccccggagagccccggggcgccgggacgcgaggcggagcgggggtccgagctcggcgtgtcaccctccgagagcccggcggccgagcgcggcgcggagctgggtgccgacgaggagcagcgcgtcccgtacccggccttggcggccacggtcttcttctgcctcggtcagaccacgcggccgcgcagctggtgcctccggctggtctgcaacccatggttcgagcacgtgagcatgctggtaatcatgctcaactgcgtgaccctgggcatgttccggccctgtgaggacgttgagtgcggctccgagcgctgcaacatcctggaggcctttgacgccttcattttcgccttttttgcggtggagatggtcatcaagatggtggccttggggctgttcgggcagaagtgttacctgggtgacacgtggaacaggctggatttcttcatcgtcgtggcgggcatgatggagtactcgttggacggacacaacgtgagcctctcggctatcaggaccgtgcgggtgctgcggcccctccgcgccatcaaccgcgtgcctagcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggaacaacaacctgaccttcctgcggccgtactaccagacggaggagggcgaggagaacccgttcatctgctcctcacgccgagacaacggcatgcagaagtgctcgcacatccccggccgccgcgagctgcgcatgccctgcaccctgggctgggaggcctacacgcagccgcaggccgagggggtgggcgctgcacgcaacgcctgcatcaactggaaccagtactacaacgtgtgccgctcgggtgactccaacccccacaacggtgccatcaacttcgacaacatcggctacgcctggattgccatcttccaggtgatcacgctggaaggctgggtggacatcatgtactacgtcatggacgcccactcattctacaacttcatctatttcatcctgctcatcatcgtgggctccttcttcatgatcaacctgtgcctggtggtgattgccacgcagttctcggagacgaagcagcgggagagtcagctgatgcgggagcagcgggcacgccacctgtccaacgacagcacgctggccagcttctccgagcctggcagctgctacgaagagctgctgaagtacgtgggccacatattccgcaaggtcaagcggcgcagcttgcgcctctacgcccgctggcagagccgctggcgcaagaaggtggaccccagtgctgtgcaaggccagggtcccgggcaccgccagcgccgggcaggcaggcacacagcctcggtgcaccacctggtctaccaccaccatcaccaccaccaccaccactaccatttcagccatggcagcccccgcaggcccggccccgagccaggcgcctgcgacaccaggctggtccgagctggcgcgcccccctcgccaccttccccaggccgcggaccccccgacgcagagtctgtgcacagcatctaccatgccgactgccacatagaggggccgcaggagagggcccgggtggcacatgccgcagccactgccgctgccagcctcagactggccacagggctgggcaccatgaactaccccacgatcctgccctcaggggtgggcagcggcaaaggcagcaccagccccggacccaaggggaagtgggccggtggaccgccaggcaccggggggcacggcccgttgagcttgaacagccctgatccctacgagaagatcccgcatgtggtcggggagcatggactgggccaggcccctggccatctgtcgggcctcagtgtgccctgccccctgcccagccccccagcgggcacactgacctgtgagctgaagagctgcccgtactgcacccgtgccctggaggacccggagggtgagctcagcggctcggaaagtggagactcagatggccgtggcgtctatgaattcacgcaggacgtccggcacggtgaccgctgggaccccacgcgaccaccccgtgcgacggacacaccaggcccaggcccaggcagcccccagcggcgggcacagcagagggcagccccgggcgagccaggctggatgggccgcctctgggttaccttcagcggcaagctgcgccgcatcgtggacagcaagtacttcagccgtggcatcatgatggccatccttgtcaacacgctgagcatgggcgtggagtaccatgagcagcccgaggagctgactaatgctctggagatcagcaacatcgtgttcaccagcatgtttgccctggagatgctgctgaagctgctggcctgcggccctctgggctacatccggaacccgtacaacatcttcgacggcatcatcgtggtcatcagcgtctgggagatcgtggggcaggcggacggtggcttgtctgtgctgcgcaccttccggctgctgcgtgtgctgaagctggtgcgctttctgccagccctgcggcgccagctcgtggtgctggtgaagaccatggacaacgtggctaccttctgcacgctgctcatgctcttcattttcatcttcagcatcctgggcatgcaccttttcggctgcaagttcagcctgaagacagacaccggagacaccgtgcctgacaggaagaacttcgactccctgctgtgggccatcgtcaccgtgttccagatcctgacccaggaggactggaacgtggtcctgtacaacggcatggcctccacctcctcctgggccgccctctacttcgtggccctcatgaccttcggcaactatgtgctcttcaacctgctggtggccatcctcgtggagggcttccaggcggagggcgatgccaacagatccgacacggacgaggacaagacgtcggtccacttcgaggaggacttccacaagctcagagaactccagaccacagagctgaagatgtgttccctggccgtgacccccaacgggcacctggagggacgaggcagcctgtcccctcccctcatcatgtgcacagctgccacgcccatgcctacccccaagagctcaccattcctggatgcagcccccagcctcccagactctcggcgtggcagcagcagctccggggacccgccactgggagaccagaagcctccggccagcctccgaagttctccctgtgccccctggggccccagtggcgcctggagcagccggcgctccagctggagcagcctgggccgtgcccccagcctcaagcgccgcggccagtgtggggaacgtgagtccctgctgtctggcgagggcaagggcagcaccgacgacgaagctgaggacggcagggccgcgcccgggccccgtgccaccccactgcggcgggccgagtccctggacccacggcccctgcggccggccgccctcccgcctaccaagtgccgcgatcgcgacgggcaggtggtggccctgcccagcgacttcttcctgcgcatcgacagccaccgtgaggatgcagccgagcttgacgacgactcggaggacagctgctgcctccgcctgcataaagtgctggagccctacaagccccagtggtgccggagccgcgaggcctgggccctctacctcttctccccacagaaccggttccgcgtctcctgccagaaggtcatcacacacaagatgtttgatcacgtggtcctcgtcttcatcttcctcaactgcgtcaccatcgccctggagaggcctgacattgatcccggcagcaccgagcgggtcttcctcagcgtctccaattacatcttcacggccatcttcgtggcggagatgatggtgaaggtggtggccctggggctgctgtccggcgagcacgcctacctgcagagcagctggaacctgctggatgggctgctggtgctggtgtccctggtggacattgtcgtggccatggcctcggctggtggcgccaagatcctgggtgttctgcgcgtgctgcgtctgctgcggaccctgcggcctctgagggtcatcagccgggccccgggcctcaagctggtggtggagacgctgatatcatcactcaggcccattgggaacatcgtcctcatctgctgcgccttcttcatcatttttggcattttgggtgtgcagctcttcaaagggaagttctactactgcgagggccccgacaccaggaacatctccaccaaggcacagtgccgggccgcccactaccgctgggtgcgacgcaagtacaacttcgacaacctgggccaggccctgatgtcgctgttcgtgctgtcatccaaggatggatgggtgaacatcatgtacgacgggctggatgccgtgggtgtcgaccagcagcctgtgcagaaccacaacccctggatgctgctgtacttcatctccttcctgctcatcgtcagcttcttcgtgctcaacatgttcgtgggcgtcgtggtcgagaacttccacaagtgccggcagcaccaggaggcggaggaggcgcggcggcgagaggagaagcggctgcggcgcctagagaggaggcgcaggagcactttccccagcccagaggcccagcgccggccctactatgccgactactcgcccacgcgccgctccattcactcgctgtgcaccagccactatctcgacctcttcatcaccttcatcatctgtgtcaacgtcatcaccatgtccatggagcactataaccaacccaagtcgctggacgaggccctcaagtactgcaactacgtcttcaccatcgtgtttgtcttcgaggctgcactgaagctggtagcatttgggttccgtcggttcttcaaggacaggtggaaccagctggacctggccatcgtgctgctgtcactcatgggcatcacgctggaggagatagagatgagcgccgcgctgcccatcaaccccaccatcatccgcatcatgcgcgtgcttcgcattgcccgtgtgctgaagctgctgaagatggctacgggcatgcgcgccctgctggacactgtggtgcaagctctcccccaggtggggaacctgggccttcttttcatgctcctgttttttatctatgctgcgctgggagtggagctgttcgggaggctggagtgcagtgaagacaacccctgcgagggcctgagcaggcacgccaccttcagcaacttcggcatggccttcctcacgctgttccgcgtgtccacgggggacaactggaacgggatcatgaaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgctctcgctgcccaacgacagctacatgttcaggcccgtggtgcctgcctcggcgccccacccccgcccgctgcaggaggtggagatggagacctatggggccggcacccccttgggctccgttgcctctgtgcactctccgcccgcagagtcctgtgcctccctccagatcccattggctgtgtcgtccccagccaggagcggcgagcccctccacgccctgtcccctcggggcacagcccgctcccccagtctcagccggctgctctgcagacaggaggctgtgcacaccgattccttggaagggaagattgacagccctagggacaccctggatcctgcagagcctggtgagaaaaccccggtgaggccggtgacccaggggggctccctgcagtccccaccacgctccccacggcccgccagcgtccgcactcgtaagcataccttcggacagcgctgcgtctccagccggccggcggccccaggcggagaggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggatgctcagggcttcctggacaagccgggccgggcagacgagcagtggcggccctcggcggagctgggcagcggggagcctggggaggcgaaggcctggggccctgaggccgagcccgctctgggtgcgcgcagaaagaagaagatgagccccccctgcatctcggtggaaccccctgcggaggacgagggctctgcgcggccctccgcggcagagggcggcagcaccacactgaggcgcaggaccccgtcctgtgaggccacgcctcacagggactccctggagcccacagagggctcaggcgccgggggggaccctgcagccaagggggagcgctggggccaggcctcctgccgggctgagcacctgaccgtccccagctttgcctttgagccgctggacctcggggtccccagtggagaccctttcttggacggtagccacagtgtgaccccagaatccagagcttcctcttcaggggccatagtgcccctggaacccccagaatcagagcctcccatgcccgtcggtgaccccccagagaagaggcgggggctgtacctcacagtcccccagtgtcctctggagaaaccagggtccccctcagccacccctgccccagggggtggtgcagatgaccccgtgtagctcggggcttggtgccgcccacggctttggccctggggtctgggggccccgctggggtggaggcccaggcagaaccctgcatggaccctgacttgggtcccgtcgtgagcagaaaggcccggggaggatgacggcccaggccctggttctctgcccagcgaagcaggagtagctgccgggccccacgagcctccgtccgttctggttcgggtttctccgagttttgctaccagccgaggctgtgcgggcaactgggtcagcctcccgtcaggagagaagccgcgtctgtgggacgaagaccgggcacccgccagagaggggaaggtaccaggttgcgtcctttcaggccccgcgttgttacaggacactcgctgggggccctgtgcccttgccggcggcaggttgcagccaccgcggcccaatgtcaccttcactcacagtctgagttcttgtccgcctgtcacgccctcaccaccctccccttccagccaccaccctttccgttccgctcgggccttcccagaagcgtcctgtgactctgggagaggtgacacctcactaaggggccgaccccatggagtaacgcgcccggccccgatgcgaatcaggcctcccctacatctgggggcgttggccgcgagattcccattgacacctttgtttcgtgtgcttttaaattcaggttaaatgttgcaataatctgatgcagaagactcagcttctcaagggagagggagggggcggagcggaataaatagtaacttatttaagaaatgcaaaaaaaaaa

SEQ ID NO: 52989 - DNA, 9902 bp, Homo sapiens
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggtgtgcaacccgtggtttgaatgtgtcagcatgctggtgatcctgctgaactgcgtgacacttggcatgtaccagccgtgcgacgacatggactgcctgtccgaccgctgcaagatcctgcaggtctttgatgacttcatctttatcttctttgccatggagatggtgctcaagatggtggccctggggatttttggcaagaagtgctacctcggggacacatggaaccgcctggatttcttcatcgtcatggcagggatggtcgagtactccctggaccttcagaacatcaacctgtcagccatccgcaccgtgcgcgtcctgaggcccctcaaagccatcaaccgcgtgcccagtatgcggatcctggtgaacctgctcctggacacactgcccatgctggggaatgtcctgctgctctgcttctttgtcttcttcatctttggcatcataggtgtgcagctctgggcgggcctgctgcgtaaccgctgcttcctggaggagaacttcaccatacaaggggatgtggccttgcccccatactaccagccggaggaggatgatgagatgcccttcatctgctccctgtcgggcgacaatgggataatgggctgccatgagatccccccgctcaaggagcagggccgtgagtgctgcctgtccaaggacgacgtctacgactttggggcggggcgccaggacctcaatgccagcggcctctgtgtcaactggaaccgttactacaatgtgtgccgcacgggcagcgccaacccccacaagggtgccatcaactttgacaacatcggttatgcttggattgtcatcttccaggtgatcactctggaaggctgggtggagatcatgtactacgtgatggatgctcactccttctacaacttcatctacttcatcctgcttatcatagtgggctccttcttcatgatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggccccacgccaaggagccccggcactaccagctgtgcccgcaacatagccccctggatgcgacgccccacaccctggtgcagcccatccccgccacgctggcttccgatcccgccagctgcccttgctgccagcatgaggacggccggcggccctcgggcctgggcagcaccgactcgggccaggagggctcgggctccgggagctccgctggtggcgaggacgaggcggatggggacggggcccggagcagcgaggacggagcctcctcagaactggggaaggaggaggaggaggaggagcaggcggatggggcggtctggctgtgcggggatgtgtggcgggagacgcgagccaagctgcgcggcatcgtggacagcaagtacttcaaccggggcatcatgatggccatcctggtcaacaccgtcagcatgggcatcgagcaccacgagcagccggaggagctgaccaacatcctggagatctgcaatgtggtcttcaccagcatgtttgccctggagatgatcctgaagctggctgcatttgggctcttcgactacctgcgtaacccctacaacatcttcgacagcatcattgtcatcatcagcatctgggagattgtggggcaggcggacggtgggctgtcggtgctgcggaccttccggctgctgcgcgtgctgaaactggtgcgcttcatgcctgccctgcggcgccagctcgtggtgctcatgaagaccatggacaacgtggccaccttctgcatgctgctcatgctcttcatcttcatcttcagcatccttgggatgcatatttttggctgcaagttcagcctccgcacggacactggagacacggtgcccgacaggaagaacttcgactccctgctgtgggccatcgtcactgtgttccagatcctcacccaggaggactggaacgtcgttctctacaatggcatggcctccacttctccctgggcctccctctactttgtcgccctcatgaccttcggcaactatgtgctcttcaacctgctggtggccatcctggtggagggcttccaggcggagggtgacgccaatcgctcctactcggacgaggaccagagctcatccaacatagaagagtttgataagctccaggaaggcctggacagcagcggagatcccaagctctgcccaatccccatgacccccaatgggcacctggaccccagtctcccactgggtgggcacctaggtcctgctggggctgcgggacctgccccccgactctcactgcagccggaccccatgctggtggccctgggctcccgaaagagcagtgtcatgtctctagggaggatgagctatgaccagcgctccctgtccagctcccggagctcctactacgggccatggggccgcagcgcggcctgggccagccgtcgctccagctggaacagcctcaagcacaagccgccgtcggcggagcatgagtccctgctctctgcggagcgcggcggcggcgcccgggtctgcgaggttgccgcggacgaggggccgccgcgggccgcacccctgcacaccccacacgcccaccacattcatcacgggccccatctggcgcaccgccaccgccaccaccgccggacgctgtccctcgacaacagggactcggtggacctggccgagctggtgcccgcggtgggcgcccacccccgggccgcctggagggcggcaggcccggcccccgggcatgaggactgcaatggcaggatgcccagcatcgccaaagacgtcttcaccaagatgggcgaccgcggggatcgcggggaggatgaggaggaaatcgactacaccctgtgcttccgcgtccgcaagatgatcgacgtctataagcccgactggtgcgaggtccgcgaagactggtctgtctacctcttctctcccgagaacaggttccgggtcctgtgtcagaccattattgcccacaaactcttcgactacgtcgtcctggccttcatctttctcaactgcatcaccatcgccctggagcggcctcagatcgaggccggcagcaccgaacgcatctttctcaccgtgtccaactacatcttcacggccatcttcgtgggcgagatgacattgaaggtagtctcgctgggcctgtacttcggcgagcaggcgtacctacgcagcagctggaacgtgctggatggctttcttgtcttcgtgtccatcatcgacatcgtggtgtccctggcctcagccgggggagccaagatcttgggggtcctccgagtcttgcggctcctgcgcaccctacgccccctgcgtgtcatcagccgggcgccgggcctgaagctggtggtggagacactcatctcctccctcaagcccatcggcaacatcgtgctcatctgctgtgccttcttcatcatctttggcatcctgggagtgcagctcttcaagggcaagttctaccactgtctgggcgtggacacccgcaacatcaccaaccgctcggactgcatggccgccaactaccgctgggtccatcacaaatacaacttcgacaacctgggccaggctctgatgtccctctttgtcctggcatccaaggatggttgggtgaacatcatgtacaatggactggatgctgttgctgtggaccagcagcctgtgaccaaccacaacccctggatgctgctgtacttcatctccttcctgctcatcgtcagcttctttgtgctcaacatgtttgtgggtgtcgtggtggagaacttccacaagtgccggcagcaccaggaggctgaagaggcacggcggcgtgaggagaagcggctgcggcgcctggagaagaagcgccggaaggcccagcggctgccctactatgccacctattgtcacacccggctgctcatccactccatgtgcaccagccactacctggacatcttcatcaccttcatcatctgcctcaacgtggtcaccatgtccctggagcactacaatcagcccacgtccctggagacagccctcaagtactgcaactatatgttcaccactgtctttgtgctggaggctgtgctgaagctggtggcatttggtctgaggcgcttcttcaaggaccgatggaaccagctggacctggccattgtgctactgtcagtcatgggcatcaccctggaggagatcgagatcaatgcggccctgcccatcaatcccaccatcatccgcatcatgagggttctgcgcattgcccgagtgctgaagctgttgaagatggccacaggaatgcgggccctgctggacacggtggtgcaagctttgccccaggtgggcaacctgggcctcctcttcatgctgctcttcttcatctatgctgctctcggggtggagctctttgggaagctggtctgcaacgacgagaacccgtgcgagggcatgagccggcatgccaccttcgagaacttcggcatggccttcctcacactcttccaggtctccacgggtgacaactggaacgggatcatgaaggacacgctgcgggactgcacccacgacgagcgcagctgcctgagcagcctgcagtttgtgtcgccgctgtacttcgtgagcttcgtgctcaccgcgcagttcgtgctcatcaacgtggtggtggctgtgctcatgaagcacctggacgacagcaacaaggaggcgcaggaggacgccgagatggatgccgagctcgagctggagatggcccatggcctgggccctggcccgaggctgcctaccggctccccgggcgcccctggccgagggccgggaggggcgggcggcgggggcgacaccgagggcggcttgtgccggcgctgctactcgcctgcccaggagaacctgtggctggacagcgtctctttaatcatcaaggactccttggagggggagctgaccatcatcgacaacctgtcgggctccatcttccaccactactcctcgcctgccggctgcaagaagtgtcaccacgacaagcaagaggtgcagctggctgagacggaggccttctccctgaactcagacaggtcctcgtccatcctgctgggtgacgacctgagtctcgaggaccccacagcctgcccacctggccgcaaagacagcaagggtgagctggacccacctgagcccatgcgtgtgggagacctgggcgaatgcttcttccccttgtcctctacggccgtctcgccggatccagagaacttcctgtgtgagatggaggagatcccattcaaccctgtccggtcctggctgaaacatgacagcagtcaagcacccccaagtcccttctccccggatgcctccagccctctcctgcccatgccagccgagttcttccaccctgcagtgtctgccagccagaaaggcccagaaaagggcactggcactggaaccctccccaagattgcgctgcagggctcctgggcatctctgcggtcaccaagggtcaactgtaccctcctccggcaggccaccgggagcgacacgtcgctggacgccagccccagcagctccgcgggcagcctgcagaccacgctcgaggacagcctgaccctgagcgacagcccccggcgtgccctggggccgcccgcgcctgctccaggaccccgggccggcctgtcccccgccgctcgccgccgcctgagcctgcgcggccggggcctcttcagcctgcgggggctgcgggcgcatcagcgcagccacagcagcgggggctccaccagcccgggctgcacccaccacgactccatggacccctcggacgaggagggccgcggtggcgcgggcggcgggggcgcgggcagcgagcactcggagaccctcagcagcctctcgctcacctccctcttctgcccgccgcccccgccgccagcccccggcctcacgcccgccaggaagttcagcagcaccagcagcctggccgcccccggccgcccccacgccgccgccctggcccacggcctggcccggagcccctcgtgggccgcggaccgcagcaaggacccccccggccgggcaccgctgcccatgggcctgggccccttggcgcccccgccgcaaccgctccccggagagctggagccgggagacgccgccagcaagaggaagagatgagggtcgcaggggcccccggccgcccaccgcccgccccgtctcaccttctttacctcaggagccaggagcagacagcaatacttcgtccacacctgggatcgcgcagggcccgcagggcacaggcgcccgacagccgggctgagcggagtctgggttagccaggcctgcgtggcccatggtggcccttccagtgcatatacatacatatatatatatatatgcatatatatatatatatatatatatatgtgtatacacacacacatagacagacatatatatatatatttattttttttactgagagcttatgacttccagaaagtgctaaaggtgggaggtgggccagggcctggacggggcttttgtctgatgctctgggattctggccagacccaccccagggcacatgtcctgcgggggcgtcccagctgtgttttttgatgtctcctccctggttaagagtagcttggagaggaccctcaggcctctgagggcaccaggccctggagaagaggtgcaattcagggtgtgtgtgtgttttttttcctttaaagaagaaacgctgctaagatcccacgtggctcccacgtgtcggggtgtctgtcctgtcatcctgactgtctcgttattgtgaagtctttcgtagacaccccagagcacacacatccccttagtccaccggttagatgtctctctttagaaaaatcaggggtgagtagctgtgtttccttaggcctggggtaggggatggagagcagctccaaggctgagctggggctctggccccaggtgaggtccccagctcctgagcacttctgagggggtgggttccacccccaggagggcgggggtgggtggagcaggagtggaggcagcctgcagaggaagggtgcgggagactgagccggcagtggcttgcttggaggggctagggtacccgcctggtctcggctggctccagctgccctgcaggtgcccctgggctcaggtagttagttgttcagccactaatgccttttatcccccatatgggcgctgagctgtggctgttcctggacactgtgctgtccccgtcctgagcaactatgcccccgccccagtaggttcaaggcaaagcagctctgaccgaattctaggcaggggtgggggcacctgcctgggccctgggtccagccgcatccccatgcccagcctttcgcgtcacctggaggccacatcttcccaccccacctgccagcccctgtctctcctccccgctgcccctaactgcagctcagctttcactatagcagtgcttcccaaacgggttctagacttgggtgtttgatttgaagagttacgcatttatttcactatttattgggaaaaaaatgcattgaacccgtgatttcacagacattttgcttaggtcaaggctactttttaaaaagggagtgactttcatgaagtcagtttgaagaaggaggttgggagcatgttggtggcagtgatctggagaggctgcaggggccacgagtttgcagatgctgtacttcagcaataaccttgcctttgctaagaccccctccgagggcttcaggggggcctgccaagggggggccttgttcttgttcccaaactctgacttggaagaactcagcttgtggccgggctggtgagggtgtggggtgcgcccttcccttttgggctgagggagagggggccgggaggggttgtcaagcccacccgggaaactgagccctggagaggggaagcagccagcccaggatgcttcagggccctggcagcaaagaagctggggtggtgtggagggccctactccacaccctagagctgtgatgctgagcaaggtgcctgtggcggaaggaactgcccagtcctccctgggggcaggtagacctgtggggatggctcggtccaagcccaacactgcccgctccagagagcctcagccctgcctccctttccacagaggtggttttatgtggaacgaggtaccttgtctggggaagaagtggagctgggcaggcttgactgctcctggctgaccctgagctctcgcagttggagggaagcagacagacttgactttttgcaagtccgcgtgttgctggagggacacgtgtattggagcccagaagaggggctgtgtggcctgggaataccatgtggaaggttgggcttcaagttaacaggatcagacaccagtcaagcagcctcaggtcatcttgcgactccactgagcagcctttcctgttgtcacatgggttcagagcagctgagcagggaacacgtcctaggcaggtctgacgtgaaacctccccttaccctgaaccgtgtgactctgcaagcagacacctcgaggcaggtgttctaggcaaagggatgggcatgagcgaaggctccagggtccacagagcagggagtgtggagaaggtggaagagctgagctcagaggcagagaagctccttgcagggagcactgggagatggcctggcccgtcccaggctcctggaggccccacctgccgatcccaggcacttgaccttgttcctgtgggtgacagagatgagaaccagggaagctgtgatccactggccaggacaagtcaacatgggtgagggttgggcaaagggcccttccttcctccccaaccctgtggtctggggccatggcctcaggcttgtgtctatcacaaaagcacaaacttgccctaacccacatgggcctggctgtggggaaagtggggacccaggtccctgagctgtctgctgggctccgtagagcggtggtgggcaggcaccttggcatctgtgcagagacggcccagtctggccaaatcctcttcctctcccctgctctaccttctccggcaccaggcagccccttaaaggaggacaaagtgtgtaaagcccgtctgctgtcttcccccaaatcctcagctcagagccttccgcttccagggccaaccccagccccgtttgctgcgttgtgtaagggcttggggtcttagaagctgctctttagcccagatacacatactcttttttgtctttgtgcaataatcagtgttcctggcagagcctgggccaagctgcagcctactgaggaggcagaggccacctcctccagaaagccctcggcctgggccgccgccgtgactctagcactctcagtcgctgtacagtttctatggtgtgaatgaacttccctcctagttgctgatggcgctggtacctgctggcccatggcccgggtgtagagaaaccaagcggcagccaccaccagtgttgttttgaataaaagcccagaagcctatttaagaaaaaaa

SEQ ID NO: 52990 - DNA, 10007 bp, Homo sapiens
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggtgtgcaacccgtggtttgaatgtgtcagcatgctggtgatcctgctgaactgcgtgacacttggcatgtaccagccgtgcgacgacatggactgcctgtccgaccgctgcaagatcctgcaggtctttgatgacttcatctttatcttctttgccatggagatggtgctcaagatggtggccctggggatttttggcaagaagtgctacctcggggacacatggaaccgcctggatttcttcatcgtcatggcagggatggtcgagtactccctggaccttcagaacatcaacctgtcagccatccgcaccgtgcgcgtcctgaggcccctcaaagccatcaaccgcgtgcccagtatgcggatcctggtgaacctgctcctggacacactgcccatgctggggaatgtcctgctgctctgcttctttgtcttcttcatctttggcatcataggtgtgcagctctgggcgggcctgctgcgtaaccgctgcttcctggaggagaacttcaccatacaaggggatgtggccttgcccccatactaccagccggaggaggatgatgagatgcccttcatctgctccctgtcgggcgacaatgggataatgggctgccatgagatccccccgctcaaggagcagggccgtgagtgctgcctgtccaaggacgacgtctacgactttggggcggggcgccaggacctcaatgccagcggcctctgtgtcaactggaaccgttactacaatgtgtgccgcacgggcagcgccaacccccacaagggtgccatcaactttgacaacatcggttatgcttggattgtcatcttccaggtgatcactctggaaggctgggtggagatcatgtactacgtgatggatgctcactccttctacaacttcatctacttcatcctgcttatcatagtgggctccttcttcatgatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggccccacgccaaggagccccggcactaccatgggaagactaagggtcagggagatgaagggagacatctcggaagccggcattgccagactttgcatgggcctgcctcccctggaaatgatcactcgggaagagagctgtgcccgcaacatagccccctggatgcgacgccccacaccctggtgcagcccatccccgccacgctggcttccgatcccgccagctgcccttgctgccagcatgaggacggccggcggccctcgggcctgggcagcaccgactcgggccaggagggctcgggctccgggagctccgctggtggcgaggacgaggcggatggggacggggcccggagcagcgaggacggagcctcctcagaactggggaaggaggaggaggaggaggagcaggcggatggggcggtctggctgtgcggggatgtgtggcgggagacgcgagccaagctgcgcggcatcgtggacagcaagtacttcaaccggggcatcatgatggccatcctggtcaacaccgtcagcatgggcatcgagcaccacgagcagccggaggagctgaccaacatcctggagatctgcaatgtggtcttcaccagcatgtttgccctggagatgatcctgaagctggctgcatttgggctcttcgactacctgcgtaacccctacaacatcttcgacagcatcattgtcatcatcagcatctgggagattgtggggcaggcggacggtgggctgtcggtgctgcggaccttccggctgctgcgcgtgctgaaactggtgcgcttcatgcctgccctgcggcgccagctcgtggtgctcatgaagaccatggacaacgtggccaccttctgcatgctgctcatgctcttcatcttcatcttcagcatccttgggatgcatatttttggctgcaagttcagcctccgcacggacactggagacacggtgcccgacaggaagaacttcgactccctgctgtgggccatcgtcactgtgttccagatcctcacccaggaggactggaacgtcgttctctacaatggcatggcctccacttctccctgggcctccctctactttgtcgccctcatgaccttcggcaactatgtgctcttcaacctgctggtggccatcctggtggagggcttccaggcggagggtgacgccaatcgctcctactcggacgaggaccagagctcatccaacatagaagagtttgataagctccaggaaggcctggacagcagcggagatcccaagctctgcccaatccccatgacccccaatgggcacctggaccccagtctcccactgggtgggcacctaggtcctgctggggctgcgggacctgccccccgactctcactgcagccggaccccatgctggtggccctgggctcccgaaagagcagtgtcatgtctctagggaggatgagctatgaccagcgctccctgtccagctcccggagctcctactacgggccatggggccgcagcgcggcctgggccagccgtcgctccagctggaacagcctcaagcacaagccgccgtcggcggagcatgagtccctgctctctgcggagcgcggcggcggcgcccgggtctgcgaggttgccgcggacgaggggccgccgcgggccgcacccctgcacaccccacacgcccaccacattcatcacgggccccatctggcgcaccgccaccgccaccaccgccggacgctgtccctcgacaacagggactcggtggacctggccgagctggtgcccgcggtgggcgcccacccccgggccgcctggagggcggcaggcccggcccccgggcatgaggactgcaatggcaggatgcccagcatcgccaaagacgtcttcaccaagatgggcgaccgcggggatcgcggggaggatgaggaggaaatcgactacaccctgtgcttccgcgtccgcaagatgatcgacgtctataagcccgactggtgcgaggtccgcgaagactggtctgtctacctcttctctcccgagaacaggttccgggtcctgtgtcagaccattattgcccacaaactcttcgactacgtcgtcctggccttcatctttctcaactgcatcaccatcgccctggagcggcctcagatcgaggccggcagcaccgaacgcatctttctcaccgtgtccaactacatcttcacggccatcttcgtgggcgagatgacattgaaggtagtctcgctgggcctgtacttcggcgagcaggcgtacctacgcagcagctggaacgtgctggatggctttcttgtcttcgtgtccatcatcgacatcgtggtgtccctggcctcagccgggggagccaagatcttgggggtcctccgagtcttgcggctcctgcgcaccctacgccccctgcgtgtcatcagccgggcgccgggcctgaagctggtggtggagacactcatctcctccctcaagcccatcggcaacatcgtgctcatctgctgtgccttcttcatcatctttggcatcctgggagtgcagctcttcaagggcaagttctaccactgtctgggcgtggacacccgcaacatcaccaaccgctcggactgcatggccgccaactaccgctgggtccatcacaaatacaacttcgacaacctgggccaggctctgatgtccctctttgtcctggcatccaaggatggttgggtgaacatcatgtacaatggactggatgctgttgctgtggaccagcagcctgtgaccaaccacaacccctggatgctgctgtacttcatctccttcctgctcatcgtcagcttctttgtgctcaacatgtttgtgggtgtcgtggtggagaacttccacaagtgccggcagcaccaggaggctgaagaggcacggcggcgtgaggagaagcggctgcggcgcctggagaagaagcgccggaaggcccagcggctgccctactatgccacctattgtcacacccggctgctcatccactccatgtgcaccagccactacctggacatcttcatcaccttcatcatctgcctcaacgtggtcaccatgtccctggagcactacaatcagcccacgtccctggagacagccctcaagtactgcaactatatgttcaccactgtctttgtgctggaggctgtgctgaagctggtggcatttggtctgaggcgcttcttcaaggaccgatggaaccagctggacctggccattgtgctactgtcagtcatgggcatcaccctggaggagatcgagatcaatgcggccctgcccatcaatcccaccatcatccgcatcatgagggttctgcgcattgcccgagtgctgaagctgttgaagatggccacaggaatgcgggccctgctggacacggtggtgcaagctttgccccaggtgggcaacctgggcctcctcttcatgctgctcttcttcatctatgctgctctcggggtggagctctttgggaagctggtctgcaacgacgagaacccgtgcgagggcatgagccggcatgccaccttcgagaacttcggcatggccttcctcacactcttccaggtctccacgggtgacaactggaacgggatcatgaaggacacgctgcgggactgcacccacgacgagcgcagctgcctgagcagcctgcagtttgtgtcgccgctgtacttcgtgagcttcgtgctcaccgcgcagttcgtgctcatcaacgtggtggtggctgtgctcatgaagcacctggacgacagcaacaaggaggcgcaggaggacgccgagatggatgccgagctcgagctggagatggcccatggcctgggccctggcccgaggctgcctaccggctccccgggcgcccctggccgagggccgggaggggcgggcggcgggggcgacaccgagggcggcttgtgccggcgctgctactcgcctgcccaggagaacctgtggctggacagcgtctctttaatcatcaaggactccttggagggggagctgaccatcatcgacaacctgtcgggctccatcttccaccactactcctcgcctgccggctgcaagaagtgtcaccacgacaagcaagaggtgcagctggctgagacggaggccttctccctgaactcagacaggtcctcgtccatcctgctgggtgacgacctgagtctcgaggaccccacagcctgcccacctggccgcaaagacagcaagggtgagctggacccacctgagcccatgcgtgtgggagacctgggcgaatgcttcttccccttgtcctctacggccgtctcgccggatccagagaacttcctgtgtgagatggaggagatcccattcaaccctgtccggtcctggctgaaacatgacagcagtcaagcacccccaagtcccttctccccggatgcctccagccctctcctgcccatgccagccgagttcttccaccctgcagtgtctgccagccagaaaggcccagaaaagggcactggcactggaaccctccccaagattgcgctgcagggctcctgggcatctctgcggtcaccaagggtcaactgtaccctcctccggcaggccaccgggagcgacacgtcgctggacgccagccccagcagctccgcgggcagcctgcagaccacgctcgaggacagcctgaccctgagcgacagcccccggcgtgccctggggccgcccgcgcctgctccaggaccccgggccggcctgtcccccgccgctcgccgccgcctgagcctgcgcggccggggcctcttcagcctgcgggggctgcgggcgcatcagcgcagccacagcagcgggggctccaccagcccgggctgcacccaccacgactccatggacccctcggacgaggagggccgcggtggcgcgggcggcgggggcgcgggcagcgagcactcggagaccctcagcagcctctcgctcacctccctcttctgcccgccgcccccgccgccagcccccggcctcacgcccgccaggaagttcagcagcaccagcagcctggccgcccccggccgcccccacgccgccgccctggcccacggcctggcccggagcccctcgtgggccgcggaccgcagcaaggacccccccggccgggcaccgctgcccatgggcctgggccccttggcgcccccgccgcaaccgctccccggagagctggagccgggagacgccgccagcaagaggaagagatgagggtcgcaggggcccccggccgcccaccgcccgccccgtctcaccttctttacctcaggagccaggagcagacagcaatacttcgtccacacctgggatcgcgcagggcccgcagggcacaggcgcccgacagccgggctgagcggagtctgggttagccaggcctgcgtggcccatggtggcccttccagtgcatatacatacatatatatatatatatgcatatatatatatatatatatatatatgtgtatacacacacacatagacagacatatatatatatatttattttttttactgagagcttatgacttccagaaagtgctaaaggtgggaggtgggccagggcctggacggggcttttgtctgatgctctgggattctggccagacccaccccagggcacatgtcctgcgggggcgtcccagctgtgttttttgatgtctcctccctggttaagagtagcttggagaggaccctcaggcctctgagggcaccaggccctggagaagaggtgcaattcagggtgtgtgtgtgttttttttcctttaaagaagaaacgctgctaagatcccacgtggctcccacgtgtcggggtgtctgtcctgtcatcctgactgtctcgttattgtgaagtctttcgtagacaccccagagcacacacatccccttagtccaccggttagatgtctctctttagaaaaatcaggggtgagtagctgtgtttccttaggcctggggtaggggatggagagcagctccaaggctgagctggggctctggccccaggtgaggtccccagctcctgagcacttctgagggggtgggttccacccccaggagggcgggggtgggtggagcaggagtggaggcagcctgcagaggaagggtgcgggagactgagccggcagtggcttgcttggaggggctagggtacccgcctggtctcggctggctccagctgccctgcaggtgcccctgggctcaggtagttagttgttcagccactaatgccttttatcccccatatgggcgctgagctgtggctgttcctggacactgtgctgtccccgtcctgagcaactatgcccccgccccagtaggttcaaggcaaagcagctctgaccgaattctaggcaggggtgggggcacctgcctgggccctgggtccagccgcatccccatgcccagcctttcgcgtcacctggaggccacatcttcccaccccacctgccagcccctgtctctcctccccgctgcccctaactgcagctcagctttcactatagcagtgcttcccaaacgggttctagacttgggtgtttgatttgaagagttacgcatttatttcactatttattgggaaaaaaatgcattgaacccgtgatttcacagacattttgcttaggtcaaggctactttttaaaaagggagtgactttcatgaagtcagtttgaagaaggaggttgggagcatgttggtggcagtgatctggagaggctgcaggggccacgagtttgcagatgctgtacttcagcaataaccttgcctttgctaagaccccctccgagggcttcaggggggcctgccaagggggggccttgttcttgttcccaaactctgacttggaagaactcagcttgtggccgggctggtgagggtgtggggtgcgcccttcccttttgggctgagggagagggggccgggaggggttgtcaagcccacccgggaaactgagccctggagaggggaagcagccagcccaggatgcttcagggccctggcagcaaagaagctggggtggtgtggagggccctactccacaccctagagctgtgatgctgagcaaggtgcctgtggcggaaggaactgcccagtcctccctgggggcaggtagacctgtggggatggctcggtccaagcccaacactgcccgctccagagagcctcagccctgcctccctttccacagaggtggttttatgtggaacgaggtaccttgtctggggaagaagtggagctgggcaggcttgactgctcctggctgaccctgagctctcgcagttggagggaagcagacagacttgactttttgcaagtccgcgtgttgctggagggacacgtgtattggagcccagaagaggggctgtgtggcctgggaataccatgtggaaggttgggcttcaagttaacaggatcagacaccagtcaagcagcctcaggtcatcttgcgactccactgagcagcctttcctgttgtcacatgggttcagagcagctgagcagggaacacgtcctaggcaggtctgacgtgaaacctccccttaccctgaaccgtgtgactctgcaagcagacacctcgaggcaggtgttctaggcaaagggatgggcatgagcgaaggctccagggtccacagagcagggagtgtggagaaggtggaagagctgagctcagaggcagagaagctccttgcagggagcactgggagatggcctggcccgtcccaggctcctggaggccccacctgccgatcccaggcacttgaccttgttcctgtgggtgacagagatgagaaccagggaagctgtgatccactggccaggacaagtcaacatgggtgagggttgggcaaagggcccttccttcctccccaaccctgtggtctggggccatggcctcaggcttgtgtctatcacaaaagcacaaacttgccctaacccacatgggcctggctgtggggaaagtggggacccaggtccctgagctgtctgctgggctccgtagagcggtggtgggcaggcaccttggcatctgtgcagagacggcccagtctggccaaatcctcttcctctcccctgctctaccttctccggcaccaggcagccccttaaaggaggacaaagtgtgtaaagcccgtctgctgtcttcccccaaatcctcagctcagagccttccgcttccagggccaaccccagccccgtttgctgcgttgtgtaagggcttggggtcttagaagctgctctttagcccagatacacatactcttttttgtctttgtgcaataatcagtgttcctggcagagcctgggccaagctgcagcctactgaggaggcagaggccacctcctccagaaagccctcggcctgggccgccgccgtgactctagcactctcagtcgctgtacagtttctatggtgtgaatgaacttccctcctagttgctgatggcgctggtacctgctggcccatggcccgggtgtagagaaaccaagcggcagccaccaccagtgttgttttgaataaaagcccagaagcctatttaagaaaaaaa

SEQ ID NO: 52991 - DNA, 1677 bp, Homo sapiens
ctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaagggtctgcaacttcattcttgaagtcagtgaggccaagaacccatcaattccgtacacattttggtgactttgaagagactgtcacctatcaccaagtggtgagactattgccaagcagtgagactattgccaagtggtgagaccatcaccaagcggtgagactatcacctatcgccaagtggcctgattcagcaggaagcatctcagacaccaaccactatgctgtcagcagttgcccggggctaccagggctggtttcatccctgtgctaggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctgagggggtgtctaggtgatcatttggatctggaggcagagtctgccattctgccagactagcaatttgggggcttactcatgctaggcttgaggaagaagaaaaacgcttcggcattctccttaggacttatctgcttgtagatttggctgatccaattaacatgtggggttcttggtgtgggtctggggagctgaaggattttatggagctggtgctttggaggaatcttaagggaaaggagtagaagctcaggcctttgaaggatttcagctcctcctctctgtaatttgtgctttaagcattttttttcctaaaataaactcaaatttatcctcaaaaaaaaaaaa

SEQ ID NO: 52992 - DNA, 1688 bp, Homo sapiens
ctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaagggtctgcaacttcattcttgaagtcagtgaggccaagaacccatcaattccgtacacattttggtgactttgaagagactgtcacctatcaccaagtggtgagactattgccaagcagtgagactattgccaagtggtgagaccatcaccaagcggtgagactatcacctatcgccaagtggcctgattcagcaggaagcatctcagacaccaaccactatgctgtcagcagttgcccggggctaccagggctggtttcatccctgtgctaggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctgagggggtgtctaggtgatcatttggatctggaggcagagtctgccattctgccagactagcaatttgggggcttactcatgctaggcttgaggaagaagaaaaacgcttcggcattctccttaggacttatctgcttgtagatttggctgatccaattaacatgtggggttcttggtgtgggtctggggagctgaaggattttatggagctggtgctttggaggaatcttaagggaaaggagtagaagctcaggcctttgaaggatttcagctcctcctctctgtaatttgtgctttaagcattttttttcctaaaataaactcaaatttatcctcaaaaaaaaaaaa

SEQ ID NO: 52993 - DNA, 1708 bp, Homo sapiens
gggggaggctggcagcggagctttgaatagggaagttttgcaggggttacgtttgcagtcagtccggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatgcctgtcctgggagctggagaggatgtcagcgagcctgacattgccctccctgaatgcatcaaatactcttctccaaggactgacaaaaacaaccccccggctgtgggcacagtagggaaccatgccggtttgatcttccattgctcaagccagggaatgcattgcagaggcacctgcacaacgacaaacttgagtgtttccctgccacttctgtgcctccacagcctgctccagttccgcagctagagctgggcctaccttccccagccagccctgccacacacctggctgaggcatgtctgggaggggtggaggaggcagagggactccaggccagagggctgttctcacaacctcagcccactctcagtcaaggagggcagaaaataaaagatgacatcactgccaaaaaaaa

SEQ ID NO: 52994 - DNA, 2444 bp, Homo sapiens
agatgtccccggcccgcgagagcgggcgccggggttcgctctgagtcgcgtggcaggccgcgctgcgtccaccgctgccgagttcagagccgcgcaccgcccgccgccgcaggtcgggttcccagcgctactcccaagacaccgctcagccatgaagatgcatttctgtatcccggtgtcccagcagcggtccgacgcgctggggggccgctacgtgctgtactccgtgcacctggacgggttcctcttctgcagggtgcgctacagccagctgcacggttggaacgaacagctaaggcgggtctttggaaattgcctgccacccttcccaccaaagtactatctggcaatgaccacagctatggctcatgagaggagggaccaactggaacaatatttgcaaaatgtaaccatggacccaaacgtgttgagaagtgatgtcttcgttgagtttttaaaactggcgcagctgaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctccctgttgtgaaaaaattggctgactttgaactcccttatgttagtcttggaagttctgaggtggaaaactgtaaggttggactccgaaagtggtatatggctccatccctcgactccgtgctgatggactgcagggtggcggtagatttgctctacatgcaggcaatacaggacattgaaaaaggatgggccaaacccacacaggcacagaggcagaaattagaagctttccagaaagaagacagtcaaacaaagtttttggagctggcccgggaggtacggcactatggatacctgcagctggatccttgtacctgtgactacccagaatcaggctctggagctgttctttctgttggcaataatgagatcagctgctgcatcaccctgcctgacagccagacccaggacatcgttttccagatgagcagggtgaagtgctggcaggtcactttccttggaactctgctggatacggatgggccccagagagctctcaaccagaacttagagctcagatttcaatacagtgaggatagttgctggcagtggtttgttatttacaccaaacaggcttttttgctgagtagctgcttgaaaaagatgatctcagaaaagatggtaaagctagctgctgagaatacagaaatgcagattgaagttccggaacaaagcaaaagtaaaaaataccacattcaacaaagccagcagaaagactattctagttttctatcaagaaaaagcaagattaagatagctaaagatgactgcgtttttgggaacataaaggaagaagatctctgaagaaagctctcatattttaaaatatccttggaggctatctcaagacagtgaaagaacttggggattcaggtgggctacctaccatcagtggaggaaatttgacctcttcccatttttttggcattaacatggactgtattcatcaaggtattataccacagcactctatggaaatctcaagattagaaaaaaaaaaagaaccaagttatagagttagtttttattttatttttgcacttcgtcatgacagtatagagtttgtttttaatgtctcataaatgacaagtggcaaattcaaatcaactcatataaaactcattctattttttctctaaaatagatctttatatggcttcatgaagtcttttatgtgttttgaatttacataaatgaaagtctcataaaatatcataaagatattttggatcgatttctaaagatgtgactcttcaacggaggagaatagggctctgagaaatggaatcactgaaaaagaaacctgggttctctgatctatccacacagaactagagcaaggaggtgatgaaatactgatctctttcctcacataagtctgagcctaccaatatggatgtactcaaagtgaaacgctgccctgttctctgcttgaccattgttataattttattctgtccttagagtactgaaggcagttcaataatcaacatgctatttggaatgttttaatttggaaagcaataaggctctgcacctgatatcagataccttataattctcttagctttaaaaatatgtatactttctcacaaggtttttccttatctagcttcatttctctcatggtaattaatgtaattatgtatagaattaagaccacaataagggagatgatcagaggaatctgtatagtgtaattagaaaaagtacaatattctaatgttctaactgggttgtatacctaattatataataaatacaaaataattcc

SEQ ID NO: 52995 - DNA, 3183 bp, Homo sapiens
gagtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctagcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctgccacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgtccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagcctctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggccaggtggtggagacagagacaggccctgaacgataagcaccaagagacccaaggctccagatggaacactgagggtgaccgtccctctcagaagcttttccctggagtgtcatgcctcacctgcaacccatgtggttctcagacttgaatcttctcggcccccaaaaatgaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccccaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctttcacatagtaggagcttctagatgcatgtggaagcaatgagagttgtcccttagccttataaactccccatgatctgacatgcagaaatccagccttgtccagaatcctcctggaattgcttggaggacgaaagtatgctgggggatgggtgggtactagggagactgggtacaagggtgaaaagtagttcccataatacacatggttgactatggtgatccaccttgtgatggttaatattaggtgtctggagaaggttgcttcattggccctgggacttctctctgcaggaggagagaacgctgcctctcctctggattggtctcaggctctctgttggcctttggtcagcgtttccacatcctgctctgctgcaggagagggggctaaggggctggatccaccaaggcagctcacagcgggaaaactctgggactgaaccactgaattcaggggatgggggtgggggcccggttctcgaggtgtgtgccagctacacgtgtgttctgtatgggtccagctgcgtttccatcactcgctaataaatcaacagaaacac

SEQ ID NO: 52996 - DNA, 2373 bp, Homo sapiens
cccaggcccaccccacccagcacccctggcgcagggactgctggaacctggctgtgcgcgctgtcgctttaagacagactctgccggcgccgtccggagccttagaaaccggccccggatcgcgagccggagccggagccggagccggggccggccgggctgctgaggcccgagcggcaggagcgcagcgcggagcgctgagccaggcgcccagtcgcgagaagctgccgccgcctctgcccgcccggcgccgcagccccgggcggtccatggggcgggcacggcgtcgctgcaggcgccggcagccctggagggcagccgcttaggcgctgcgctcttgtccccgcaggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcgccctgcagggcccggcctcgggcctcaacgcgtgccagtacaacagctgaccgccccgccgcaccacgcgggccggcggccggagcggggaagggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaagcaaaaagacgtcggagaaaagtgccgcgaaaaaatggatgagttgcaatttctctcgggatggcgcgggtggtgtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgactaaaaaaaaaaaaaaaaa

SEQ ID NO: 52997 - DNA, 1407 bp, Homo sapiens
ggagcgcccgagcggagaggcggcccgggagcaggggggcggcccccactccggccgggtgcccggcccctggcccctgcctgccctctagatcgccgccgcagccgccgctactgggagtctgcctgttgcaggacgcactagccctccctccatggagttcggcctgctcagcgaggcagaggcccggagccctgccctgtcgctgtcagacgctggcactccgcacccccagctcccagagcacggctgcaagggccaggagcacagcgactcagaaaaggcctcggcttcgctgcccggcggctccccagaggacggttcgctgaaaaagaagcagcggcggcagcgcacgcacttcaccagccagcagctacaggagctagaggcgaccttccagaggaaccgctaccccgacatgagcacgcgcgaggagatcgccgtgtggaccaacctcaccgaggcccgcgtgcgggtgtggttcaagaaccggcgcgccaaatggcggaagcgcgagcgcagccagcaggccgagctatgcaaaggcagcttcgcggcgccgctcggggggctggtgccgccctacgaggaggtgtaccccggctactcgtacggcaactggccgcccaaggctcttgccccgccgctcgccgccaagacctttccattcgccttcaactcggtcaacgtggggcctctggcttcgcagcccgtcttctcgccacccagctccatcgccgcctccatggtgccctccgccgcggctgccccgggcaccgtgccagggcctggggccctgcagggcctgggcgggggcccccccgggctggctccggccgccgtgtcctccggggccgtgtcctgcccttatgcctcggccgccgccgccgccgcggctgccgcctcttccccctacgtctatcgggacccgtgtaactcgagcctggccagcctgcggctcaaagccaaacagcacgcctccttcagctaccccgctgtgcacgggccgcccccggcagccaaccttagtccgtgccagtacgccgtggaaaggcccgtatgagcggccccgcccgtagatcatccccgagggcgggggcaacgattcacagcctccgcggactggggtcattttgactggcttgctcccgccccagggtctgaaaggggtgtttgggcagctggggggcaccggctcaggagagggccttcccctcccagccctgaggggtggactaggccctacacacagaccgcgcccctgggactaaagccaggaacagggaccagctccccgggggccaactcacccttggcccatcccgccttctccaggcttcccctccctcgttttcaaagataaatgaaataaacgtgcgcggactgtcaaaaaaaaaaaaaaaaaaa

SEQ ID NO: 52998 - DNA, 4183 bp, Homo sapiens
atgtaacaggtcatgtggcagcctcctagggacacgcgtggggtctggagcgggacacgcgtgtgcagccgggccttacgtgtggctcaaggggcggtgggcgagagagacgtggacacaagtggggtggggcacgtgagggtctggggaatagaaccaggggttccatgcgccctcctccttgtctggggcgggtcttaggttggcgggagagcccagcggggacctagcgacaaggggggctggcagcctccggggctctgggccctgggagagggcggggggtgggggggattagcgttgcctgagcggcgcgtagggggtagggggagggactgagaggcgggcgggcctggagcaaacgggagccgcgctgccttcacagctcagctgggcccagcctctcctctgtctctcctcggtctcagctctgggcgagcagcggcctgtctgaagagcatgcagcccccttactccccgcctggcctcgccatccctgcccccccagcctgacccccggccccagcatggcccagggtgccatgcgcttctgctcggaaggcgactgtgccatctccccaccacgatgcccacgccgctggctccccgaaggcccggtgccccagagccccccagccagcatgtatggcagcacaggctccttgctacggcgagtggcaggtccaggtcctcgaggccgggaactgggacgtgtgacagcaccctgtacacctctgcgtggccccccctcaccccgtgttgctccctcaccctgggcaccctcttcacccactgggcagcccccacccggggcccagagctctgtggtcatcttccgctttgtggagaaggccagtgtgaggccactgaatgggctacctgctccagggggcttgagtcggagctgggatctgggtggggtttctcctcccaggcccaccccagcccttgggcctggctccaaccggaagttacggctggaagcatccacatcagacccactccccgccagaggaggctcggccctacctggcagccggaaccttgtacatgggccgccagccccaccccaggttggagcagatggcctttactcctctctccccaatgggctggggggcccccctgagcgcctggccacactcttcggaggacctgctgacactggattcctgaaccagggggatacctggtcctccccccgggaagtctcctctcatgcccagagaatcgctagagccaaatgggaattcttctatggctccttggacccccccagctcaggtgctaagcccccagagcaggcccccccatctccacctggggtgggctcaaggcagggctctggggtggctgtggggcgagcagccaagtactccgagacagacctggacacggtgcccctgaggtgctaccgcgagactgacatcgatgaggtgctggctgagcgggaggaggccgactcggccatcgaaagtcagcccagctctgagggcccaccaggcactgcctacccacctgccccacggcccggcccactccctggccctcatcccagcctcggcagtggcaatgaggatgaggacgacgatgaggcaggtggggaagaagatgtggacgacgaggtgtttgaggcctctgaaggggcccggccagggagccggatgcctctcaagtcacctgtgccctttctacctgggacgagcccctcggctgatgggcctgactctttcagttgtgtgttcgaagccatcctggagtcacaccgggccaaaggcacctcctataccagcctcgcctcgctggaggccttggcctcacctggcccaacccagagccccttcttcacctttgagctgcctccccaaccccctgcaccccggcccgacccaccagctcccgccccacttgcccctcttgaaccggattctggtaccagctctgctgctgatggtccttggacacagagaggggaggaggaggaggcagaggccagagccaagctggccccagggagggagccccctagtccctgccactcagaggacagccttgggctgggggcagcaccccttggcagcgaaccacccctgagccagctggtgtccgactcagactcagagctggacagcacagagcggctggccctgggaagcacagacaccttgtccaatgggcagaaagcggacctggaggctgcgcagcgcctggccaagaggctgtaccgactagatggcttcaggaaggccgatgtggcccggcacctgggcaagaacaatgacttcagcaaactggtggctggggagtacctcaagttctttgtcttcacgggcatgactctggaccaagctctcagggtgtttctgaaggagctggccttaatgggtgagacccaggaacgagagcgcgtgctggcccacttctcccagcgatacttccagtgcaatcctgaagccctgtcctcagaggacggcgcccacacgctgacctgtgcgctcatgctgctcaacacggatctccacggccataacatcgggaagcgcatgacctgcggggacttcatcgggaacctggagggcctcaatgatggcggcgacttccctagggagctgctcaaggccttgtacagctccatcaagaatgagaagctgcagtgggccatagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgagcctggagcagatgcagtcctggatcactcgcatcaatgtagtagccgctatgttctctgcgccccccttcccagctgctgttagctcccaaaagaagttcagccgccctctcctgcccagcgctgccacccgcctctcccaggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctgagatgaggtttagggtggggagtgcctgctgggcacctgaaggatgacatggccctgcctgagcccgggccggcctcgggccacccacgagggcctcccggcctagggcccgaccgcgccggacgcggtgtccggggcagggcagggctggggcctgggcctcaggagcctaggctaggggcacctccgagagcccctttttgtgataatgttttgcactttttcgtacagggtgggcgggggcgggaggggctagcgcccctgaacttttgatgctttttttttgtgtgggagaggcctgatgccgtttctgctttctgctgagaccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccatacctgggccgggggcagcacggcctggctttcccccgcttcagtgggccttgccctttgtacagcctccacccccattaaaactgctctggacttgc

SEQ ID NO: 52999 - DNA, 1672 bp, Homo sapiens
ctgctcagtgagctccgccgacagccagccctgctcctcccgccatgaccctgcagacccctctgggcttccaagttcctgggggctgcagtgaacatgctccacctgcatggctggcaaaccatgcagggtagaaagatggggcacccaccagtctctcccagtgccccggccccagctggcaccacagctatacctgggcttattccagaccttgtcgccgggaccccctggccccgctgggctctcattgccggcgcccttgccgcgggcgtcctcctcgtctcctgcctcctctgtgctgcctgctgctgctgccgccgccacaggaagaagcccagggacaaggagtccgtgggtctgggcagtgcccgcggcaccaccaccacccacctggtgcaacctgatgtggatggcctggagtccagcccgggggatgctcagcaatgggggcgcctgcagctctccctggagttcgactttggaagccaggaggtgaagggccccgctgcgcaggaccagcggttctgcgagtttccggaaagggtgacgggggaagggcagaccccatgccctgggtggtggggagctgacagggcaggggcccttggctgagcccaccccgctggctcccagatcagggtgggcctgaggcaggcagccgacctgaggcctgggggcaccgtggacccctatgcccgggtcagcgtctccacccaggccggacacagacatgagacaaaagtgcaccgaggcacgctctgccccgtgtttgacgagacctgctgcttccacgtgagtcagggatggtcggctgggtgggcctggacggctggatgggcctgggctgggtgggcctgggcagctgggtgggcctgggcagctgggtgggcctgagctagggcagcagggcctggctcacgccgctgcctcagatcccgcaggcggagctgccaggggccaccctgcaggtgcagcttttcaacttcaagcgcttctcggggcatgagcccctgggtgagctccgtctgccactgggcaccgtggatctgcagcatgttctggagcactggtacctgctgggcccgccggctgccactcagcccgagcaggtcggggagctgtgcttctctctccggtacgtgcccagctcaggccggctgaccgtggtggtgctggaggctcgaggcctgcgtccaggacttgcagagccctacgtgaaggtccagctcatgctgaaccagaggaagtggaagaagagaaagacagccaccaaaaagggcacggcggccccctacttcaatgaggccttcaccttcctggtgcccttcagccaggtccagaatgtggacctggtgctggctgtctgggaccgcagcctgccgctccgaactgagcccgtaggcaaggtgcacctgggtgcccgggcctcggggcagcccctgcagcactgggcagacatgctggcccacgcccggcggcccattgcccagcggcaccccctgcggccagccagggaggtggaccgcatgctggccctgcagccccgccttcgcctgcgcctgcccttgccccactcctgaatgcaccacatgcctctgtctccccgctgagcccaggcacttgcccaggccgccctgcaggaccactgcaataaacgccttctcctgcc

SEQ ID NO: 53000 - DNA, 832 bp, Homo sapiens
ctgagtgactgcagccttcctagatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagactctcctacggatgtgaatcaagagaacgtccccagctttggcatcctcaagtatcccccgagagcagaataggtactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttttgcatatgaaaaaaaaaaaaaaaaaa

SEQ ID NO: 53001 - protein, 506 aa, Homo sapiens
MIMSNTHKARLERRVTGSTNRWRLPKQPFSGDLLSLSQMCKALSIDFEEALRNPDRLCISQIQKFFFENFKNKDIQSGEADVILECLGFKWELHQPQLFQSETLAKLYLKALAQGTTHPLRELEELLRAQSPKKTKEKSPAKRIIISLKINDPLVTKVAFATALKNLYMSEVEINLEDLLGVLASAHILQFSGLFQRCVDVMIARLKPSTIKKFYEAGCKYKEEQLTTGCEKWLEMNLVPLGGTQIHLHKIPQDLLHKVLKSPRLFTFSEFHLLKTMLLWVFLQLNYKIQAIPTYETVMTFFKSFPENCCFLDRDIGRSLRPLFLCLRLHGITKGKDLEVLRHLNFFPESWLDQVTVNHYHALENGGDMVHLKDLNTQAVRFGLLFNQENTTYSKTIALYGFFFKIKGLKHDTTSYSFYMQRIKHTDLESPSAVYEHNHVSLRAARLVKYEIRAEALVDGKWQEFRTNQIKQKFGLTTSSCKSHTLKIQTVGIPIYVSFAFIFPAS

SEQ ID NO: 53002 - protein, 2347 aa, Homo sapiens
MTEGARAADEVRVPLGAPPPGPAALVGASPESPGAPGREAERGSELGVSPSESPAAERGAELGADEEQRVPYPALAATVFFCLGQTTRPRSWCLRLVCNPWFEHVSMLVIMLNCVTLGMFRPCEDVECGSERCNILEAFDAFIFAFFAVEMVIKMVALGLFGQKCYLGDTWNRLDFFIVVAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPGRRELRMPCTLGWEAYTQPQAEGVGAARNACINWNQYYNVCRSGDSNPHNGAINFDNIGYAWIAIFQVITLEGWVDIMYYVMDAHSFYNFIYFILLIIVGSFFMINLCLVVIATQFSETKQRESQLMREQRARHLSNDSTLASFSEPGSCYEELLKYVGHIFRKVKRRSLRLYARWQSRWRKKVDPSAVQGQGPGHRQRRAGRHTASVHHLVYHHHHHHHHHYHFSHGSPRRPGPEPGACDTRLVRAGAPPSPPSPGRGPPDAESVHSIYHADCHIEGPQERARVAHAAATAAASLRLATGLGTMNYPTILPSGVGSGKGSTSPGPKGKWAGGPPGTGGHGPLSLNSPDPYEKIPHVVGEHGLGQAPGHLSGLSVPCPLPSPPAGTLTCELKSCPYCTRALEDPEGELSGSESGDSDGRGVYEFTQDVRHGDRWDPTRPPRATDTPGPGPGSPQRRAQQRAAPGEPGWMGRLWVTFSGKLRRIVDSKYFSRGIMMAILVNTLSMGVEYHEQPEELTNALEISNIVFTSMFALEMLLKLLACGPLGYIRNPYNIFDGIIVVISVWEIVGQADGGLSVLRTFRLLRVLKLVRFLPALRRQLVVLVKTMDNVATFCTLLMLFIFIFSILGMHLFGCKFSLKTDTGDTVPDRKNFDSLLWAIVTVFQILTQEDWNVVLYNGMASTSSWAALYFVALMTFGNYVLFNLLVAILVEGFQAEGDANRSDTDEDKTSVHFEEDFHKLRELQTTELKMCSLAVTPNGHLEGRGSLSPPLIMCTAATPMPTPKSSPFLDAAPSLPDSRRGSSSSGDPPLGDQKPPASLRSSPCAPWGPSGAWSSRRSSWSSLGRAPSLKRRGQCGERESLLSGEGKGSTDDEAEDGRAAPGPRATPLRRAESLDPRPLRPAALPPTKCRDRDGQVVALPSDFFLRIDSHREDAAELDDDSEDSCCLRLHKVLEPYKPQWCRSREAWALYLFSPQNRFRVSCQKVITHKMFDHVVLVFIFLNCVTIALERPDIDPGSTERVFLSVSNYIFTAIFVAEMMVKVVALGLLSGEHAYLQSSWNLLDGLLVLVSLVDIVVAMASAGGAKILGVLRVLRLLRTLRPLRVISRAPGLKLVVETLISSLRPIGNIVLICCAFFIIFGILGVQLFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRKAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLGSVASVHSPPAESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 53003 - protein, 2353 aa, Homo sapiens
MTEGARAADEVRVPLGAPPPGPAALVGASPESPGAPGREAERGSELGVSPSESPAAERGAELGADEEQRVPYPALAATVFFCLGQTTRPRSWCLRLVCNPWFEHVSMLVIMLNCVTLGMFRPCEDVECGSERCNILEAFDAFIFAFFAVEMVIKMVALGLFGQKCYLGDTWNRLDFFIVVAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPGRRELRMPCTLGWEAYTQPQAEGVGAARNACINWNQYYNVCRSGDSNPHNGAINFDNIGYAWIAIFQVITLEGWVDIMYYVMDAHSFYNFIYFILLIIVGSFFMINLCLVVIATQFSETKQRESQLMREQRARHLSNDSTLASFSEPGSCYEELLKYVGHIFRKVKRRSLRLYARWQSRWRKKVDPSAVQGQGPGHRQRRAGRHTASVHHLVYHHHHHHHHHYHFSHGSPRRPGPEPGACDTRLVRAGAPPSPPSPGRGPPDAESVHSIYHADCHIEGPQERARVAHAAATAAASLRLATGLGTMNYPTILPSGVGSGKGSTSPGPKGKWAGGPPGTGGHGPLSLNSPDPYEKIPHVVGEHGLGQAPGHLSGLSVPCPLPSPPAGTLTCELKSCPYCTRALEDPEGELSGSESGDSDGRGVYEFTQDVRHGDRWDPTRPPRATDTPGPGPGSPQRRAQQRAAPGEPGWMGRLWVTFSGKLRRIVDSKYFSRGIMMAILVNTLSMGVEYHEQPEELTNALEISNIVFTSMFALEMLLKLLACGPLGYIRNPYNIFDGIIVVISVWEIVGQADGGLSVLRTFRLLRVLKLVRFLPALRRQLVVLVKTMDNVATFCTLLMLFIFIFSILGMHLFGCKFSLKTDTGDTVPDRKNFDSLLWAIVTVFQILTQEDWNVVLYNGMASTSSWAALYFVALMTFGNYVLFNLLVAILVEGFQAEGDANRSDTDEDKTSVHFEEDFHKLRELQTTELKMCSLAVTPNGHLEGRGSLSPPLIMCTAATPMPTPKSSPFLDAAPSLPDSRRGSSSSGDPPLGDQKPPASLRSSPCAPWGPSGAWSSRRSSWSSLGRAPSLKRRGQCGERESLLSGEGKGSTDDEAEDGRAAPGPRATPLRRAESLDPRPLRPAALPPTKCRDRDGQVVALPSDFFLRIDSHREDAAELDDDSEDSCCLRLHKVLEPYKPQWCRSREAWALYLFSPQNRFRVSCQKVITHKMFDHVVLVFIFLNCVTIALERPDIDPGSTERVFLSVSNYIFTAIFVAEMMVKVVALGLLSGEHAYLQSSWNLLDGLLVLVSLVDIVVAMASAGGAKILGVLRVLRLLRTLRPLRVISRAPGLKLVVETLISSLRPIGNIVLICCAFFIIFGILGVQLFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRSTFPSPEAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLGSVASVHSPPAESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 53004 - protein, 2188 aa, Homo sapiens
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYQLCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQATGSDTSLDASPSSSAGSLQTTLEDSLTLSDSPRRALGPPAPAPGPRAGLSPAARRRLSLRGRGLFSLRGLRAHQRSHSSGGSTSPGCTHHDSMDPSDEEGRGGAGGGGAGSEHSETLSSLSLTSLFCPPPPPPAPGLTPARKFSSTSSLAAPGRPHAAALAHGLARSPSWAADRSKDPPGRAPLPMGLGPLAPPPQPLPGELEPGDAASKRKR

SEQ ID NO: 53005 - protein, 2223 aa, Homo sapiens
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYHGKTKGQGDEGRHLGSRHCQTLHGPASPGNDHSGRELCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQATGSDTSLDASPSSSAGSLQTTLEDSLTLSDSPRRALGPPAPAPGPRAGLSPAARRRLSLRGRGLFSLRGLRAHQRSHSSGGSTSPGCTHHDSMDPSDEEGRGGAGGGGAGSEHSETLSSLSLTSLFCPPPPPPAPGLTPARKFSSTSSLAAPGRPHAAALAHGLARSPSWAADRSKDPPGRAPLPMGLGPLAPPPQPLPGELEPGDAASKRKR

SEQ ID NO: 53006 - protein, 280 aa, Homo sapiens
MLSAVARGYQGWFHPCARLSVRMSSTGIDRKGVLANRVAVVTGSTSGIGFAIARRLARDGAHVVISSRKQQNVDRAMAKLQGEGLSVAGIVCHVGKAEDREQLVAKALEHCGGVDFLVCSAGVNPLVGSTLGTSEQIWDKILSVNVKSPALLLSQLLPYMENRRGAVILVSSIAAYNPVVALGVYNVSKTALLGLTRTLALELAPKDIRVNCVVPGIIKTDFSKVFHGNESLWKNFKEHHQLQRIGESEDCAGIVSFLCSPDASYVNGENIAVAGYSTRL

SEQ ID NO: 53007 - protein, 300 aa, Homo sapiens
MLSAVARGYQGWFHPCARLSVRMSSTGIDRKGVLANRVAVVTGSTSGIGFAIARRLARDGAHVVISSRKQQNVDRAMAKLQGEGLSVAGIVCHVGKAEDREQLVAKALEHCGGVDFLVCSAGVNPLVGSTLGTSEQIWDKILSVNVKSPALLLSQLLPYMENRRGAVILVSSIAAYNPVVALGVYNVSKTALLGLTRTLALELAPKDIRVNCVVPGIIKTDFSKVVRIGFMGMSLSGRTSRNIISCRGLGSQRTVQESCPSCALQMPATSTGRTLRWQATPLGSERSGGGCVAVVPGPGA

SEQ ID NO: 53008 - protein, 283 aa, Homo sapiens
MDVLPMCSIFQELQIVHETGYFSALPSLEEYWQQTCLELERYLQSEPCYVSASEIKFDSQEDLWTKIILAREKKEESELKISSSPPEDTLISPSFCYNLETNSLNSDVSSESSDSSEELSPTAKFTSDPIGEVLVSSGKLSSSVTSTPPSSPELSREPSQLWGCVPGELPSPGKVRSGTSGKPGDKGNGDASPDGRRRVHRCHFNGCRKVYTKSSHLKAHQRTHTGEKPYRCSWEGCEWRFARSDELTRHFRKHTGAKPFKCSHCDRCFSRSDHLALHMKRHL

SEQ ID NO: 53009 - protein, 440 aa, Homo sapiens
MKMHFCIPVSQQRSDALGGRYVLYSVHLDGFLFCRVRYSQLHGWNEQLRRVFGNCLPPFPPKYYLAMTTAMAHERRDQLEQYLQNVTMDPNVLRSDVFVEFLKLAQLNTFDIATKKAYLDIFLPNEQSIRIEIITSDTAERVLEVVSHKIGLCRELLGYFGLFLIRFGKEGKLPVVKKLADFELPYVSLGSSEVENCKVGLRKWYMAPSLDSVLMDCRVAVDLLYMQAIQDIEKGWAKPTQAQRQKLEAFQKEDSQTKFLELAREVRHYGYLQLDPCTCDYPESGSGAVLSVGNNEISCCITLPDSQTQDIVFQMSRVKCWQVTFLGTLLDTDGPQRALNQNLELRFQYSEDSCWQWFVIYTKQAFLLSSCLKKMISEKMVKLAAENTEMQIEVPEQSKSKKYHIQQSQQKDYSSFLSRKSKIKIAKDDCVFGNIKEEDL

SEQ ID NO: 53010 - protein, 664 aa, Homo sapiens
MSLQRIVRVSLEHPTSAVCVAGVETLVDIYGSVPEGTEMFEVYGTPGVDIYISPNMERGRERADTRRWRFDATLEIIVVMNSPSNDLNDSHVQISYHSSHEPLPLAYAVLYLTCVDISLDCDLNCEGRQDRNFVDKRQWVWGPSGYGGILLVNCDRDDPSCDVQDNCDQHVHCLQDLEDMSVMVLRTQGPAALFDDHKLVLHTSSYDAKRAQVFHICGPEDVCEAYRHVLGQDKVSYEVPRLHGDEERFFVEGLSFPDAGFTGLISFHVTLLDDSNEDFSASPIFTDTVVFRVAPWIMTPSTLPPLEVYVCRVRNNTCFVDAVAELARKAGCKLTICPQAENRNDRWIQDEMELGYVQAPHKTLPVVFDSPRNGELQDFPYKRILGPDFGYVTREPRDRSVSGLDSFGNLEVSPPVVANGKEYPLGRILIGGNLPGSSGRRVTQVVRDFLHAQKVQPPVELFVDWLAVGHVDEFLSFVPVPDGKGFRMLLASPGACFKLFQEKQKCGHGRALLFQGVVDDEQVKTISINQVLSNKDLINYNKFVQSCIDWNREVLKRELGLAECDIIDIPQLFKTERKKATAFFPDLVNMLVLGKHLGIPKPFGPIINGCCCLEEKVRSLLEPLGLHCTFIDDFTPYHMLHGEVHCGTNVCRKPFSFKWWNMVP

SEQ ID NO: 53011 - protein, 314 aa, Homo sapiens
MDAFKGGMSLERLPEGLRPPPPPPHDMGPAFHLARPADPREPLENSASESSDTELPEKERGGEPKGPEDSGAGGTGCGGADDPAKKKKQRRQRTHFTSQQLQELEATFQRNRYPDMSMREEIAVWTNLTEPRVRVWFKNRRAKWRKRERNQQLDLCKGGYVPQFSGLVQPYEDVYAAGYSYNNWAAKSLAPAPLSTKSFTFFNSMSPLSSQSMFSAPSSISSMTMPSSMGPGAVPGMPNSGLNNINNLTGSSLNSAMSPGACPYGTPASPYSVYRDTCNSSLASLRLKSKQHSSFGYGALQGPASGLNACQYNS

SEQ ID NO: 53012 - protein, 302 aa, Homo sapiens
MEFGLLSEAEARSPALSLSDAGTPHPQLPEHGCKGQEHSDSEKASASLPGGSPEDGSLKKKQRRQRTHFTSQQLQELEATFQRNRYPDMSTREEIAVWTNLTEARVRVWFKNRRAKWRKRERSQQAELCKGSFAAPLGGLVPPYEEVYPGYSYGNWPPKALAPPLAAKTFPFAFNSVNVGPLASQPVFSPPSSIAASMVPSAAAAPGTVPGPGALQGLGGGPPGLAPAAVSSGAVSCPYASAAAAAAAAASSPYVYRDPCNSSLASLRLKAKQHASFSYPAVHGPPPAANLSPCQYAVERPV

SEQ ID NO: 53013 - protein, 1024 aa, Homo sapiens
MAQGAMRFCSEGDCAISPPRCPRRWLPEGPVPQSPPASMYGSTGSLLRRVAGPGPRGRELGRVTAPCTPLRGPPSPRVAPSPWAPSSPTGQPPPGAQSSVVIFRFVEKASVRPLNGLPAPGGLSRSWDLGGVSPPRPTPALGPGSNRKLRLEASTSDPLPARGGSALPGSRNLVHGPPAPPQVGADGLYSSLPNGLGGPPERLATLFGGPADTGFLNQGDTWSSPREVSSHAQRIARAKWEFFYGSLDPPSSGAKPPEQAPPSPPGVGSRQGSGVAVGRAAKYSETDLDTVPLRCYRETDIDEVLAEREEADSAIESQPSSEGPPGTAYPPAPRPGPLPGPHPSLGSGNEDEDDDEAGGEEDVDDEVFEASEGARPGSRMPLKSPVPFLPGTSPSADGPDSFSCVFEAILESHRAKGTSYTSLASLEALASPGPTQSPFFTFELPPQPPAPRPDPPAPAPLAPLEPDSGTSSAADGPWTQRGEEEEAEARAKLAPGREPPSPCHSEDSLGLGAAPLGSEPPLSQLVSDSDSELDSTERLALGSTDTLSNGQKADLEAAQRLAKRLYRLDGFRKADVARHLGKNNDFSKLVAGEYLKFFVFTGMTLDQALRVFLKELALMGETQERERVLAHFSQRYFQCNPEALSSEDGAHTLTCALMLLNTDLHGHNIGKRMTCGDFIGNLEGLNDGGDFPRELLKALYSSIKNEKLQWAIDEEELRRSLSELADPNPKVIKRISGGSGSGSSPFLDLTPEPGAAVYKHGALVRKVHADPDCRKTPRGKRGWKSFHGILKGMILYLQKEEYKPGKALSETELKNAISIHHALATRASDYSKRPHVFYLRTADWRVFLFQAPSLEQMQSWITRINVVAAMFSAPPFPAAVSSQKKFSRPLLPSAATRLSQEEQVRTHEAKLKAMASELREHRAAQLGKKGRGKEAEEQRQKEAYLEFEKSRYSTYAALLRVKLKAGSEELDAVEAALAQAGSTEDGLPPSHSSPSLQPKPSSQPRAQRHSSEPRPGAGSGRRKP

SEQ ID NO: 53014 - protein, 172 aa, Homo sapiens
MLHLHGWQTMQGRKMGHPPVSPSAPAPAGTTAIPGLIPDLVAGTPWPRWALIAGALAAGVLLVSCLLCAACCCCRRHRKKPRDKESVGLGSARGTTTTHLVQPDVDGLESSPGDAQQWGRLQLSLEFDFGSQEVKGPAAQDQRFCEFPERVTGEGQTPCPGWWGADRAGALG

SEQ ID NO: 53015 - protein, 121 aa, Homo sapiens
MRIMLLFTAILAFSLAQSFGAVCKEPQEEVVPGGGRSKRDPDLYQLLQRLFKSHSSLEGLLKALSQASTDPKESTSPEKRDMHDFFVGLMGKRSVQPDSPTDVNQENVPSFGILKYPPRAE

SEQ ID NO: 53016 - DNA, 20 bp, Homo sapiens
gatcctaactctcaaatacc

SEQ ID NO: 53017 - DNA, 20 bp, Homo sapiens
gatcaagcagaagtttgggt

SEQ ID NO: 53018 - DNA, 20 bp, Homo sapiens
gatcatgaaggacacgctgc

SEQ ID NO: 53019 - DNA, 20 bp, Homo sapiens
gatcaagcaggtgtggcaag

SEQ ID NO: 53020 - DNA, 20 bp, Homo sapiens
gatcagccaaatctacaagc

SEQ ID NO: 53021 - DNA, 20 bp, Homo sapiens
gatccaattaacatgtgggg

SEQ ID NO: 53022 - DNA, 20 bp, Homo sapiens
gatcaaaccggcatggttcc

SEQ ID NO: 53023 - DNA, 20 bp, Homo sapiens
gatcagaggaatctgtatag

SEQ ID NO: 53024 - DNA, 20 bp, Homo sapiens
gatcgggaggaccagtccat

SEQ ID NO: 53025 - DNA, 20 bp, Homo sapiens
gatcgtcgacatgtacaagg

SEQ ID NO: 53026 - DNA, 20 bp, Homo sapiens
gatctgggaccaacaaggca

SEQ ID NO: 53027 - DNA, 20 bp, Homo sapiens
gatccaccaaggcagctcac

SEQ ID NO: 53028 - DNA, 20 bp, Homo sapiens
gatcgccgtgtggaccaacc

SEQ ID NO: 53029 - DNA, 20 bp, Homo sapiens
gatcgggcactcagtggagc

SEQ ID NO: 53030 - DNA, 20 bp, Homo sapiens
gatcctctacctgcagaagg

SEQ ID NO: 53031 - DNA, 20 bp, Homo sapiens
gatcaaggacggccgtggcc

SEQ ID NO: 53032 - DNA, 20 bp, Homo sapiens
gatctgcagcatgttctgga

SEQ ID NO: 53033 - DNA, 20 bp, Homo sapiens
gatcctaaggaatcaacatc

SEQ ID NO: 53034 - DNA, 20 bp, Homo sapiens
gatcccacctcccattcaca

SEQ ID NO: 53035 - DNA, 20 bp, Homo sapiens
gatcccaatgtccacactcc

SEQ ID NO: 53036 - DNA, 1459 bp, Homo sapiens
cggcgggctggcctggcgcgctgcggcgctcgctcacccgctcccgaggaagggcagtgggccccgccgccgcctcccaatggcgaggctgcgggattgcctgccccgcctgatgctcacgctccggtccctgctcttctggtccctggtctactgctactgcgggctctgcgcctccatccacctgctcaaacttttgtggagcctcggcaaggggccggcgcagaccttccggcggcccgcccgggagcaccctcccgcgtgcctgagcgacccctccttgggcacccactgctacgtgcggatcaaggattcagggttaagatttcactatgttgctgctggagaaagaggcaaaccacttatgctgctgcttcatggatttccagaattctggtattcttggcgttaccaactgagagaatttaaaagtgaatatcgagttgtagcactggatttgagaggttatggagaaacagatgctcccattcatcgacagaattataaattggattgtctaattacagatataaaggatattttagattctttagggtatagcaaatgtgttcttattggccatgactgggggggcatgattgcttggctaattgccatctgttatcctgaaatggtgatgaagcttattgttattaacttccctcatccaaatgtatttacagaatatattttacgacaccctgctcagctgttgaaatccagttattattacttcttccaaataccatggttcccagaatttatgttctcaataaatgatttcaaggttttgaaacatctgtttaccagtcacagcactggcattggaagaaaaggatgccaattaacaacagaggatcttgaagcttatatttatgtcttttctcagcctggagcattaagtggcccaattaaccattaccgaaatatcttcagctgcctgcctctcaaacatcacatggtgaccactccaacactactactgtggggagagaatgacgcattcatggaggttgagatggctgaagtcacaaagatttttgttaaaaactatttcaggctaactattttgtcagaagccagtcattggcttcagcaagaccaacctgacatagtgaacaaattgatatggacatttctaaaagaagaaacaagaaaaaaagattgacttttctttatcttctatgaagggtctgtaatgaaatctctaaataatttttaaaaattgttcatcaacttctttatgttttattagaaaaaaactgttttaatgtgctttatcataaataaatatcctgacaaatggtattgaaaaaaatctgagatcatgtgaacatataatacaatgttgattttcttctggtgtattttgcacagacaagcatctgccttaaaatatatacacttgtacaaaaagggaaaaaaaaaaaaaaaaaaaaaaaaaaaaaaaaaaaaaaaa

SEQ ID NO: 53037 - DNA, 2368 bp, Homo sapiens
ccggacgacaacagcagcagcaacaacgcggcagccgccaccatggccctgcaggctgattttgacagggctgcagaagatgtgaggaagctgaaagcaagaccagatgatggagaactgaaagaactctatgggctttacaaacaagcaatagttggagacattaatattgcgtgtccaggaatgctagatttaaaaggcaaagccaaatgggaagcatggaacctcaaaaaagggttgtcgacggaagatgcgacgagtgcctatatttctaaagcaaaggagctgatagaaaaatacggaatttagaatacagcatatgaggaatttttccttttgaagacttccaaatgctatcatgacctaacatttagagggagaggcatactgttaacttgatgtatcatgtatatttttgctattagcatgagctgtagtacttagaagtatactgaaactacatagttaactcaattgtacttgcttaaaccaggtgtctttaaaagttctttttaagaaaatgtggcacatatacaccatggaatactatggagccataaaaagggatgagttcatgtcctttgcagggacatggatgaagctggaaaccatcattctcagcaaactatcacaagatcagaaaaccaagcatgttctcactcataagtgggagttgaacaatgagaacacatggacacagggaagggaacatcacacactggggcctgtcggggactagggggttaggggagggataacattaggagacatacctgatgtaggtgaccggttgatgggtacagcaaaccaccatggcacatgtatacctatgtaacaaaactgcacgttctgcatatgtatcccagaacttaaagtataaaaaaaaaaattcttttagaaaagtattttttatttttatagagttagggagtacagttgcagtttttgtttgtttgtttgttttttcttgaggagtctcactctgtcacccaggctggagtgcagtcgtgtgatctcggttcactgcaacctccgcctcctgggttcaagtgattctcttgcctcagcctcccgagtagctgggattacaggtgcttgccaccatggctggctaatttttgtatttttagtagagacggggttttgccatgttggccaggctggtctcgaactcctgacctcaggtgatctgcccaccttggcgctggggttgcaggtgtgagccaccacacctggtcacaggtgcagttttgttacatggatatattgtgtagtggggaaatctgggcttttagtgtaaccatcaccaaaatactgtacattgtacccaaaaaaaaaaaaaaaattacaagtctgtccatagcagtttaaagaaatttaaaaagcccccataggaatatctatttttctttaaatttttacatttaagacatttaagacaaaaaggcaaactaaaatgtatctagtgataaactgtaccactactgtaccccatatgttcagttctatctgagtaaaaatagagtctggaatataatattggccccctactcagtctttctggatggtacacaggctctttgaaagaagacagtctcatgttaacaattcaaaaaattgtttgagatcccttaagataaatatcccccaaaacagtgtacctctattccctgcataaaaatttagatttggaatggtatgaccagaggaatagatccacttcatgttactacaacaacaaaactatctaggtctgctagatgaatttccagggaattatgctgagcagaaaaagccagtccccaaatgtgacatgtataattccatttatataacattctttttcttttctttttttttttttttttttttgttgagacaggctgtcactctgttacccaggctggagcgcagtggcacgctctcggctcactgcaacctctgcctcccagggtcaagcaatcctcccatctcagcctccagagtagctgggactacaggtgcgtgcaaccatgcccagctaatttttgtatttttcatagagacagggtttcaccatgttgcccaggctggtctggaactcctgatctgaggtgatctacccaccttggccccccaaagtgctgagactataggcatgagccaccgcgtccagccaggattcttgaaagggaacatttatagacgcaaaggatggaatagtggttgccagggaggagggaggtgggtgtggctttaaaagggcagcaggagggatgatcctgcagtgatggaatgttctgtcttgattgtagcaacaccaatatgctgattgtgatattatactatagttttgcataacagttaccattaaaggaaattgggtaaa

SEQ ID NO: 53038 - DNA, 2368 bp, Homo sapiens
ccggacgacaacagcagcagcaacaacgcggcagccgccaccatggccctgcaggctgattttgacagggctgcagaagatgtgaggaagctgaaagcaagaccagatgatggagaactgaaagaactctatgggctttacaaacaagcaatagttggagacattaatattgcgtgtccaggaatgctagatttaaaaggcaaagccaaatgggaagcatggaacctcaaaaaagggttgtcgacggaagatgcgacgagtgcctatatttctaaagcaaaggagctgatagaaaaatacggaatttagaatacagcatatgaggaatttttccttttgaagacttccaaatgctatcatgacctaacatttagagggagaggcatactgttaacttgatgtatcatgtatatttttgctattagcatgagctgtagtacttagaagtatactgaaactacatagttaactcaattgtacttgcttaaaccaggtgtctttaaaagttctttttaagaaaatgtggcacatatacaccatggaatactatggagccataaaaagggatgagttcatgtcctttgcagggacatggatgaagctggaaaccatcattctcagcaaactatcacaagatcagaaaaccaagcatgttctcactcataagtgggagttgaacaatgagaacacatggacacagggaagggaacatcacacactggggcctgtcggggactagggggttaggggagggataacattaggagacatacctgatgtaggtgaccggttgatgggtacagcaaaccaccatggcacatgtatacctatgtaacaaaactgcacgttctgcatatgtatcccagaacttaaagtataaaaaaaaaaattcttttagaaaagtattttttatttttatagagttagggagtacagttgcagtttttgtttgtttgtttgttttttcttgaggagtctcactctgtcacccaggctggagtgcagtcgtgtgatctcggttcactgcaacctccgcctcctgggttcaagtgattctcttgcctcagcctcccgagtagctgggattacaggtgcttgccaccatggctggctaatttttgtatttttagtagagacggggttttgccatgttggccaggctggtctcgaactcctgacctcaggtgatctgcccaccttggcgctggggttgcaggtgtgagccaccacacctggtcacaggtgcagttttgttacatggatatattgtgtagtggggaaatctgggcttttagtgtaaccatcaccaaaatactgtacattgtacccaaaaaaaaaaaaaaaattacaagtctgtccatagcagtttaaagaaatttaaaaagcccccataggaatatctatttttctttaaatttttacatttaagacatttaagacaaaaaggcaaactaaaatgtatctagtgataaactgtaccactactgtaccccatatgttcagttctatctgagtaaaaatagagtctggaatataatattggccccctactcagtctttctggatggtacacaggctctttgaaagaagacagtctcatgttaacaattcaaaaaattgtttgagatcccttaagataaatatcccccaaaacagtgtacctctattccctgcataaaaatttagatttggaatggtatgaccagaggaatagatccacttcatgttactacaacaacaaaactatctaggtctgctagatgaatttccagggaattatgctgagcagaaaaagccagtccccaaatgtgacatgtataattccatttatataacattctttttcttttctttttttttttttttttttttgttgagacaggctgtcactctgttacccaggctggagcgcagtggcacgctctcggctcactgcaacctctgcctcccagggtcaagcaatcctcccatctcagcctccagagtagctgggactacaggtgcgtgcaaccatgcccagctaatttttgtatttttcatagagacagggtttcaccatgttgcccaggctggtctggaactcctgatctgaggtgatctacccaccttggccccccaaagtgctgagactataggcatgagccaccgcgtccagccaggattcttgaaagggaacatttatagacgcaaaggatggaatagtggttgccagggaggagggaggtgggtgtggctttaaaagggcagcaggagggatgatcctgcagtgatggaatgttctgtcttgattgtagcaacaccaatatcctgattgtgatattatactatagttttgcataacagttaccattaaaggaaattgggtaaa

SEQ ID NO: 53039 - DNA, 2747 bp, Homo sapiens
ctcttccacatcaccttggtgtctccctaaataaaaccagccctccttatcgcctggaaaaaatcaagagctagagtttgaatgggttttatataaacactcacccctgtcagcgtgcggctgggctctcaggataaactcacagcatctggcgcgatgcttgccttgcgttctctcccctgaacgtcaaggtttaagcagagcccgaggactgggagctcttctctgaaattcgatcaacctgaagccagttgcggaactgcacggggtcccgatggacctcaaggaaagccccagtgagggcagcctgcaaccttctagcatccagatctttgccaacacctccaccctccatggcatccgccacatcttcgtgtatgggccgctgaccatccggcgtgtgctgtgggcagtggccttcgtgggctctctgggcctgctgctggtggagagctctgagagggtgtcctactacttctcctaccagcatgtcactaaggtggacgaagtggtggctcaaagcctggtcttcccagctgtgaccctctgtaacctgaatggcttccggttctccaggctcaccaccaatgacctgtaccatgctggggagctgctggccctgctggatgtcaacctgcagatcccggacccccatctggctgacccctccgtgctggaggccctgcggcagaaggccaacttcaagcactacaaacccaagcagttcagcatgctggagttcctgcaccgtgtgggccatgacctgaaggatatgatgctctactgcaagttcaaagggcaggagtgcggccaccaagacttcaccacagtgtttacaaaatatgggaagtgttacatgtttaactcaggcgaggatggcaaacctctgctcaccacggtcaagggggggacaggcaacgggctggagatcatgctggacattcagcaggatgagtacctgcccatctggggagagacagaggaaacgacatttgaagcaggagtgaaagttcagatccacagtcagtctgagccacctttcatccaagagctgggctttggggtggctccagggttccagacctttgtggccacacaggagcagaggctcacatacctgcccccaccgtggggtgagtgccgatcctcagagatgggcctcgacttttttcctgtttacagcatcaccgcctgtaggattgactgtgagacccgctacattgtggaaaactgcaactgccgcatggttcacatgccaggggatgcccctttttgtacccctgagcagcacaaggagtgtgcagagcctgccctaggtctgttggcggaaaaggacagcaattactgtctctgcaggacaccctgcaacctaacccgctacaacaaagagctctccatggtgaagatccccagcaagacatcagccaagtaccttgagaagaaatttaacaaatcagaaaaatatatctcagagaacatccttgttctggatatattttttgaagctctcaattatgagacaattgaacagaagaaggcgtatgaagttgctgccttacttggtgatattggtggtcagatgggattgttcattggtgctagtatccttacaatactagagctctttgattatatttatgagctgatcaaagagaagctattagacctgcttggcaaagaggaggacgaagggagccacgatgagaatgtgagtacttgtgacacaatgccaaaccactctgaaaccatcagtcacactgtgaacgtgcccctgcagacgaccctggggaccttggaggagattgcctgctgacacccctcgagtcacccagcactccctccaaacagaccttgaggcccaagacccaggacaaggaacagcaagctcaggtgggatggccccagtgctggaaagaagcaagagccccctatgcacacattgcagactagctgcctagacctcgctccggccacgtccaacacgacgcatccttgggccccgccgtgcgtccctcttaggagagatgagtcacactctggaactgtccaagaacgaacctgccatcacatctcactgccagatgtataaagcacctgcatgctcagacttcttgtggcgccacctccacgtctgtcttgtacatgacactcctccacgcggtttccagtgtccacactgctgcccgtgcagtgggaccagattccaggtccaaagtcaccatgaggccaccctggaatcagaactgcacaatcaagagggaacccatgggactctctgctacattcagttcttgtgtcgtttgtgaaagttcttaacctgcccaaaaacccccttttccccaagctgcccatggggcttcggcgccaaaggtgacccgcgccaacctccctcccccccagtgcctatgacggcggcacagcagccagcgggtgggggacgcctgtgttcacccatggtgcccatgtcgttcttctctccctgtgacacagcttgtacagtctgattctttttatctggggtaggggggcttttatgtttgtccgatggagatttgttttgttttgcttcattttatgcttttttattttagttttgatgttctgaggtttgctttggtttttccattttctttggcatttatttattcgtgcttcaaatcacagtcatattaaaagctggtcttgtggaaaaaaaaaaaaaaaaaaaaaaaaaaaaaaaaaaaaaaaaaaaaaaaaaaaaaaaaaaa

SEQ ID NO: 53040 - DNA, 3470 bp, Homo sapiens
cacctgggagagccgaggcgagaagcgacacttccctgcggctagcatccttgaaggaccccggcggcgaacagcctcccgcaggacgccctgagaagctctcagccccaggcgagagcgggcgcctggcaggacttaggcgcaggacttggggaagcctaagcaggtctctgccgagcgcagcccagggagcagtaacaaggaagggtcctggaggggaagggaaagaaggcggcagccggcaaggcgaccactcacccccgtacacacccaccccgcccgcccagccaggagccgcggtgcgcctctgggggcgctcgttccttggcgccttctctcccgtgtcccagcaccgctgggctacgggccgggctggtggggtccctggggatgtccagatcaggcatggtggccgagtggcccttctcccaggaccagcgtaaaagctggggttaggcggggcaggggggactcggctcagggtcccccgaggtccaggacgagggaaggcgggcgcagcacccagggactggagaggcggctcccagtgggacccctccagaagtagtgccgggcgccgggcatcctccaggaagaccaggggccgggaaagcctgggaggcgctcgggagaggccactgccaggggctgcgggctgaggcggcgctcagccccgggcgggcgcccgcggaggcggcagcggcggcgccgggcgggcatgccgcgccaccggagctcctttcgggcgcacgcttccctggcgcgggctgcgcgcggctgccgctgctgctgcttccactgctgctgcggactcccatggcggctccgcccggccggggccgccgccgctgccgccagccgcgggctgaatgaatgagccggattggcggagccgggctgcccgcagccgcgctcaccggcccgggacgcttccgcatggcccgcgaggagccggcgcccgcggcgttggcggctgccgggcagcccgggggcggcagaggcggcgagcgggcgctgcaggggccaggggtcgcccgcagggggcggccatcgctgagccgcgctaaactgcacgggctgcggcacatgtgtgccgggcgcacggcggctgggggctccttccagcggcgggcgctgtgggtgctggccttctgtacatccttcggcttgctgctgtcctggtcctcgaaccgcttgctctactggctcagcttcccgtcacacacgcgggtgcaccgcgagtggagccgccagttacccttccccgccgtcactgtgtgcaacaacaacccgctgcgcttcccgcgcctctccaagggggacctctactatgccggccactggctcgggctgctgctgcccaaccgcaccgcgcgcccgcttgtcagcgagctgctgcggggcgacgagccgcgccgccagtggttccgcaagctggcggacttccgcctcttcctgcctccgcgccacttcgagggaatcagcgccgccttcatggaccgcctgggccaccagctggaggacatgctgctctcctgcaagtaccgcggcgagctctgcgggccgcacaacttctcctccgtgtttacaaaatatgggaagtgttacatgtttaactcaggcgaggatggcaaacctctgctcaccacggtcaagggggggacaggcaacgggctggagatcatgctggacattcagcaggatgagtacctgcccatctggggagagacagaggaaacgacatttgaagcaggagtgaaagttcagatccacagtcagtctgagccacctttcatccaagagctgggctttggggtggctccagggttccagacctttgtggccacacaggagcagaggctcacatacctgcccccaccgtggggtgagtgccgatcctcagagatgggcctcgacttttttcctgtttacagcatcaccgcctgtaggattgactgtgagacccgctacattgtggaaaactgcaactgccgcatggttcacatgccaggggatgcccctttttgtacccctgagcagcacaaggagtgtgcagagcctgccctaggtctgttggcggaaaaggacagcaattactgtctctgcaggacaccctgcaacctaacccgctacaacaaagagctctccatggtgaagatccccagcaagacatcagccaagtaccttgagaagaaatttaacaaatcagaaaaatatatctcagagaacatccttgttctggatatattttttgaagctctcaattatgagacaattgaacagaagaaggcgtatgaagttgctgccttacttggtgatattggtggtcagatgggattgttcattggtgctagtatccttacaatactagagctctttgattatatttatgagctgatcaaagagaagctattagacctgcttggcaaagaggaggacgaagggagccacgatgagaatgtgagtacttgtgacacaatgccaaaccactctgaaaccatcagtcacactgtgaacgtgcccctgcagacgaccctggggaccttggaggagattgcctgctgacacccctcgagtcacccagcactccctccaaacagaccttgaggcccaagacccaggacaaggaacagcaagctcaggtgggatggccccagtgctggaaagaagcaagagccccctatgcacacattgcagactagctgcctagacctcgctccggccacgtccaacacgacgcatccttgggccccgccgtgcgtccctcttaggagagatgagtcacactctggaactgtccaagaacgaacctgccatcacatctcactgccagatgtataaagcacctgcatgctcagacttcttgtggcgccacctccacgtctgtcttgtacatgacactcctccacgcggtttccagtgtccacactgctgcccgtgcagtgggaccagattccaggtccaaagtcaccatgaggccaccctggaatcagaactgcacaatcaagagggaacccatgggactctctgctacattcagttcttgtgtcgtttgtgaaagttcttaacctgcccaaaaacccccttttccccaagctgcccatggggcttcggcgccaaaggtgacccgcgccaacctccctcccccccagtgcctatgacggcggcacagcagccagcgggtgggggacgcctgtgttcacccatggtgcccatgtcgttcttctctccctgtgacacagcttgtacagtctgattctttttatctggggtaggggggcttttatgtttgtccgatggagatttgttttgttttgcttcattttatgcttttttattttagttttgatgttctgaggtttgctttggtttttccattttctttggcatttatttattcgtgcttcaaatcacagtcatattaaaagctggtcttgtggaaaaaaaaaaaaaaaaaaaaaaaaaaaaaa

SEQ ID NO: 53041 - DNA, 2867 bp, Homo sapiens
aaggctagcctctctcagtgggtgactgagctgtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagctcactgactgacaggcagccactctccaaagagtccctgaaccatgctctcgagctctcagtgccagagaaggtgaataatgcccagtgggatgctccagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaaactgctgctgcctgtttgattctatttaatgtataatttgaatattaaaccttttaacagaactgtcaaaaaaaaaaaaaaaaaaaaaaaaaaaaaaaaaaaaaaa

SEQ ID NO: 53042 - DNA, 1495 bp, Homo sapiens
cccgggagctgtccggccgcctcggtgctgatcccgccaccgcccacgggccgctagcagcgcagcgggcactatgagcgggggcgtctacggcggagatgaggtgggggcgctggtctttgacattggctccttctcagtccgcgctgggtacgctggggaggactgtcccaaggctgacttccccaccacagtggggctgctggccgcggaggaggggggcgggctggagctggagggggacaaagagaagaaagggaagatcttccacatcgacaccaatgccctgcacgtgcctcgggatggagcggaggtcatgtcgcccctcaagaatggcatgatcgaggactgggagtgcttccgagccatcctggatcacacctacagcaaacacgtcaagtctgagccaaacctgcacccagtgctcatgtccgaggctccgtggaacacacgggccaagcgggagaagctgacagagctgatgttcgagcagtacaacattcctgccttcttcttatgcaagacggctgtgctcaccgcctttgcaaacgggcggtccactggcctcgtgctggacagtggagccacccacaccacggccattccagtacatgacggctacgttctgcagcaaggcatcgtcaagtcccctctggcaggggacttcatctccatgcagtgccgggagctgttccaggagatggccattgacatcatcccaccttacatgatcgcagccaaggagcctgtccgggagggtgcccccccaaactggaagaagaaggagaagctaccccaggtctccaagtcctggcataactacatgtgtaatgaggtgatccaggacttccaggcctccgtgctgcaggtctcagactccccctacgatgaacaggtggctgcacaaatgcccacagtgcactacgagatgcccaatggctacaatacagactacggcgccgagcgactccgcatccctgagggcctgtttgatccctcgaacgtcaagggcctgtcggggaacaccatgttgggtgtgggccacgtggtgaccaccagcatcggcatgtgtgacattgatattcgcccgggcctgtacgggagtgtcattgtcaccggcgggaacacactgctgcagggcttcactgacaggctcaatcgagagctttcccagaagaccccaccgagcatgcgactgaaactcattgccagcaacagcaccatggagcgcaagttcagcccctggatcgggggttccatcctggcctcactgggcactttccagcagatgtggatctccaagcaggaatatgaggagggcgggaagcagtgcgtggagcgaaagtgcccctgatggcactcctccccacacacctgctcccaagctcagatggaagtcccttaacccccatgccacattgcccccctcctcctttccctcttgtcctcataaatggtgatgtttctgggttgaaagaagtaaaaatgttttaag

SEQ ID NO: 53043 - DNA, 4402 bp, Homo sapiens
  misc_feature 1065: n = A,T,C or G
atgaggctgctgcggcgctgggcgttcgcggctctgctgctgtcgctgctccccacgcccggtcttgggacccaaggtcctgctggagctctgcgatgggggggcttaccccagctgggaggcccaggagcccctgaggtcacggaacccagccgtctggttagggagagctccgggggagaggtccgaaagcagcagctggacacaagggtccgccaggagccaccagggggcccgcctgtccatctggcccaggtgagtttcgtcatcccagccttcaactcaaacttcaccctggacctggagctgaaccaccacctcctctcctcgcaatacgtggagcgccacttcagccgggaggggacaacccagcacagcaccggggctggagaccactgctactaccaggggaagctccgggggaacccgcactccttcgccgccctctccacctgccaggggctgcatggggtcttctctgatgggaacttgacttacatcgtggagccccaagaggtggctggaccttggggagcccctcagggaccccttccccacctcatttaccggacccctctcctcccagatcccctcggatgcagggaaccaggctgcctgtttgctgtgcctgcccagtcggctcctccaaaccggccgaggctgagaaggaaaaggcaggtccgccggggccaccctacagtgcacagtgaaaccaagtatgtggagctaattgtgatcaacgaccaccagctgttcgagcagatgcgacagtcggtggtcctcaccagcaactttgccaagtccgtggtgaacctggccgatgtgatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgggcaggaccttccagagcacgagcagcggggcagcctacgtggggggcatatgctccctgtcccatggcggnggtgtgaacgagtacggcaacatgggggcgatggccgtgacccttgcccagacgctgggacagaacctgggcatgatgtggaacaaacaccggagctcggcaggggactgcaagtgtccagacatctggctgggctgcatcatggaggacactgggttctacctgccccgcaagttctcgcgctgtagcatcgacgagtacaaccagtttctgcaggagggtggtggcagctgcctcttcaacaagcccctcaagctcctggaccccccagagtgcgggaacggcttcgtggaggcaggggaggagtgcgactgcggctcggtgcaggagtgcagccgcgcaggtggcaactgctgcaagaaatgcaccctgactcacgacgccatgtgcagcgacgggctctgctgtcgccgctgcaagtacgaaccacggggtgtgtcctgccgagaggccgtgaacgagtgcgacatcgcggagacctgcaccggggactctagccagtgcccgcctaacctgcacaagctggacggttactactgtgaccatgagcagggccgctgctacggaggtcgctgcaaaacccgggaccggcagtgccaggttctttggggccatgcggctgctgatcgcttctgctacgagaagctgaatgtggaggggacggagcgtgggagctgtgggcgcaagggatctggctgggtccagtgcagtaagcaggacgtgctgtgtggcttcctcctctgtgtcaacatctctggagctcctcggctaggggacctggtgggagacatcagtagtgtcaccttctaccaccagggcaaggagctggactgcaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtctgcagcaatgaagggaagtgcatctgtcagccagactggacaggcaaagactgcagtatccataaccccctgcccacgtccccacccacgggggagacggagagatataaaggtcccagcggcaccaacatcatcattggctccatcgctggggctgtcctggttgcagccatcgtcctgggcggcacgggctggggatttaaaaacattcgccgaggaaggtccggaggggcctaagtgccaccctcctccctccaagcctggcacccaccgtctcggccctgaaccacgaggctgcccccatccagccacggagggaggcaccatgcaaatgtcttccaggtccaaacccttcaactcctggctccgcaggggtttgggtgggggctgtggccctgcccttggcaccaccagggtggaccaggcctggagggcacttcctccacagtcccccacccacctcctgcggctcagccttgcacacccactgccccgtgtgaatgtagcttccacctcatggattgccacagctcaactcgggggcgcctggagggatgcccccaggcagccaccagtggacctagcctggatggcccctccttgcaaccaggcagctgagaccagggtcttacctctctgggacctagggggacggggctgacatctacattttttaaaactgaatcttaatcgatgaatgtaaactcgggggtgctggggccagggcagatgtggggatgttttgacatttacaggagggcccggagaaactgaggtatggccatgccctagaccctccccaaggatgaccacacccgaagtcctgtcactgagcacagtcaggggctgggcatcccagcttgcccccgcttagccccgctgagcttggaggaagtatgagtgctgattcaaaccaaagctgcctgtgccatgcccaaggcctaggttatgggtacggcaaccacatgtcccagatcgtctccaattcgaaaacaaccgtcctgctgtccctgtcaggacacatggattttggcagggcggggggggttctagaaaatatagttcctataataaaatggcaccttccccctttcaagaagggtgattctggggccgactcagggtttaggtgccccctggtgtggcctagatgtccccacctgggccatctttctggggaggactctcccaggtagggaaggccagaggtggcccagtgcctggagggttagggtctctgcctgggatatgcaagaggaagtaggaaagggaggtctcatggatgatcctaggctgctagaagtccttaaggccccatctagtccattccactccctacccccattccagagccgagtagtaagtttacagatgtttcccccattacgtacccccacccatccctgctgcagcgagcctgagagccaggtagagccaggcacagctcctcagtcttctcacacagtcctgccggtggccttccctcatgacccttgcttgggagggtggagcactggctccttgaccctaaaaggtagctggcaggggcaagatgggggccagctacctaatggatgaaagccacaagtgaatacagttcttgtcaccagggttgccctgccctcactcggcagggagttctgacaccccagggcccgtgagctacctgcttgagcccctgtttctggggcaccttcgaggaggcgttgtggagggcatcgccccctgtttattcacaacaccctcaggggcaaacaggcctgggacccgctgacaccattttgggtagctggatgcacccgacagcagtggggtccacacactgagctccagctggcactgcccactcaagggctgagtggaggggcccctccggccagctctgctccaccagccctgcaagctgatgcagggcgggggaagggctgggtgttgcactattgctgcgctgccttaaggcatctgtcctctggtggtgcacccgtgcacacaggtacagtgcatctgggcacagcttttggatccacacctctgcacaagtgtgaatacctctgcacatatgggcgtatctgtgtgtgctcgtgtatatggggtggggaacatgagacttcctgtgaccagtccaccctggctcccagctgtctgtatcctcctgccccgccctggcgagtgcctaccctggcagaacccagggaggagtggaggctgcctctgcctgggcctccacacagcatcctgtacatacgccacctgggctgggggtggggaggcagggccaggagcatcgattaaagatcacatcctggggcttccagggagctcacaccaa

SEQ ID NO: 53044 - DNA, 13746 bp, Homo sapiens
cgccgcctgtgcagccgctgccgccgccgccgccgccgccgccgccgccgccgccgccgccgccgctgccgccccggctgccgcgccgcgccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaaggtagctgaatatacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggagatgacccattcctggcctactcctctcacttccatgcatactgctggacactctgagcagagcaccttttccatcccaggacaggaatcgcagcatctgaccccaggattcaccttacaaaagtggaatgacccaaccaccagagcttctacaaagtcagtgtctttcaaatcgatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagatatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcctgtagactgttaattacttaataatctcattgggaaaatactagtagttttatatttggatgacataattggaaaagcagattagctgctactacttttaaaagacttaaggtcgggatgcctttttttccatgtaaggaaatgaaaagaccaaaatcttcaggcaaaaagcaagttgcaaaattagaaaccattggctaaaaatgtgttttgttgagtttccaaatggatgaattttcatttggacattacatcactaaattcattagattttgtctgcattggaaagatactcttctagcatatctttcccaaagatatctaatttggattctgtttcatgcaaatttgcatcccggaggttgaagttggagtttgaggttggaaaatatctttgaaggcagaatcagttgagttgtgagggtgaagcctcacatacttctcaacagacatgataaaattcacctgcatgagttggcaggtgggagaaccaaactggatcactgggtaagactactcagtaaagcaatgaactgcttgcttagagaagcatcactatccccattgagaaaaatgtgtggcaagatgatacagctacacagtatcaaatgaatgggtcaattcagcacccccaaatttaattctgtggggaaaaattattgagccagttgtcagtgttctgttacatgactggcagactaaattcttcatcgttgttgttattgttgttgttgtttctcattttcactcgcacggccttattctcataattaaaatctaattcattttctctttagtgttagtagactccaacaacagaagtggcatctgtgtattcataatcagcatttaccctggcaggagactaatcagataggccggtctcagacattaatcctaccatctgatatttttggtgaaggaaaaagtattaattctctttccatcctcctcctcagaaatatagaagccctctttaccaaaatcatcacattttactctgtaatctaccagctaaaagaaaattgcattgtggggagggcagaaagggggtgggggtgggggtgggggggtggggggtggggaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagacatcctctttgggatcagaagatacctaaaattctccccttttgcccacttggttagatgagtgatatattctttggatcctgcaaagaagagattggtttcttttcttttctggtggtggtagtggttgtatctgtggctgtgatggttgttgttacttgtctctctctctctctggctctggcttttgctttcctgctagtgttctttctctttccaaacaaatagttaaattaaacgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacgcacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcagctggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctca

SEQ ID NO: 53045 - DNA, 2107 bp, Homo sapiens
acgccaccggtgacctccgacgccccgggcaagagaacgccaggagggataacgggaggaaggccggccggggccgccaaggcagtcccaggctcgcgtaggaggcgcgcagaccttgcaccttgcaccttcgcagcgccctgcaccacgccaccatgtgcgagctgtacagtaagcgggacactctggggctgaggaagaagcacatcgggccctcatgcaaagttttctttgcatcggatcccatcaaaatagtgagagcccagaggcagtacatgtttgatgagaacggtgaacagtacttggactgcatcaacaatgttgcccatgtgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaaaggtggaattgtcagtttagattcataaatgaaaaggtaaatgagtaatcagaataaaccaagtgataatcaaaccatgtcaagattattagttcagactctagcctgttaattttcttagttgatttctgaagctacctgatttattctattaaattgtaagcttgcaaactcaaaataaattggcagatttacctctcatgttttaatgtgtcaaattagagagcaaagtataacaggtgccttcacttttgagacttagtgccttaaaatatgtattctataatgatttcatatataaaagtatatttattgactgtaataaaataaaatatgatgtaaacaaaaaaaaaaaaaaaa

SEQ ID NO: 53046 - DNA, 3962 bp, Homo sapiens
agtcttccagcagggttctgaaagcagcctgctcccatcgcgcccctcggatgtggacacccagggtgggctgcagaccgcggccgggccgcactctctgggggcgagggccaggtcaggtggctgcactgtcgcccagcagcgagtaaagactcgaaactgagggagccagagccctagtcactctgctggtcgagggtcggaaccgctgggggaaagaggaaatgtggacgaaggcagcccttcctggagacagcttggaagagagggatgaagatgcaaaaagcaaaacccaacctatcaagtgccacctccccggtgacaggcccccagccttgctctgcgctttcgctgaatgaactcctgagcacgtttttcccgttgcctaggaagggttgggccgcaggtttcgccagtgctcgacaacccacctggagatagcgggtcggggagggagctgcgaggggggcggactcctgttgctcagtcttcagaccgcagcacagcatcatctgcaccgggacccgggaatggggggacacttggagactgagagagaggaggctcgaggaatgaaccttggtctgttctaagccacaacccctgtctcaggtcgtttggcttcctttccttctctttgtatttgaatttaaaaacattcctgaatctcaagtgcttttgcttgaagtaggggggaggaggagaaaagaatagaagcaagccaggcttcctaagcgagctctgaaaggagaaatccattcactgcaaacctcgttccccatttctgaaaacggatagactgatatcgtaaactaaaggtcatgagggtttttccccccggtttgggggatttgttctgttaaaaggaattttaaagcaccacttgagaaaataattttgcctcagtttccctaaactatctttaaaatgggttgccataattacaggtcttcttttctctcacctctataagccaccgttttcaggtcatctgaagtcaagatttccagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgtaatgcctgaaaactcaaactttccatatcggcggtatgaccggctccctccaatccatcaattctccatagaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaaagaagatccacagtaccagcagcaataggaaatggagtcttattgccaagataattacaactggagaattggccccacaggaaacaacaattacagagataaaacaaaaattgatgcaaatacctgatgaagagggcattgttattgatggatttccaagagatgttgcccaggctctatcttttgaggaccaaatctgtacccccgatttggtggtattcctggcttgtgctaatcagagactcaaagaaagattactgaagcgtgcagaacagcagggccgaccagacgacaatgtaaaagctacccaaaggagactaatgaacttcaagcagaatgctgctccattggttaaatacttccaggaaaaggggctcatcatgacatttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgtaaaattattttcataattggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattttctgaaggcaaaaatgcatgtttgttagaatggaaacagaaaaacattaaaaagttcattccttaacacaatgtttcaagttaaaccttttgtgtcaccgcccccaccaaccaccacctcctaaatcctgacagcactgtttgcttcccagctagacctgtgtgagaggtgtctggaaatcatgcatggtgtatttgggactatatcaacctattctccacacttcagacaactgtctgcactcacggcacacacactttgtatcatgcaggccacactcagagctagtcagtacatgaacagtggtgcggtgccagtctgtgtccgttgtgatcacaggccttgctagaccctgatcatctggttctcctctcattaagcatccctaacccccagtcacaccttcctcttacatactgttccccaatggaggcccctggcataggggacagccctgggcatcttcctttggtgtctggctgttttgtcaactctcatccactggtggctcagagccataaggtgggttgattacacaatgccttgtacatgatatagaggcatcaagcaagtaaaatttgacagaaattttaaaatatgaagatgtatagctttcccaagatgatggtaaaacccaggttagtcatcagtaaccttctctattattattattttttagaaacttggaatactgtcgtcatggctaagagaacaaatctgataaattgtgtaacctagtctcttctctacatggtgatgcatttcagcaattataaattaatataaatgaccaaaagtaacttaaaagcatgagatatttgctatttcattcattgggcacatatcaaattataattttgattttaaatggtcacccatgtatttatttgttgccaagcaagtaaaaaaataccctaacaaacctgatgtgggtgggaggggcatgtcagtaagtggtgtgttcaatgtgtttgtttcatatgggccctttccaggagtttgcaaaccttgtcatacccatatgcaaaactgtgtttccttgcattaaaccagtgaagtttgggttctcttttgtgctatcaatcagttgtaaaatcagagctgcttatatattctactggaataactgcatcttccactcagtcactacaaaaaagcatagtttcagtttgcatgaatttttttttttttcttcaatggctgtgcagataaggatccatttctgggatagaattgtattttttaagtcatttttttttcttgaaatggatatgtacaaataaaataaatggaagacaggataaaaaaaaaaaaaaaaaaaaaaaaaaaa

SEQ ID NO: 53047 - DNA, 3257 bp, Homo sapiens
cagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaaggcacgcgcggcacagccatgaacaccaacgatgccaaggagtatctggcccggagggaaatccctcagctttttgagagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgtaatgcctgaaaactcaaactttccatatcggcggtatgaccggctccctccaatccatcaattctccatagaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaaagaagatccacagtaccagcagcaataggaaatggagtcttattgccaagataattacaactggagaattggccccacaggaaacaacaattacagagataaaacaaaaattgatgcaaatacctgatgaagagggcattgttattgatggatttccaagagatgttgcccaggctctatcttttgaggaccaaatctgtacccccgatttggtggtattcctggcttgtgctaatcagagactcaaagaaagattactgaagcgtgcagaacagcagggccgaccagacgacaatgtaaaagctacccaaaggagactaatgaacttcaagcagaatgctgctccattggttaaatacttccaggaaaaggggctcatcatgacatttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgtaaaattattttcataattggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattttctgaaggcaaaaatgcatgtttgttagaatggaaacagaaaaacattaaaaagttcattccttaacacaatgtttcaagttaaaccttttgtgtcaccgcccccaccaaccaccacctcctaaatcctgacagcactgtttgcttcccagctagacctgtgtgagaggtgtctggaaatcatgcatggtgtatttgggactatatcaacctattctccacacttcagacaactgtctgcactcacggcacacacactttgtatcatgcaggccacactcagagctagtcagtacatgaacagtggtgcggtgccagtctgtgtccgttgtgatcacaggccttgctagaccctgatcatctggttctcctctcattaagcatccctaacccccagtcacaccttcctcttacatactgttccccaatggaggcccctggcataggggacagccctgggcatcttcctttggtgtctggctgttttgtcaactctcatccactggtggctcagagccataaggtgggttgattacacaatgccttgtacatgatatagaggcatcaagcaagtaaaatttgacagaaattttaaaatatgaagatgtatagctttcccaagatgatggtaaaacccaggttagtcatcagtaaccttctctattattattattttttagaaacttggaatactgtcgtcatggctaagagaacaaatctgataaattgtgtaacctagtctcttctctacatggtgatgcatttcagcaattataaattaatataaatgaccaaaagtaacttaaaagcatgagatatttgctatttcattcattgggcacatatcaaattataattttgattttaaatggtcacccatgtatttatttgttgccaagcaagtaaaaaaataccctaacaaacctgatgtgggtgggaggggcatgtcagtaagtggtgtgttcaatgtgtttgtttcatatgggccctttccaggagtttgcaaaccttgtcatacccatatgcaaaactgtgtttccttgcattaaaccagtgaagtttgggttctcttttgtgctatcaatcagttgtaaaatcagagctgcttatatattctactggaataactgcatcttccactcagtcactacaaaaaagcatagtttcagtttgcatgaatttttttttttttcttcaatggctgtgcagataaggatccatttctgggatagaattgtattttttaagtcatttttttttcttgaaatggatatgtacaaataaaataaatggaagacaggataaaaaaaaaaaaaa

SEQ ID NO: 53048 - DNA, 2285 bp, Homo sapiens
cgaggagccgcggcggctcaggagcgggtggtgggcgtctgaaaagtcgccaccatgaggaagctcttcagcttcgggagacgcctgggccaggcgctcctggactccatggaccaagagtacgctggtcgggggtaccacatccgggactgggaactgcggaagatccacagggctgccatcaagggcgacgccgcggaggtggagcactgcctgacgcgcaggttccgggacttggacgcccgcgacagaaaagacaggactgttctacatttgacctgtgcccatggccgtgtggaagtggtcaccctcttgctgagcagaagatgccagatcaacatatatgatagactaaacaggacacctttaatgaaggctgtacactgccaggaagaggcttgtgccattattctcctggaacatggcgccaatccaaacattaaggatatctacagcaacactgctctccattatgctgtgtataataaggggacttcactggcagaaaaactgctttcccaccatgcaaatattgaagcactaaacgaggagggaaacactccacttttgtttgctataaattctaggagacagcaaattgtggaatttctgttgaagaaccaggcaaatttacatgccattgacaatttcagaagaacagccctcatgcttgcagtacagcataactcatcaagtatcgtcagcctcctccttcaacaaaatataaatatcttttctcaagacctgtttggccagactgccgaggattatgctgtttgttataatttcagaagcattcaacaacaaattttggaacataaaaataagatacttaaaagtcatctttgaaatgataatcaagaaacagcagctatgaagccttgaattttgaaaaaaagacaagaaggtgcaaaagtctttaatcctggcagggattcacgggcgcacacacacacactcaggattcagatcttgttgaaagctgcgatatcgacactctgcacgtgctcctcaaacttggtgatctcctccagcaagtctgtccccaccttgtcgtcctccaccacacactgaatctgtagcttccggataccgtagcccatgggcaccagcttggaggccccctagaccagctcttccagctggatggagcacacacaggcctccagctgggccatgtcagtctcatcgtcccaaggcttgaaaatccagcaggatggaggacttggccaccagttcaggcttcttggccttcttctccgcgtactgctgcagccgctcctcctgcagctgtgccgccttcttgtcctcctcctcattgtcgctgccaaacaggaggcaccggccacaggcccattcatctgctcgtagaatctcctttctgcgtcgtcatatttgaacttgtcgaaccagatcttctcatgtactaggaagtttgtagccatttttctgacgcctgccaaggacgcgacgaccagggaggaggaatcggcggacgcgggacacctgaggaaagggtactaccttaaaaatcttttcctatagtcttggtaaattttaaatgatagctctataaatgatatttataagttatggttattttttttttagtttttcattaattttgatcaattgtatcttactagatcacccatttactgtaggtagtattctcttcctactatatttcatatctacctactacatttcatatcattcctactacatttcatatctacctacatttacatgtaggtagatatgaaatgattcaatatccatgtctccttttactcattacaaatcttacataattttgctctctcttatctctttaccttactcgggtttatgtgaggtatttagtttactaaggttttaaaatattttcatattcattttagtaggaaaaggacggattattttataaatttcattgcctgaataagtttaggtatggtttcgggtacaataagaaagagataaaatggaatgctttatgccaaacatgtttatttttatcacacagctaaagtctgtagttaagttgctgctacttttgagtcaataacatcaagaccagtgttggtgaatcttttggcctttccccaatgcttgaaagaagatcaccactgctggaggcataatgtacaaggcaggaaaagggatggaattgatggtgacagctaagtctgtcttttttcttaggaaataaaggttttcctaggataaaaaaaaaaaaaaaaaaaaaaaaaaaaaaaaaaaaaaaaaaaaaaaaaaaaaaa

SEQ ID NO: 53049 - DNA, 3192 bp, Homo sapiens
acccgccccgggagccaggaacccagggccccaccatggcgctggccgccgccgccgccgctgcggctgccggggtgagccaggcggcggtgctgggcttcctgcaggagcacggcgggaaggtgcgcaactccgagctgctgagccgcttcaagccgctgctcgatgccggcgacccgcggggccgcgccgcccgcagggaccgcttcaagcagttcgtcaacaacgtggcggtggtgaaggagctcgacggcgtcaagttcgtggtgctgaggaagaagccccggcccccggagcccgagcccgcacccttcggccccccgggggcagcggcccagccgtcgaaacccacttcgacggtcttgccgcggagcgcctctgccccgggggctaaacccttggtcgcggccagtggagccgccaggggacctgggtctgccaacagagccacaggacaccccgggggggccggcctccgagcccgctcagccgcccggggagcggtccgccgacccaccgcttccagcccttgagctagcccaggccaccgagagaccctccgcagacgcggccccaccgcctagggccccttctgaggcggcatcgccctgctctgatccgccagacgcggagcccgggcccggggcagcgaaagggccgccgcagcagaagccctgtatgctgccggtgcgctgcgtcccggcccccgccacgctccgcctccgggcggaggagcccggcctgcgccggcagctgtcggaggagccgagcccgcggagctcccctctgctgctgaggcggctctcggtggaagagtccggtctgggcctcggcctgggcccgggccgctccccgcacctgaggcgcctgtcgcgcgccggcccgcgtctgctgagccctgacgccgaggagttgcccgccgcgccgccgccgtccgcggtgcccctggagccgtccgagcacgagtggctcgtgcggactgccgggggccgctggacccaccagctgcacgggctgctgctgcgcgaccgcggcttggcggccaagcgcgacttcatgtctggcttcacggccctgcattgggccgccaagagcggcgacggcgagatggcgctgcagctggtggaggtcgcgcggcgcagtggcgcaccagtcgacgtgaacgcacgctcccacggcggctacacgccgctgcacctggctgcactgcacggccacgaggacgctgccgtgctgctggtggtgcgtctgggtgcccaggtgcacgtgcgtgatcacagcgggcgtcgcgcctaccagtacctgcggcccggctcctcgtacgcgctgcgccgccttcttggcgatccaggcctgcgaggcaccacggagccagatgcgaccggtggtggaagtggcagtcttgctgccaggcgccccgtacaggtggccgccaccatcctcagttccaccaccagtgcatttctgggcgtcctggctgacgacctcatgctccaggacctggcccgaggcttgaagaagtcgagctccttcagcaagttcttgagcgcctcgcccatggctccacgtaaaaagacaaagatccgcggtggtctgccagccttctcagaaatctctcgtcgacctactccggggcctttagctggtctagtgcccagtttgcctccaacaacctgaaggtccctggggctaccacctggttgatctatcgtggcctgctcgtcgcagtccaaacccgcccaagactgcagcccaatcaacgcctggagcctcattctgtttccagctttgtccagggcagcctgttttacccagatgggcctgcacctccagcttctttctgaagcatgacccatctccagagatgggatttgagaaatcagtgagagcttcctataaagaactccaggagacaggcctgaactctagagggaacttgaaatccagggtcaaaggttaaggggcagcagctggtctggcccctgaaagccttcacctgatgcctctgcagctacacaatcccaagacagagctagagcaagggtctctttaaatgttgaaagatgttaggttgtcagctttaagatatgtggtggttttgtaatttgatgcttttattctgtttttaaattgaaatgaggtaatgcaactttcgtaataaccttttggaattatatttttccacttttaggcaaagtgcttagacattttcaattttttttttgctaaatactttggaattctatttaaaaaatagatgatcaagatctaaaggaaattaatcccaaccaacaaacttaaaagtttatctacctcgttttaggcaatcaagattctggagagtcttgaacacagaataacgattgtgaccattatgaatgtaactaatttcagttgtactgtgaatgctaaatatttgcaaacaagtacatcttgaaagtaaaggtgacttagagaaaagagacattttgacagatacttttaatttgtggttgtctccatcatgaaatagaaacgtgtttggcacttgtgggtggctattttgatttggcatgactacttaattttttaaaaaaattgtggtttgtgaattgcacctttgtgccatgtttctgaatctggttttcaaatccagtggagcctttcagtgaaataggtgactattaaaaaagtaatagtattacagaaaaatgagcgattaaatagtaatggatacaattaaggagcaactattttatatgactgttctgtacaaacaaaaagtatgtaatacccattttaaaaaaccatttgaaagtagacaacttattccaaaatagcaaatgcagaatctctgctcagtgagcttggatgagtggcttaacttctctgggcctttgttcctatctgtaaatgagaaagtttgtagatattgccaagatttcccaggctcaatacagtgtaattattttatgttttaaagatatgaaatctgtttactcaaccaattttttaaatgtcatattgtgataatgctctgcttttgcaaattgtgtttgcatgtcattagttatatcaaatagttttgtggcatggggtagtggagcttccctccccacccccatatgtatcagtgaagcctttgaaattacttaaggcagtctttcatggaatgttttgattgagcaatgaaataaacagtcctccattttg

SEQ ID NO: 53050 - DNA, 3287 bp, Homo sapiens
cttcttctgctgcctggttttgggggctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaaaaaaaaaaaaaaaaaaaaaaaaaaaaaaa

SEQ ID NO: 53051 - DNA, 3778 bp, Homo sapiens
ggcggcggcggcggcggcggcagctgcggcgggagaagatggtggcgctggaggcagcagcggctggagcggagctttattcccaggcttggcaccagcgctgtcactagcgccgcctgctcccgcgggcccgcggacccagctgtcaggcaagcccagtggagcaaaatgagagcgcagtgagccgggcccagcttctctcctagccgttccgactcccaccatgaaccacttggaggggtctgcggaggtggaggtgaccgacgaggcggcaggtggggaggtgaacgagtcggtggaggccgacctggagcaccccgaggtggaagaggaacagcagcagccgccgcagcagcagcactatgtgggccgccaccagcgcgggcgagccctcgaggacctccgcgcccagctcggccaggaggaagaggagcgcggggaatgcctggcgcgctcagccagcacggagagcggcttccacaaccacacggacaccgccgagggcgacgtgatcgccgcggcccgcgacggctacgatgcggagcgcgcgcaggaccccgaggacgagagcgcctatgctgtgcagtaccggcccgaggccgaggagtacacggagcaggcagaggccgagcacgccgaggccacgcaccgccgcgcgctgcccaaccacctgcacttccactcgctggagcacgaggaagccatgaatgcggcctactcaggctacgtctacacgcaccggctcttccaccgcggtgaggacgagccctactccgagccctatgccgactacggcggcctccaggagcacgtgtacgaggagataggggacgcgcccgagctggacgcacgcgacggcctgcggctctacgagcaggagcgcgacgaggcggccgcgtaccgccaggaggccctgggcgcgcggctgcaccattacgacgagcgctccgacggcgagtccgacagccccgagaaggaggccgagttcgcgccctacccgcgcatggacagctacgagcaggaggaggacatcgaccagatagtggccgaggtgaagcagagcatgagctcgcagagcctcgacaaggcagccgaggacatgcctgaggccgagcaggacctggagcgtccccctaccccggccgggggtcgccccgacagccccgggctgcaggcgccggcggggcagcagcgggcggtgggccccgcgggcggcggcgaggcggggcagcggtacagcaaggagaagcgcgatgccatctcgctggccatcaaggacatcaaggaggccatcgaggaggtgaaaaccaggaccatccgttcgccttacacccccgacgagcccaaagagcccatctgggtcatgcgccaggacattagccccaccagggactgtgacgaccagaggccgatggacggagattctccgtctcctggcagctcctcccccttgggtgcagagtcatcaagcacatctcttcaccccagtgaccctgtggaagcgtccactaataaagagtcaagaaaaagcttggcttcattcccaacctacgttgaagttccgggaccctgcgaccccgaagacttgatcgatggaatcatttttgccgccaattaccttggctccactcagctgctctcagacaaaactccttccaaaaacgtgcgcatgatgcaggcccaggaagccgtaagcaggatcaagatggcccagaaattagccaaaagcaggaagaaggctcctgaaggcgaatctcagccaatgactgaagtggatctcttcatttctacccagagaatcaaagtgctgaacgccgacacacaggagacaatgatggaccaccctctgaggaccatttcctacattgcggacattgggaacatcgttgtgctgatggcccgccggcggatgcctcgctccaactcccaggagaacgtggaagcgtcccacccatcccaggatgggaaaaggcagtacaagatgatctgccacgtcttcgagtctgaggatgctcagctgattgcacagtccatcggacaggcatttagcgtggcataccaggaattcctcagggccaatgggattaaccccgaagatctcagccagaaggagtatagtgacctgctcaatacccaggacatgtacaacgatgacctgatccacttctccaagtcggaaaactgtaaagatgttttcatagagaagcagaaaggagaaatcctaggtgtggtgattgtggagtctggctggggatccatcctccccaccgtgatcattgccaacatgatgcatggtggccctgcggagaaatctgggaagctgaatatcggtgaccagatcatgtccattaatggcaccagcctggtgggcctgcctctgtccacctgccagagcattattaagggcttaaagaatcagtcccgagtcaagctgaatatcgtgagatgtcctccggtgaccaccgtgttaatcagaagaccagaccttcgctaccagctcggtttcagcgtccagaatggaattatctgcagcctcatgcgagggggaatagctgagagaggaggcgtccgtgtggggcaccggatcattgaaatcaatggacagagcgtcgtggccaccccccacgagaagatcgtccacattctctccaatgctgttggggagattcatatgaagacaatgccagccgcgatgtacaggctgctgacggcccaggagcagcctgtttacatctgaccgcggccacacgcggtggcatgcatggaggactctcctcttcgtggttgtgtttctcgtgctgcatccctgtgtccactgagactttcccctctcgcgcccagcatttggttttacacaggaagagaagaatccacaaggacctctttactctctccgatttgcttttttttttttttttttttcaataccagggaagtttcgtatgcactcccttgaggatggagagcagccagcacccacctggtactgacccaggaccatcctggagggctttctgggtgtgtccagggggtgggctgtcactgcttgagggagaatcctcccttcccaggaggtgcagacttcttaaaaggagctcgcggggcagcaaagcagctgattcagcagtgcctaaaacccagttgctgatccctgctctctgagtttatctgtgggaatgtggtagtacccagggccagcccacgtcattaaggttatgcactgcctgccatgtagttggggcaccatacattatttcttcccagaatctctgagccaaccttaaacctcttctattgctagttctaatttcaacgtatgtgtgttttctaatacgagccttctcaccccaggataaaaggggaaataactgccttgggcaaggacaccatagtgtcacagagagcttggcaattcatggggcatctgaagctttaccaggttgtcctcaagttatcaaccattagataaacacaggcaggtactgtctgcttctctctctctcacacacacacacacacacacagtcccatttgcatatcacccttccctgctcccaccaccagtgagacaagctgaagattaggcacacagatcccctggaaacccacctctctggaaggccccttccctggcaggtggccaggcaggcgggggctgctcagcctcatcctgagagacctgccctctctgcgctgaggcccagcccctccagcaccactttggcttaaagcatcctcctcctggactcccctccctgccgaacacacatcccaggag

SEQ ID NO: 53052 - DNA, 3627 bp, Homo sapiens
atttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatga

SEQ ID NO: 53053 - DNA, 10151 bp, Homo sapiens
gcagcgccgcctgcccaggcccggaccgggctttgtccgccccggagcccctgcccgcgccgcggagaccccggagcccgcgcgctccgaggccaccccgggccgggatttccggtggggcccgcggagccgcgcagagggaggaggccccagacccaggcgccccgccagcccagctgcacgtaagcggacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgtggagacgcagttctcgatgcagatggacctgatccggcagcagcttgagttcgaggcccagcacatccgctcgctgatggaggagcgcttcggcacctcggacgagatggtgcagcgggcacagatccgcgcctcgcgcctggagcagattgacaaggagctgctggaggcgcaggaccgagtgcagcagacggagccccaggccttgctggcggtgaagtcggtgccggtggacgaggaccccgagacagaggtccccacacaccctgaggatggcacccctcagccgggcaacagcaaggtggaggtggtcttctggctgttgtccatgttggcgacgcgcgaccaggaggatacagcgcgcacgctgctggccatgtccagctcgcccgagagctgcgtggccatgcgccgctcgggctgtctgcctctgctgctgcaaatcctccacggcaccgaggccgcggccgggggtcgcgccggggccccaggggcaccgggcgccaaggacgcacgcatgcgcgccaacgcggcgctgcacaacatcgtcttctcgcagccggaccagggcctggcgcgcaaggagatgcgcgtcctgcacgtgctggagcagatccgggcctactgcgagacctgctgggactggctgcaggcccgagacggcgggcccgagggaggtggcgccggcagcgccccgatccccatcgagccgcagatctgccaggccacctgtgctgttatgaagctgtcctttgatgaggagtaccgccgtgccatgaacgagctaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaacagagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgcattgcc

SEQ ID NO: 53054 - DNA, 1469 bp, Homo sapiens
ggagctcctgataatgtgtactgcgttacatgatctgtaaatcgtgggctacgcatcctctacacccgactggaacacgctttgcacctatgcgcacacgtgtttcgcggagagtggtgctcagcgttgtgccaggcgctgaatcaggctctggggtgcagcagtgacctcggtggtcatgtccccgcgtcgcccggccacctccgcagagcaagctgagcagggggctggctggaggccgacggcggaatcccctcaacggagcgccgccagggggcgcgcgaggcagggcggagctgcgtactttgtccgcccgcgcggcccgtcgctcgcgccgcggcgggaaaatccgacctggccgcgcaccaccgccccttctcggccctcctgcgtttgcccagggtcggcccgcagtgatggaggaggaggcggagaccgaggagcagcagcgattctcttaccaacagaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatctgcgcgccgggacagaatgccctgcaggaacttcttctggaagaccttctcctcctgcaaataaaacctcacccatgaatgctcacgcaagtgtaatgacagacctgaataaaatgtattaagcagcagtgatctttcctctcctccttcccaagtcatttgaaaagtgtttgttatttaaattccaataatgcccaatactgacgtgtcttgagtaatttggaacccaaagtgaagatctttgataaagatttttttgtggttcgactggactgtgctgagtgcgggcactgggcttttcttctgatgttcattatggtgctgggaagctctgtctttgatttaaaataaaatagctaaaggctacacaattaagagttcagaataacatcttatttcagtttatgaattgatatgaattgtctaatttaaaaaatatttccctcacattaaaagcaaatttttaacatcaggctcgaagagcaaaatgattattcctcatgttttagctgaaattaattttaaaacatattaaacagaaaacctgctgacatgcctgtgaaactgatactcgaacttgctgttatgtaccagttttaattagtagcttaatgggttgcaa

SEQ ID NO: 53055 - DNA, 965 bp, Homo sapiens
gagcgccgagcggggcggcggcggggcgggcggcggctcctcggcggctccgcggcgcccgggccgcgcgccgccatgctgggcctggacgcgtgcgagctgggggcgcagctgctggagctgctccggctggcgctgtgcgcccgagtcctcctggctgacaaggagggtgggccgccggcagtggacgaggtgttggatgaggctgtgcccgagtaccgggcgccggggaggaagagcctcttggagatccggcagctggacccggacgacaggagcctggccaagtacaagcgggtgctgctggggcccctgccaccggccgtggacccaagcctgcccaatgtgcaggtgaccaggctgacactcctgtcggaacaggctccggggcccgtcgtcatggatctcacaggggacctggctgttctgaaggaccaggtgtttgtcctgaaggaaggtgttgattacagagtgaagatctccttcaaggtccacagggagattgtcagcggcctcaagtgtctgcaccacacctaccgccggggcctgcgcgtggacaagaccgtctacatggtgggcagctatggcccgagcgcccaggagtatgagtttgtgactccggtggaggaagcgccgaggggtgcgctggtgcggggcccctatctggtggtgtccctcttcaccgacgatgacaggacgcaccacctgtcctgggagtggggtctctgcatctgccaggactggaaggactgaacccccagtccgtgtctcccctacctccctcagttgttgcacagggacccccaagcatccccagcaccccccgtgagtgaccagaccctcccctgctgcccctgctgcccctgctgcccctgctctgtcccgggaccccctgggcctggcgctgtcccctgagctgtcccattaaacatggccctgtctcggtgaaaaaaaaaaaaaaaaaa

SEQ ID NO: 53056 - DNA, 5304 bp, Homo sapiens
ggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaacatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgtaagagctgttgctcatatatctctcaccagaactaatgcacttctgagcttttcttaacaaatgcttgttgtatcgcagcctgcttttcttagatgttttcttgctgttccttgtctcttttatgtgatattttaacaacttttgagagtgttcctgatatttcccattgtactttgtggaggcttaactgccgatgcgagtatacattcgaatgactgactattggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttatttaaaaaaaaaaaaaaaaaactcacccgttttcctgggatttgttgtaaggagttttcactggcctcactcagaccaatttctgcttcaaaaagcactgaatgtgacctgttgcattcagttgtagcatcaaatccacacctagtcattgcttgaggggccaaattgtgttctgtcccatgcacgctctatttggtgttaaaatggaaccttacggttgtgttttaagtattcattgaaaccagcttcagaaaacaagatgccatagtaaattgagaataacattttttccttcttcagggtggctgtaattccaggtggccgtgatttctttcttccccactgcccactccttcgccaaacccacgtattcagtgttctgatcttgtttgtgcagagtgaactctgatgcagtatcagtcttgtcctgggagccgggtcctgctgctcacaagcccagagctgccagggagctcctggcagtagcacgttgtttagaaagttgggtggcttcattcagcatggaacaagctaatggcacaggagacatcagggcagctgttaattccaaatatttgttcccaagtagctactgaactgctcacaccattggaagattttgtattttcataccaattagtaaaaataagaacattgaggagcagtcagagcccagtgttaatctccggcagagatggggtttatgtatgttcagccagatagtaaatgggatttttggagaaataagataactacaaagtttctatacttactataagtggatttagaagcgattttggttttgtattacatacggtagtcctctgcgtcagggagcacttttttgtttgcctcgagactactcattagcgcactggctaagctgcctttgccttctcgtaggcgtgggttgcctgtgtcatgggctgtgtagaccacaacactcaaacacagttgctgcacttggattttcctttaataccaagtatcatttggttatcttactgggacattttcattgatattctatacaccaaagttttgacggtttaccatcattccattttgtaccagttaaaggcattttgatgatgctttttcttgatgctaagatcactgcagaagaataacctgaccttttctttgcatttgttttgaatgtctaacaccattagcttttgtgatctggttaagaagtattagtgccacaagcctgaaaagacagttctcctgtggcagtggcgatgtggcatccagagggccattgtttctacttttgtgggacttcagtcatgctgataatagaatcttctgttcatacaattctgtaatatttatttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgctagcc

SEQ ID NO: 53057 - DNA, 6576 bp, Homo sapiens
gcggccgcggcggcggggagagcggagggagcgccgcccgcccgcgccgtcctttgtgtggcggcggcggcgcctgggcctgaccgggtccccggggctgagcgccgggctccgcgccgcccctcccgcgcccctgccaagcgggcgcctatcctctccgagcaagatggcaaccccggcggcggtcaaccctccggaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggttgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacatgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagtacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctgaacaacaaaaaaaaaaaaaaaaaaaa

SEQ ID NO: 53058 - DNA, 1562 bp, Homo sapiens
tgaggtgggagagagaagcagagcgagagagaggaggctgctggaaggagaaagaagagggtgaggaggcgacagagggagaggaggaagaagaggtagaaggagagagaaaggggagagaaaggagagaggagggttggaggtgcatgaaggaggggagagggagcttcagcgtggagagaggaccgcggaaggagagagagacagcccagagtggaatgtggaagggaaacagtccagcggggagccagggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcagggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatggtagccaggacctcctctctactgcgggggtgggcgggggcggaggatgggaactggctagtgagcactgaaatataaattctgaatcctctcctaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 53059 - DNA, 3587 bp, Homo sapiens
agcctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaaaaaaaaaaaaaaaaaaaaaaaaaaaaaaaaaaaaaa

SEQ ID NO: 53060 - DNA, 3534 bp, Homo sapiens
ggagggagccgcacgcggcccagggcagcggtctaggggcgccggggccggggcgtaggggccgttgcccgcgatggaccgcaccggagacgctccggactcgtcgccgcaggtgtccaccccccagggttcctgacccctgcccctggacagcgaccccttctcagactccagttgggccggactctccaaacctgcttccgcaatgggtgggttgtgagtgctggtaatgaggagccgtgggtgcagccagccttggagatgccgaagagacgggacatcctagcgatcgtcctcatcgtgctgccctggactctgctcatcactgtctggcaccagagcaccctcgcacccctgctcgcggtacataaggatgagggcagtgacccccgacgcgaaacgccgcccggcgccgaccccagggagtactgcacgtctgaccgcgacatcgtggaggtggtgcgcaccgagtacgtgtacacgcggcccccgccatggtccgacacgctgcccaccatccacgtggtgacgcccacctacagccgcccggtgcagaaggccgagctgacgcgcatggccaacacgctgctgcacgtgcccaacctccactggctggtggtggaggatgcgccgcgccggacgccgctgaccgcgcgcctgctgcgcgacaccggcctcaactacacgcacctgcacgtggagacgccccgcaactacaagctgcgcggagacgcccgcgacccacgcatcccgcggggcaccatgcagcgcaacctggccctgcgctggctgcgcgagaccttcccgcgcaactccagccagcctggcgtggtctacttcgccgacgacgacaacacctacagcctggagctcttcgaagagatgcgcagcaccaggagggtgtccgtgtggcccgtcgccttcgtgggtggcctgcggtacgaggccccacgggtgaacggggcagggaaggtggtcggctggaagacggtgtttgacccccaccggccatttgcaatagacatggctggatttgccgtcaacctgcggctcattctgcagcgaagccaggcctacttcaagctgcgaggtgtgaagggaggctaccaggaaagcagcctccttcgagaacttgtcaccctcaacgacctggagcccaaggcagccaactgcaccaagatcctggtgtggcacacacggacagagaagccagtgctggtgaatgagggcaagaagggcttcactgacccctcggtggagatctgagcctcaggatgcaggagcctcctcctcagaccctgttcttggccttccatcctctccccacggctgatggtccctccaaggccgactcctaaggaatcaccatcaccctcctttctattctgggggcttctgagagagcccagcctgatgccagaacaaaggacagagaatttaagcacagaaatcccagacctgttgttctctccatccagcgtgaccagggcccgagagacctgatggccagggtggggtgtccagcaccagccaagctggtgctccagcgcacctccccagagctccccgcactgacggggctgcaggagcaggtgcagtgggcgcccacactggccctgcagtgatgcagggcgggagggagataagaagaccccgcagtcaagtggagcatggccctccctggctccctgtccctgggctcagcacgaccacacaggacacccagccagggaattctgaagaccagagagcagcccacgggcatcacgagcgctctgctcctctcctgggcccctgctcttcccgagagctgcccccaaatcagacatacctctgtggctctcctctggttcacgtttacagagcataaggctgtcttggatcccaacaggcacccagccctgcatggggggagcctgggcctaataggcaccccctgtacctcaggctgtggcgggagcagagtccccccctccggcccctcttcctttaccccttctcctccagcagtggcaaaggggtaggctctagagccagcacaggtcactgcctgacctggactaagaaccccacggccccactgtccacacactgcctccccaccgcccacctcggctgctaggcccctcgcctggactggactggggagggaaagcgccttttcctgcagctcttcagagccacagacctcagggtggagtgagcccatggtgggcagtgggcaaggcggtgggtggtgggcaaggtgggacctcctgcagcctggaaagaggagggaggccaaggccattccctaactccctcctgcccctggtctgaggaggagggactctggagtagcagaggggctgggaaagagggggcaggggctgctgggacactgagcaggagggaggcctgagcacactgctttggaaattattctaaacacaaaaaagggaaagaaaatgttatttctccctaagtcaggagcatgcagagctagcccacctcatgtccagctgtccactttccatcctggagaaagaacagtgtgcctcaaactcctgccctccccaggcctctggggcccactggaaagggctctgaccccctggcccagccgggctctctagtggtgatccggctcattctcctgcaagttggaagcacaattttccccccaagtggaggaaaaggaaagggccccagcctactgaagaggtgtttattttttaactaacagcctcccaccccattaagactcaccaggagaggtctgagggccattcagaacccactcctgagtgggtgggtgggtgggactcagtccagagacctaacattcagaatatagcattggttgcctattttgagatggatttaatctcccacagtattcatgagaccatctgatggaatcagatccctgagccaccttgcaggacgttttccccaacctcttacaccctggatgtcactttggaaaccaagcccttggaagcaagtggggtggcatgggagagaagggaggaggtgggcacaggtggtgagcttatgtgtgggcactctactgcctcacagaagccagccaagtgccaaggtcagcttggctggtctgaggccaccttcttagccaaaaacctagggttcattttcaggactttgataatgaacaacaaaatggggacttctttgggcagatgctaggtcagttgttttcacctaatatcctcttttagctgcatgtatatttatttataattataaccctggtggactgcagccttcatctttattgggaatgagtttgttataaatcagaaatgggtccatgatgaccactgttttccaaacccagtctgttccctgctccctcgctggcaagccccaccacacaggagtgaggccaggggctaggagttctaagaacagaggctggggtgagggtggcacccaggcagctgcatctggtctgttttaatttaactgtatttaatttgctttcaaaattaaaagtcaaatacagtttttaacagtcctaaaaaaaaaaaa

SEQ ID NO: 53061 - DNA, 3666 bp, Homo sapiens
ggagggagccgcacgcggcccagggcagcggtctaggggcgccggggccggggcgtaggggccgttgcccgcgatggaccgcaccggagacgctccggactcgtcgccgcaggtgtccaccccccagggttcctgacccctgcccctggacagcgaccccttctcagactccagttgggccggactctccaaacctgcttccgcaatgggtgggttgtgagtgctggtaagacctgctagccaacattcagctgctctgtcctctccatgcctggccggcccggcccatgcctgttcttttctcccctgtgctgccgccgcccgtggccgcccctctcctgaacttaccgccactcaggtaatgaggagccgtgggtgcagccagccttggagatgccgaagagacgggacatcctagcgatcgtcctcatcgtgctgccctggactctgctcatcactgtctggcaccagagcaccctcgcacccctgctcgcggtacataaggatgagggcagtgacccccgacgcgaaacgccgcccggcgccgaccccagggagtactgcacgtctgaccgcgacatcgtggaggtggtgcgcaccgagtacgtgtacacgcggcccccgccatggtccgacacgctgcccaccatccacgtggtgacgcccacctacagccgcccggtgcagaaggccgagctgacgcgcatggccaacacgctgctgcacgtgcccaacctccactggctggtggtggaggatgcgccgcgccggacgccgctgaccgcgcgcctgctgcgcgacaccggcctcaactacacgcacctgcacgtggagacgccccgcaactacaagctgcgcggagacgcccgcgacccacgcatcccgcggggcaccatgcagcgcaacctggccctgcgctggctgcgcgagaccttcccgcgcaactccagccagcctggcgtggtctacttcgccgacgacgacaacacctacagcctggagctcttcgaagagatgcgcagcaccaggagggtgtccgtgtggcccgtcgccttcgtgggtggcctgcggtacgaggccccacgggtgaacggggcagggaaggtggtcggctggaagacggtgtttgacccccaccggccatttgcaatagacatggctggatttgccgtcaacctgcggctcattctgcagcgaagccaggcctacttcaagctgcgaggtgtgaagggaggctaccaggaaagcagcctccttcgagaacttgtcaccctcaacgacctggagcccaaggcagccaactgcaccaagatcctggtgtggcacacacggacagagaagccagtgctggtgaatgagggcaagaagggcttcactgacccctcggtggagatctgagcctcaggatgcaggagcctcctcctcagaccctgttcttggccttccatcctctccccacggctgatggtccctccaaggccgactcctaaggaatcaccatcaccctcctttctattctgggggcttctgagagagcccagcctgatgccagaacaaaggacagagaatttaagcacagaaatcccagacctgttgttctctccatccagcgtgaccagggcccgagagacctgatggccagggtggggtgtccagcaccagccaagctggtgctccagcgcacctccccagagctccccgcactgacggggctgcaggagcaggtgcagtgggcgcccacactggccctgcagtgatgcagggcgggagggagataagaagaccccgcagtcaagtggagcatggccctccctggctccctgtccctgggctcagcacgaccacacaggacacccagccagggaattctgaagaccagagagcagcccacgggcatcacgagcgctctgctcctctcctgggcccctgctcttcccgagagctgcccccaaatcagacatacctctgtggctctcctctggttcacgtttacagagcataaggctgtcttggatcccaacaggcacccagccctgcatggggggagcctgggcctaataggcaccccctgtacctcaggctgtggcgggagcagagtccccccctccggcccctcttcctttaccccttctcctccagcagtggcaaaggggtaggctctagagccagcacaggtcactgcctgacctggactaagaaccccacggccccactgtccacacactgcctccccaccgcccacctcggctgctaggcccctcgcctggactggactggggagggaaagcgccttttcctgcagctcttcagagccacagacctcagggtggagtgagcccatggtgggcagtgggcaaggcggtgggtggtgggcaaggtgggacctcctgcagcctggaaagaggagggaggccaaggccattccctaactccctcctgcccctggtctgaggaggagggactctggagtagcagaggggctgggaaagagggggcaggggctgctgggacactgagcaggagggaggcctgagcacactgctttggaaattattctaaacacaaaaaagggaaagaaaatgttatttctccctaagtcaggagcatgcagagctagcccacctcatgtccagctgtccactttccatcctggagaaagaacagtgtgcctcaaactcctgccctccccaggcctctggggcccactggaaagggctctgaccccctggcccagccgggctctctagtggtgatccggctcattctcctgcaagttggaagcacaattttccccccaagtggaggaaaaggaaagggccccagcctactgaagaggtgtttattttttaactaacagcctcccaccccattaagactcaccaggagaggtctgagggccattcagaacccactcctgagtgggtgggtgggtgggactcagtccagagacctaacattcagaatatagcattggttgcctattttgagatggatttaatctcccacagtattcatgagaccatctgatggaatcagatccctgagccaccttgcaggacgttttccccaacctcttacaccctggatgtcactttggaaaccaagcccttggaagcaagtggggtggcatgggagagaagggaggaggtgggcacaggtggtgagcttatgtgtgggcactctactgcctcacagaagccagccaagtgccaaggtcagcttggctggtctgaggccaccttcttagccaaaaacctagggttcattttcaggactttgataatgaacaacaaaatggggacttctttgggcagatgctaggtcagttgttttcacctaatatcctcttttagctgcatgtatatttatttataattataaccctggtggactgcagccttcatctttattgggaatgagtttgttataaatcagaaatgggtccatgatgaccactgttttccaaacccagtctgttccctgctccctcgctggcaagccccaccacacaggagtgaggccaggggctaggagttctaagaacagaggctggggtgagggtggcacccaggcagctgcatctggtctgttttaatttaactgtatttaatttgctttcaaaattaaaagtcaaatacagtttttaacagtcctaaaaaaaaaaaa

SEQ ID NO: 53062 - DNA, 5535 bp, Homo sapiens
ggactttagaagccgttgctgccctctctgtcacctgaagcggggccctctcccatcccacccttgccccgcctccctgcccccaccgggccggccctgcccgccgccggaccctggcatgtcaagacctggtccgcgcctgcctgcccagcccgcggaaccccggcggccccgcgagctaggatgaggggccaggccgccgccccgggccccgtctggatcctcgccccgctgctactgctgctgctgctgctgggacgccgcgcgcgggcggccgccggagcagacgcggggcccgggcccgagccgtgcgccacgctggtgcagggaaagttcttcggctacttctccgcggccgccgtgttcccggccaacgcctcgcgctgctcctggacgctacgcaacccggacccgcggcgctacactctctacatgaaggtggccaaggcgcccgtgccctgcagcggccccggccgcgtgcgcacctaccagttcgactccttcctcgagtccacgcgcacctacctgggcgtggagagcttcgacgaggtgctgcggctctgcgacccctccgcacccctggccttcctgcaggccagcaagcagttcctgcagatgcggcgccagcagccgccccagcacgacgggctccggccccgggccgggccgccgggccccaccgacgacttctccgtggagtacctggtggtggggaaccgcaaccccagccgtgccgcctgccagatgctgtgccgctggctggacgcgtgtctggccggtagtcgcagctcgcacccctgcgggatcatgcagaccccctgcgcctgcctgggcggcgaggcgggcggccctgccgcgggacccctggccccccgcggggatgtctgcttgagagatgcggtggctggtggccctgaaaactgcctcaccagcctgacccaggaccggggcgggcacggcgccacaggcggctggaagctgtggtccctgtggggcgaatgcacgcgggactgcgggggaggcctccagacgcggacgcgcacctgcctgcccgcgccgggcgtggagggcggcggctgcgagggggtgctggaggagggtcgccagtgcaaccgcgaggcctgcggccccgctgggcgcaccagctcccggagccagtccctgcggtccacagatgcccggcggcgcgaggagctgggggacgagctgcagcagtttgggttcccagccccccagaccggtgacccagcagccgaggagtggtccccgtggagcgtgtgctccagcacctgcggcgagggctggcagacccgcacgcgcttctgcgtgtcctcctcctacagcacgcagtgcagcggacccctgcgcgagcagcggctgtgcaacaactctgccgtgtgcccagtgcatggtgcctgggatgagtggtcgccctggagcctctgctccagcacctgtggccgtggctttcgggatcgcacgcgcacctgcaggcccccccagtttgggggcaacccctgtgagggccctgagaagcaaaccaagttctgcaacattgccctgtgccctggccgggcagtggatggaaactggaatgagtggtcgagctggagcgcctgctccgccagctgctcccagggccgacagcagcgcacgcgtgaatgcaacgggccttcctacgggggtgcggagtgccagggccactgggtggagacccgagactgcttcctgcagcagtgcccagtggatggcaagtggcaggcctgggcgtcatggggcagttgcagcgtcacgtgtggggctggcagccagcgacgggagcgtgtctgctctgggcccttcttcgggggagcagcctgccagggcccccaggatgagtaccggcagtgcggcacccagcggtgtcccgagccccatgagatctgtgatgaggacaactttggtgctgtgatctggaaggagaccccagcgggagaggtggctgctgtccggtgtccccgcaacgccacaggactcatcctgcgacggtgtgagctggacgaggaaggcatcgcctactgggagccccccacctacatccgctgtgtttccattgactacagaaacatccagatgatgacccgggagcacctggccaaggctcagcgagggctgcctggggagggggtctcggaggtcatccagacactggtggagatctctcaggacgggaccagctacagtggggacctgctgtccaccatcgatgtcctgaggaacatgacagagattttccggagagcgtactacagccccacccctggggacgtacagaactttgtccagatccttagcaacctgttggcagaggagaatcgggacaagtgggaggaggcccagctggcgggccccaacgccaaggagctgttccggctggtggaggactttgtggacgtcatcggcttccgcatgaaggacctgagggatgcataccaggtgacagacaacctggttctcagcatccataagctcccagccagcggagccactgacatcagcttccccatgaagggctggcgggccacgggtgactgggccaaggtgccagaggacagggtcactgtgtccaagagtgtcttctccacggggctgacagaggccgatgaagcatccgtgtttgtggtgggcaccgtgctctacaggaacctgggcagcttcctggccctgcagaggaacacgaccgtcctgaattctaaggtgatctccgtgactgtgaaacccccgcctcgctccctgcgcacacccttggagatcgagtttgcccacatgtataatggcaccaccaaccagacctgtatcctgtgggatgagacggatgtaccctcctcctccgcccccccgcagctcgggccctggtcgtggcgcggctgccgcacggtgcccctcgacgccctccggacgcgctgcctctgtgaccggctctccaccttcgccatcttagcccagctcagcgccgacgcgaacatggagaaggcgactctgccgtcggtgacgctcatcgtgggctgtggcgtgtcctctctcaccctgctcatgctggtcatcatctacgtgtccgtgtggaggtacattcgctcagagcgttctgtcatcctcatcaacttctgcctgtccatcatctcctccaatgccctcatcctcatcgggcagacccagacccgcaacaaggtgatgtgcacgctggtggccgccttcctgcacttcttcttcctgtcctccttctgctgggtgctcaccgaggcctggcagtcctacatggccgtgacgggccacctccggaaccgcctcatccgcaagcgcttcctctgcctgggctgggggctccctgcactggttgtggccatttctgtgggattcaccaaggccaaagggtacagcaccatgaactactgctggctctccctggaggggggactgctctatgccttcgtgggacctgccgctgccgttgtgctggtgaacatggtcattgggatcctggtgttcaacaagctcgtgtccaaagacggcatcacggacaagaagctgaaggagcgggcaggggcctccctgtggagctcctgcgtggtgctgccgctgctggcgctgacctggatgtcggctgtgctcgccgtcaccgaccgccgctccgccctcttccagatcctcttcgctgtcttcgactcgctggagggcttcgtcatcgtcatggtgcactgtatcctccgtagagaggtccaggacgctgtgaaatgccgtgtggttgaccggcaggaggagggcaacggggactcagggggctccttccagaacggccacgcccagctcatgaccgacttcgagaaggacgtggatctggcctgtagatcagtgctgaacaaggacatcgcggcctgccgcactgccaccatcacgggcacactgaagcggccgtctctgcccgaggaggagaagctgaagctggcccatgccaaggggccgcccaccaatttcaacagcctgccggccaacgtgtccaagctgcacctgcacggctcaccccgctatcccggcgggcccctgcccgacttccccaaccactcactgaccctcaagagggacaaggcgcccaagtcctccttcgtcggtgacggggacatcttcaagaagctggactcggagctgagccgggcccaggagaaggctctggacacgagctacgtgatcctgcccacggccacggccacgctgcggcccaagcccaaggaggagcccaagtacagcatccacattgaccagatgccgcagacccgcctcatccacctcagcacggcccccgaggccagcctccccgcccgcagcccgccctcccgccagccccccagcggcgggccccccgaggcaccccctgcccagcccccaccgcctccgcccccaccgccaccacctccccagcagcccctgcccccaccgcccaatctggagccggcaccccccagcctgggggatcccggggagcctgccgcccatccgggacccagcacggggcccagcaccaagaacgagaatgtcgccaccttgtctgtgagctccctggagcggcggaagtcgcggtatgcagaactggactttgagaagatcatgcacacccggaagcggcaccaagacatgttccaggacctgaaccggaagctgcagcacgcagcggagaaggacaaggaggtgctggggccggacagcaagccggaaaagcagcagacgcccaacaagaggccctgggagagcctccggaaagcccacgggacgcccacgtgggtgaagaaggagctggagccgctgcagccgtcgccgctggagcttcgcagcgtggagtgggagaggtcgggcgccacgatcccgctggtgggccaggacatcatcgacctccagaccgaggtctgagcgggtgggcggcggccacgcactgggccacggaggagggatgctgctccgcccgctcctgccgcagacgggcacagacacgctcgcgggcagcgggccaggcccgcaccccggcctcagggcgctcagacggcggccaggcacagggcccgcagtgctgggaccagagccagatgcaggacaggaggcggcccggccagcgggcacagggcaccagaggccgaaggtgcctcagactccgccctcctcgggccgaggcccagcgggcagatgggcggacggctgtggaccgtggacaggcccagcgcggccagcgtcccagggtacccgcctgagctcctgctgcggaggagctgcctgcttggcccggccggcctggcaccgttttttaaacacccccatccctcgggaagcagccagctccccacaccttccagggccctaggcccctcctagacccaggtggagggcacagccctccgaccctcatggcccccaggggcaggactgagtcccctccaggaagaagcaggggggaatctattttttctctccttttcttttcttcaataaaaagaattaaaaacccaaaaaaaa

SEQ ID NO: 53063 - DNA, 5399 bp, Homo sapiens
gccgcgcgggagagcgggagcctcggccctccgcgcggctgcagctacctaccctgcgcccggccaggtccccgacttagggatggcaaacttgcgccccgtggccgcccccgccagcgccggcccccgctcctgctgctgacggcgcccaggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccgggtcggagcggtgcccctgggccagcctgctcctcccctgctcagcgtgtggagcggtccccagccccctgctcagctcagcctcggccaggaacgccatggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggcccgaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgaggtgatgcacacccggaaacggcattcagaactctaccacgagctcaaccagaagttccacactttcgaccgctaccgcagccagtccacggccaagagggagaagcggtggagtgtgtcctcgggtggggcggccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgg

SEQ ID NO: 53064 - DNA, 3168 bp, Homo sapiens
ccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgagcagaaatgccaggcaggacctgctgggccgtgcggggcaccctcggcctcaccctgcagtgtctgtggcactcactgcttttctaaggctcgccgtgagccaggtctaaagtttgaagaaaaagaaaaatcttaaaaaaaaaaaaaaaaaaagaaaaaaagaaaaacaggaaaaaggactttttttttcctgaaaaacaaaaaccgatctgcatggactccggtgtgcgctgttatctcgcatccgacttccccggtgcgatggcctctgtccggacagggaaggtgctggggtccctggccgccccggcccctgtggaggggtgcacagagaaagggggctcgtgccaagctcgaggggcctcctgaggaagccggccgctcctgtgagggaggccgggcccgggcacctgagggcttctccctctggacactgcgggccaggtgtacatagagcagcgcggcacagtggcctcacctcccgtcgggcactggcgggagcaaggtcgggggcaggcgctgcccagctggccgcacacggacattccaaagacctccagagaccaccccacccccacattcctttgaccagccttgtgagggcatcgatgctgccccgggctacctggctgctctgggcagggtgtgcgggccgggcccggctgggggagggcagctctgggcacgccgcacccacgccccccacctgggggaaacaggcggttcctgcccggttcttcctaaacgctctcgtctttttgtgtgtcttggtgactttagaaacaaacacagtggactcagtggctactggtattgtctcttcccacactgaactctggggaattgagtgcagggcacagcccggctcagcctgcccgctggtgggagcccctgggaagctgcggcgctcctttatctgatgtggtttagtaaaagcctcccacacacctccccgtggcctgggacgtggctggtagtgtttgtgtgggaagcagctcaagacgcggaccgcgtgacattaaggagagcgcaagggcggaccgggccctgtgtagagacccttccgcgccggcgttcccgctccgctaaagatttcaaatccaggggattccatgctcaatggatgaatgtagacacaaaacagcaacacttgtatgaagatgtaaagtgctgaacatatttttttcctgtttcctttccttttttttaaaaaatctgaattgtgccctgtactgcagttacttgtttgaataaaagttttatttattgc

SEQ ID NO: 53065 - DNA, 2873 bp, Homo sapiens
ccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaaccaaaaaaaaaaaaaaaaa

SEQ ID NO: 53066 - DNA, 942 bp, Homo sapiens
aaccgaagcgggggcgagggggaggtagagcccgccccctgcgcgtcgcggctgggagggagaggaggtgggagagaaggaagaggcggaggaggcagcgggcgccgaggctctgggacccgcaggcaagccagaccgacgcgcagagccgggagcctcatcgcagcggcagcggcagcggcgggctcgggccggcctcgggggctgctcacccacatgagcatccgcccacccggcgagcccccgagcccaggcggcgcggccatggccgagctcaagtcgctgtcgggggacgcgtacctggcactaagccacggctacgcggcggcggctgcgggtctcgcctacggggcggcgcgagaacccgaagcggcccgcggctacggcactccgggcccgggcggcgacctccccgcggcgcctgcacctcgcgccccagctcaggcggcggagagcagcggcgaacagagcggggacgaggacgacgccttcgagcagcggcggcggcggcgcgggccagggagcgcggcggacgggcggcggcggccgcgagagcagcggtctctgcggctcagcatcaacgcgcgcgagcggcggcgcatgcacgacctaaacgacgcgctggacgggctgcgagccgtcatcccctacgcgcacagcccgtcggtgcgcaagctctccaagatcgccacgctgctgctcgccaagaactatatcctcatgcaggcgcaggccctggacgagatgcggcgcctggtggccttcctcaaccagggccagggcctggccgcgcccgtaaacgccgcgcccttgacgcccttcggccaggccactgtgtgccccttctccgcaggcgccgccctggggccctgccctgacaagtgcgccgccttctccgggacgccctccgcgctttgcaaacactgtcacgagaagccgtga

SEQ ID NO: 53067 - DNA, 1642 bp, Homo sapiens
agtgcattgtgggaaactcccgagctctcctccgcgttcgcagccgccgtcatcccgcggaggagcgcgcagccccggggaggccggaggacgcgcccatagaatgcccaggggcgacaaactgtcctgagcccctctggtgcagccacctgcctgtcccatacgccccgcccaccatggagtccagagggaagtcagccagcagccccaagcccgacaccaaggtgccccaggtcaccaccgaggccaaggtacccccggcagccgatgggaaagcccccttgaccaagccctcgaagaaggaggccccggccgagaagcagcagccgccagcagcccccaccacggcacctgccaagaagacctcggccaaggccgaccctgcccttctcaacaaccacagcaacctgaagccagcccccacggtccccagcagtcccgatgcaaccccggagcccaagggtcctggggacggggcggaggaagatgaggctgccagtggggggcctgggggccgaggtccctggtcctgtgagaacttcaaccccctgctggtggctgggggtgtggccgtggcagccatagccctgattctcggtgtggccttcctggtccggaaaaaataatacctgggggccaggcggggggcacggagccacttcctgtacagacccgaggaagccagtgcatgcagagttcacccttacctattcgtacacacgcacattcattacacacctacatatgcccccaacacacgcgcacggtgaagaggacgcccgagcccacccctgctgacccaggacttccccaacctccagggcagaaagagcccaggctccggggtccacagcacaggatgtggggcgagggcacagctggggaacggcaagaaaggaatggaccctgtgtgtggcccccccacccctggcggctgggtgatcctgggcccccagggctggtctgagtgcaggtgggggtgccgggatgggttgggcctgggcccggccctcgtggggacattaaagggcgcggtggctccactcgccccatttctgctctttgcgtacccaccgggggtctgcctgggcgaatgcagtgggacggacctggggtgggcactcacctcagcagagcctcaatgccacctccccacaccacccaagcctagctgggtgggaagacggagccctgaagcctgcgtgtggagggggtgctgcccaagggtcgccttccccagcttgtgctccaggggagccccgacgccggcggggaggcagggatgtcgagggcccctcacagctgtgcccgccctgccccgctagactgcccctccagcttgcacccagcaccacctgagtctaaccagcgtataatgcaataacaggtagagtagaactgcttttggcggcgaccgtcacacactgtcctcagcccactgcacctggggaagcccctcgtgcagcccctccttagcacatccagtcccagcgtggcccttggcgcgcagcagcaggcgaactcccagaaggtggtggtgggcactgtgagaacgtggcctgccctcactggccagtggccacaggaaccccgggcctgagtggaggctgagtctgaaataaactctgtcgtctgaaggctg

SEQ ID NO: 53068 - DNA, 1894 bp, Homo sapiens
ccgccgccgccgccgccggctcggtcccgcgcccgccatggcccgcctgacggagagcgaggcgcgccggcagcagcagcagctcctgcagccgcggccctcgcccgtgggcagcagcgggcccgagccccccggggggcagcccgacggcatgaaggacctggacgccatcaaactcttcgtgggccagatcccgcggcacctggacgagaaggacctcaagccgctcttcgagcagttcggccgcatctacgagctcacggtgctcaaagacccctacacggggatgcacaaaggctgtgccttcctcacctactgtgccagggattccgccatcaaagctcagactgccctgcacgagcagaagaccttgcccggaatggcgcggccaatccaggtgaagcctgcggacagtgaaagccgcggaggtagggaccggaagctgttcgtggggatgctgaacaagcagcagtcggaggaggacgtgctgcggctgttccagcccttcggggtcattgacgagtgcaccgtgctccgggggcctgacggcagcagcaaaggctgtgctttcgtgaagttctcctcccacacggaggcgcaggcggccatccacgccttgcatgggagccagaccatgccgggagcctcctccagcctggtggtcaagttcgccgacacggacaaggagcggacgctccggcgcatgcagcagatggtgggccagctgggcatcctgacgccgtccctcacattgcccttcagcccctacagtgcctacgcccaggctctcatgcaacagcagacaacagtcctgtccacctcgggcagctacctgagtcccggcgtggccttctcaccctgtcacatccagcagataggcgccgtcagcctcaacgggctgcctgccacacccatcgctcctgcctctgggctgcactcacccccgctgctgggcaccaccgctgtgcctggcctcgtggctcccatcaccaatggctttgcaggtgtcgtgccctttccaggtgggcaccctgccctggaaaccgtctatgccaatggccttgtgccctacccagctcagagcccgactgtggccgagacactgcatcctgccttctccggagtccagcagtacacagccatgtaccccaccgcggccatcacgcccatcgcgcacagcgtcccccagccgccgcccctcctgcagcagcagcagcgagaaggtcccgagggctgtaacctgtttatctaccacctcccccaggagtttggagacacggagctgacgcagatgttcctacccttcggcaatatcatttcctccaaggtgtttatggatcgagctaccaaccagagcaagtgtttcggcttcgtgagctttgataacccggccagcgcccaggcagccatccaggccatgaacggcttccagatcggcatgaagaggctcaaagtccagctgaagcggcccaaagacccgggacacccctactgaccgcgcccacagccgccctgaggctgtaggcatggcccagacctgcgtgatttgtacaatgtactttatttctgctacgagtaatttcatgaagtttcaacttgcaaactgacttttgggacaaaccaacacacacacagaagagaaagcaaagaacttggaactttgggttgactcggtttgagttttgtgtcaaagaagatttcccgcggctgaagaggttggtgttcctgttacgtgtttcaggtgagaagcagcaaagcgtcttaatgttcaaaacgcctctctttggtctggagaaaaaaaaaaaaaaaaaaaaacaactaaaaatttatttaataaaagttttacttgctaaaaaaaaaaaaaaaaaaaaaaaaaaaaaaaaaaaaaaaaaaa

SEQ ID NO: 53069 - DNA, 15964 bp, Homo sapiens
agagccgagctgggagatggcggcggcagcggcggcgccgagagtgtgagcaccgcccgggagccgccggcccgggcgcagcgcgaccccgaccccgcccgcccgcctgcccgccatgggcaacgaggtcagcctggagggcggcgctggcgacgggccgctgccgcccggcggcgccggccccggcccgggccccggccccggccccggcgcaggaaagccgccttcagcaccggccggtggcggacagctccccgcggcgggagcagcgcggtcgaccgcggtaccaccggtccctggccccggccccggccccggtcccggccctggcccgggcagcacttcccggagactggaccccaaggaacccctgggtaaccagagagcagcttccccaactccgaagcaggcttctgctaccactcctggccatgagagcccccgagagacaagggcacagggaccagcaggccaggaggctgatggtccccgcaggacgctgcaggtagacagcaggacacagagatcagggcggtccccctcagtgtcaccggacagaggcagcacccccacatcaccctactccgtccctcagatcgccccccttcccagcagcacgctgtgtcccatatgcaagacttcggacctcacgtcgacccccagccagccaaacttcaacacctgcacccagtgtcacaacaaggtctgcaaccagtgtgggttcaaccccaaccctcatctcacccaggtgaaggagtggctctgtctgaactgtcagatgcagagggctctgggaatggacatgaccactgcacctcgctccaagagccagcagcagctgcactccccagccctgtctcctgcccactccccggccaaacagcccctggggaagccagaccaagagagatctcggggcccaggaggaccacagcctgggtcccgccaggctgagacagccagggccacctcagtgccggggcctgcccaagcagctgcccctccagaggtggggagggtgtctcctcagccccctcaacccaccaagccttccacagctgagcccaggccacctgcaggagaggccccggccaaaagtgccaccgcagtgcccgctgggcttggtgccactgagcagacccaggagggcctcactggtaagctcttcggccttggcgcgtcactgctaacccaggcgagcaccctcatgtctgtgcagcccgaggctgacacccagggccagcctgcccccagcaaggggacacctaagatcgtcttcaatgatgccagcaaggaggctggcccaaaacccttgggctcagggcccgggcctgggccagcacctggagccaaaactgagcctggggctagaatgggtcctggatctggacctggagccctgccgaaaactgggggaacaaccagtccaaagcatggcagagcagaacatcaggcagcatcgaaggctgctgccaagccaaagaccatgccgaaggaaagggccatctgcccactgtgccaagccgagctcaacgtgggcagcaagagcccagccaactataacacatgcaccacctgcaggctccaggtgtgcaacctgtgtggcttcaacccaacaccccacctggtggagaaaacagagtggctctgtctgaactgccaaaccaagcggctactggagggcagcctaggagagccgacccccctgccgccgcccacctcacagcagccccctgtaggggcccctcaccgtgcatctggaacatcccctctgaagcagaaagggccacaggggctgggccagccttcaggccccctgcctgccaaggccagccctctatccaccaaggccagccctctgcccagcaaggccagcccccaggccaagcccctcagggcttctgaacccagcaagaccccaagcagtgtccaggaaaagaagacccgagtccccactaaagctgagcccatgccgaagccacctccagagactaccccaacccctgcgactcctaaagtaaagagtggggtgaggagggctgaacctgccacccctgtcgtcaaggctgttccagaagcccccaagggtggggaggcggaggacctggtgggcaagccttactctcaggatgcgtctcggagcccacagagcctcagtgacacaggctattcctctgacggcatctctagctcccagagtgagatcacaggagtcgtgcagcaggaggtggaacagctggacagtgcaggggtgacagggccacatccacccagcccctccgagatccacaaggtggggagcagcatgcggcctttgctgcaggcccagggcctggccccaagtgagcggagcaagccactctccagcggtactggcgaggagcagaagcagcggccccactccttgtccatcacgcctgaggcctttgactctgatgaggagctggaggatatcctggaggaagacgaagactctgctgagtggaggcgccggagagagcagcaggacactgccgagtcctcagacgactttggcagccaattgaggcacgactatgtggaggacagcagtgagggtggcctgtcccctcttccaccccagcccccagcccgggcagcagaactgactgatgaggatttcatgcgacggcagattctcgagatgagcgccgaggaagacaacctggaggaggatgacactgccacctccgggcgtggcctggccaaacatggcacccagaaaggtggccccagacccaggcctgagcctagccaagaaccagcagcactgcccaagaggcgcctgccccacaatgccaccacgggctatgaggagctgctccctgagggaggctcagcagaggctaccgatggcagtgggaccctgcagggtgggctccgtcgcttcaagaccattgagctcaacagcacgggaagttatggtcatgagttggacctgggccaaggcccagaccccagtctggaccgggagcctgagctggagatggagagcctaacgggctcccctgaggaccgctcccgtggtgagcactcctctacattgcctgcctccacacccagctacacctcgggcacctctcccacctctctgtcctccctagaggaggacagtgacagcagccccagccgcaggcagcgtctagaagaagcaaagcagcagcgcaaggcccggcaccgctcccacgggcccctgctacccaccatcgaggactcctcagaggaggaggagctgcgggaggaagaggagctgcttcgtgagcaagagaagatgcgggaggtggagcagcagcgcatccgcagcacagcccgcaagacccggcgggacaaggaagaactgcgggcccagcggaggcgagagcgctccaagacaccacccagtaacttgtcacccatcgaggatgcctccccgacggaggagctgaggcaggcggccgagatggaggagctacaccgctcctcctgctctgagtactcaccctcaccctcccttgactctgaggctgaggccttggatggtggccctagccggctttacaagtcaggcagtgagtacaacctgcccaccttcatgtccctctactcaccaaccgagacaccctccggcagctccaccactcccagttccggacggccgctcaagagcgctgaggaggcttatgaggagatgatgcgcaaagctgagctgctccagaggcagcaaggccaggcagcaggggcccggggaccccatggcggcccctctcagcccacaggcccccggggcctgggctccttcgaatatcaagacactacagaccgtgagtatggccaggctgctcagcctgccgcagagggcacgccagccagcctgggagcagccgtgtacgaagaaatccttcagacatcacagagcatagtccgcatgcggcaggcctcctcacgagacctggcttttgctgaggacaaaaagaaggagaagcagtttctaaatgctgagagtgcatacatggacccaatgaagcaaaatggtggcccccttacccctggtaccagtcccacccagctcgctgcccctgtgtccttctctacccccacctcctcagacagcagcgggggccgagttattcccgatgtccgtgtcactcagcattttgcaaaggagactcaggaccccctcaagctgcacagctctcctgcctcccccagctcagcctccaaggagataggcatgcccttttcccagggccctgggaccccagccaccacagctgtggctccttgtccagctgggctgccacgaggatatatgactccagcctccccagcaggctccgagcgtagtccttcaccatcttccacagcccacagctatggacacagcccaaccactgcaaactatgggtcccaaactgaggatctaccccaggcccccagtggccttgctgcagctggacgagctgctagagagaagcccttgagtgcgagtgacggtgagggtggcactcctcagccttcccgggcatattcctactttgcaagctccagcccacctctctccccgtcttccccctcagagagtcccacattctcccctggcaagatgggcccaagggccacagcagagttctctacacagacgccaagtccagcccctgcctcagacatgccacggagccctggtgcccccactccatcacctatggtagcccagggtacacaaacaccacatcgacccagcacgcctcgcctggtgtggcaggagtcctctcaagaggctccctttatggtcatcacgctggcatctgacgcctccagccagaccaggatggtacatgccagtgcctccacctccccgctctgctcacctactgaaacccagcccaccacccatggctacagccagacaacacctccgagtgtgtctcagctgcccccagagccacctgggccacctggctttccacgggtgcccagtgctggtgcagatgggcccctggcactatatggctggggtgccctccctgctgagaacatctccctgtgccggatctcctctgtccctgggacgtctagggttgagccaggccccaggacccctggcactgcagtggtagacctccgtacagctgtcaagcccactcccatcatcctcactgaccagggcatggacctcacctctcttgctgtggaagcgaggaagtatggtcttgccctggatccaatcccaggacggcagtcgaccgccgtgcagcccttggttatcaacctcaatgcccaggagcataccttccttgctactgccaccaccgtgagcatcaccatggcctcgtctgtgttcatggctcaacaaaagcagcctgtggtctatggagacccctaccagagccgccttgactttggccagggtgggggtagccctgtgtgcctggcccaggtcaaacaagtagagcaggctgtccagacagccccataccgaagtgggccccggggaagacccagggaggccaagtttgccagatataacctacccaaccaagtagctcctctggccagaagagacgttttgatcactcagatgggcaccgcccagagcattggcctcaagccaggcccagtgccagagccaggtgccgagccccaccgggccacccctgcagagctgcggtcacatgctctgccaggtgccaggaagccacacacagtggtggtgcagatgggagagggcacagcaggcactgtgaccacactgctcccagaggagcctgcgggtgccctggaccttaccgggatgaggcctgagagccagctggcatgctgtgacatggtctacaagctcccctttggcagcagctgcactggcaccttccacccggcccccagtgtgcctgagaagagcatggcagatgctgccccacctggccaaagcagcagccccttctatggtccccgggaccctgagcctcctgagcccccaacctaccgggcacagggggtggtggggcctgggccccatgaggagcagaggccctacccacaaggcctgcctggtaggctgtactcctccatgtctgacaccaatttggctgaggctggcctcaactaccatgcccagaggatcgggcagctcttccagggtcctggacgagactcggctatggacctcagctcactgaagcactcctacagcctgggctttgcggatggacgctacctagggcagggcttgcagtatggctcagtcacggacctgcgtcatcctacagaccttttggctcacccgcttcccatgcggcgctatagctcagtgtcgaacatctactcagaccacaggtacggcccacggggagatgcagttggcttccaggaggccagcctggcccagtacagtgccaccacagcccgtgaaatcagtcgcatgtgcgctgccctcaactccatggaccagtatggtgggcggcatggcagtggtggtggtggccctgaccttgtgcagtaccagccccagcacgggcccgggctcagtgctccacagagtctggttcccctcagacctggactccttggtaaccccacctttccagagggccacccaagtcctgggaacttggcccagtatgggcctgcagcaggccaaggaacagcagtcagacagctgctgccgtccacagccactgtacgtgcagctgatggcatgatctactcgactatcaataccccaattgctgcaacactgcccatcaccacccagcctgcctcagtcctgcggcccatggtgcgtggtggcatgtacaggccttacgcatctggtggaatcacagccgtgccactcaccagtctgacacgtgtgcccatgattgccccccgggtacctcttggacccacagggctgtaccgctatcctgcaccaagtagatttcccattgcttccagtgttccacctgcagaagggcctgtctatctggggaaacctgctgctgccaaggcccctggggctgggggcccttcaaggccagagatgccagtaggggctgcacgggaagagcctcttcccacaaccacccctgctgccatcaaggaggctgcaggagccccagctcctgccccactagctggccagaagccaccagcagatgctgctcctgggggtggcagtggggccctcagccggccagggttcgagaaagaggaagcatcacaggaggagaggcagcggaagcaacaggagcagctgctccagctagagcgggagcgggtggagttggagaagctgcgacaacttcggctgcaagaggagctagagcgggaacgtgtggagctgcagaggcaccgtgaggaggagcagctgctggtgcagcgggagttgcaggagctgcagaccatcaagcaccatgtgctgcagcagcagcaagaggaacgccaggctcaatttgcactgcagcgggaacagctagcgcagcagcgtctgcagctggagcagatccagcagctgcagcagcagctgcagcagcagctagaggagcagaagcagcggcagaaggctccctttcctgcagcctgtgaggcacctggccgagggcctcccctagcggctgctgagttggcccagaatggccagtattggcccccccttacacatgcagccttcattgccatggcagggcctgaaggacttgggcagcctcgtgagcctgtgctgcaccggggtctccccagctctgcctcagacatgtcactgcaaacggaggagcagtgggaggccagccgtagtggcatcaagaagcggcactccatgccacgcctgcgggatgcctgtgagctagagtctgggactgagccctgtgtggtcaggaggattgccgacagcagcgtgcagacagacgatgaggatggggagagccgctacctcttgagtcggcgacgccgggcacggcggagtgctgactgcagtgtgcagacggacgacgaagacagtgctgagtgggagcagccagtgcgccgccgcaggtctcgtcttccccgccactcagactcaggctctgacagcaagcacgatgccactgcctcatcatccagtgctgctgccactgtgagggccatgagcagcgtgggcatccagaccatcagtgactgctccgtgcagacggagcctgaccagctgcccagggtctctccagccatccacatcacagctgccaccgatcccaaggtggagatcgtcaggtacatatcggcgccagagaagactgggcgtggggagagcctggcctgccagacggagccagatgggcaggcccagggtgtagccgggccgcagcttgtagggccaactgccatcagcccctacctgcctggcatccagatcgtcaccccagggcctctgggcagatttgaaaaaaagaagccagatcccctggagattgggtaccaggcccacctgcctccggagtctctctcacagcttgtgagccgccagcctcccaagtcccctcaggtcctctactcaccagtctcacccctgtcccctcaccggctcctggacacctcctttgcttccagtgagaggctgaacaaagctcacgtgagtccccagaagcacttcacggctgacagcgctctccgccagcagacgctgcctcgccccatgaagaccctgcagcggtccctgtctgaccctaagcccctcagccccaccgccgaagagtctgccaaagagagattctccctctaccagcaccaggggggactgggtagccaggtgtcggcgttgccacccaacagcctggtccgcaaggtgaagcggacactgcccagcccccctccagaggaggctcaccttcccctggctggccaggcctccccacagctgtatgcagccagcctgctgcagcgagggctgacggggcccaccactgtccctgctaccaaggccagcctgctccgggagctggaccgggacctgcggctggtggagcatgagtccaccaaactgcgcaagaagcaggcagagctggatgaggaggagaaggagattgacgccaagctcaagtacctggagttgggtatcacacaacgcaaagagtctttggccaaagaccggggtggccgtgactacccacccttgcgtggtcttggcgagcatcgtgactacctatcggacagtgagctcaaccagctgcggctccagggctgcaccactcccgctggccagtttgtggacttccctgccactgccgctgctcctgccaccccctctggtcccactgccttccagcagccccgcttccagcctccagccccacagtattctgcaggcagtggtgggccaactcagaacggattcccagcccaccaggcccccacctaccctggccccagcacgtacccagctcctgcctttcctcctggtgccagttacccagctgagcctggcctgccaaaccagcaggctttccgccccacaggccactatgcaggccaaacacccatgccaaccacacagagcaccctttttccagtccccgctgatagccgtgccccactgcagaagccacgccagacatcgctagccgacttggagcagaaggtgcccaccaactatgaggtgatcgccagccccgttgtgcccatgtcttcagccccatctgaaaccagctacagtggcccagcagtgagcagcggctatgagcagggcaaggtccctgaggtgccccgggctggtgaccgtggcagtgtgagccagagcccagcccccacctacccctctgactcacactataccagtctggagcagaacgttcctcgaaactacgtaatgattgatgacatcagtgaactgaccaaggacagcacctctactgctcctgatagccaacggctggagcccctggggccaggcagcagtgggcgtccagggaaggagcctggagaaccaggtgtccttgacgggcccacactgccctgctgctatgccagaggagaagaggaatctgaggaggactcatacgatccccgcgggaagggtggccacctccggagcatggagagcaatggtcgaccagccagtacccactactatggtgacagtgactacaggcatggggctcgagtagagaagtatggtccagggcccatggggcccaagcatccctccaagagcctggctccagctgccatctcctcaaagcgcagcaagcaccggaagcagggcatggagcaaaagatatccaagttctcgcctattgaagaggccaaagacgtagagtcagacctggcgtcctaccccccacctgcagtcagcagcagcctggtctctcggggcaggaagttccaggatgaaatcacctatgggctcaagaagaacgtgtatgagcagcaaaaatactatgggatgtccagccgggacgcagtggaggacgaccgcatttatggcgggagcagccggtcccgggcaccttctgcatacagtggggagaagctgtccagccacgacttcagtggctggggcaaggggtacgaaagggaacgggaggctgtggagcgacttcaaaaagcgggccccaagccctcatccctaagtatggcccacagccgggtacgaccccccatgcggagccaggcctctgaagaggagagccccgtcagtcctttggggaggccccgccctgccggagggcccctccctcccggcggggatacctgcccacagttctgctccagccactccatgcctgatgtccaggaacatgtcaaggacggacctcgggcccacgcatataagcgtgaggagggctacatcctggatgattcccattgcgtggtttccgacagcgaagcgtatcacctgggccaggaggagacggactggtttgataagccccgggatgcccgctctgaccggttcaggcaccacgggggccatgcagtttcctcctcctcccagaagcgaggccctgccaggcacagctaccatgactacgatgaaccccctgaggagggcctgtggcctcatgatgagggtggcccaggccgccatgcctcagccaaggaacaccggcacggtgaccacgggcggcactcaggccgccacactggtgaggagccgggacggcgtgctgccaaaccacacgctcgggacctgggtcgccatgaggcccggccccactctcagcccagctctgctccagctatgccgaagaagggtcagcctgggtatcccagctctgctgagtactcacagccatcccgtgcttcatccgcataccatcatgcctctgacagcaagaagggctcccggcaagcccactccgggcccgctgcactgcagtcaaaggcagaaccccaggcgcagccgcagctgcaaggtcggcaggcagctccaggaccacagcagtcacagtcaccatcatccaggcaaataccctctggggcagcatcacgccagccacagacacagcagcagcagcaaggtcttgggctgcagcccccacagcaggctctgacacaggctcggctgcagcaacagagccagccaaccacccggggctcagcccctgctgccagccagcctgcagggaagcctcagccaggccccagcacagccacaggtcctcaaccagcaggaccgccacgggcagaacagacaaatggctctaaagggacagccaaagcaccgcaacaggggagggctcctcaggcccagccaacaccaggacctggacctgcaggtgtgaaggctggagccaggcctggaggaaccccaggggctcccgccggccagccaggtgccgatggggagagcgtgttctccaagatcctccctggcggggcagccgagcaagctggcaaactgacggaagctgtctctgcttttggcaaaaaattttcctcactctggtgaccatgcccagcatggctcttgaagaaatgaagagaggtatcattgctgtggaaaaatctctggagtcagaggcctgggcgcagctctggactctgcgtataacacatctacaatctggcaaacccttggcccaaagactcaccaggtgggacgtggcaggcaggcctcagttgaggacgtgatgttttctcacagcagctgcctgggtgaagcatctgctggacaagtcggaccactggccaggggacctttgattgtctttccagagatgctgctctctgcagggcaccaccttcaaggcacagcccttgttgggagggagaaccctctccagaaaccctgccaccatggtgtcttgccgtacttcccacagccgcctttttgcggcctggccggccaggcttcccgtgcgttatacacagagtttgggcacacactgccctccctccgagatgccagaagtttttccacagccttggagaggggctttgactgagggctgggggccctgggctccgtttccttcacattccagctggcccggatccctctgtggcacagggccctgcccgtcacatgccctctgggtgacatcggagcagacctccatgtggccaggggttgggagaactttacaaacattaggacctaacactgtctcatcgctgaaataagaggccatagcaccgaaaagcagcgtgggcgccggctgaggcttctcccagcccgtgggtggcagcgtgctagcacactgccaccatctcaaagccatccccctagccatcgtgagcatcccagcggcaccgccattgtctcaaccagccggctcctcgtctgtacacctggggatttcttttgatttcaagaacagccttaatcattccagtttgatttacgtgtatacctcataaacatttttcttttgtttctctctccccctttctctcttctcttggctcactcccttgcctctccccctccaccaccaccttgtgactgatggtttggtttcctctctgctctgcccctgctcagcacagggagaatgttgacttagaagcaatagggggcagcaggccaccaagagcacaaccccagggcgaggtctggggaggcctcccagcccgcctctgtttactgtgcaattccagtcgttcttaagccatcaccagtgggtgtactcagagcagaggggccaggacttctgccagccaagggaaaggcccagagccctgtgcgggggaatgtggcactgtctatccatccggtggactgggcagcattcctccccagggctcttcccttgggggcctcctttcatctggggcacagccacaagtctcatctctaacgttctatgcaatgaaatataaaccctcaatgacaactgttaatatttaataaattccatgttatgtataaggagttaattgcaaacatgcaattgagaaactggatagatacactcataaaacccccacccctccccaccccacccctgctcccattgtgtgtgtgaaattctcagtctgtggcatgtttgacctgtggcaggactcgctgctgccaggtgagtcaccgcctgtcctgcagtggagcatgcacagctcgcagcctctttgcacgatttcatccattttaaatgcttgaccctcttgcttggagttctttttgcctcagaacctctccttcaggagcacttctagctgacttctgcacaagctagtgaggacctgccagaattgttgcctgagcgtgccaggctgcagggcaggcagtaaaaggcccccacataccctgcagttttctctgtccaggatagcaggtaaaaaggaatccccagagcagacgcaatggtaggagcctgcacaggatgtgtgtgtatggacattctgaaggtttgctgtaggatatctgtctgtctgtcattttcccttcctaccccaaccctgagccagaggcatctgacagccctttcccagagggcaccacgcaagggcagagctgggcggcatccacagccagagaggcagaggcaagagcagagccaggctgtgcccgagggaccccagctcttgactgcacctgtttcatgcctctcctctgtggctaggaggctcaaaggactgtgagccgggagatctgggctggagctagggggtcaatggatgctcaggaagagctgggcctttggcacttgtggtgagaacagttgacagtggtcatctggaactgttcatataaacagtggcttcaagctaagtttcttgtgaagtttctcaatagcaaatcttacagaaggtcctgtgtgaccctctctgcatctgtccccaggacctatgctccctgctcacccccttctccaaagcccaagcgtcccgctgctcatcagcttttttaccattgagccaggagtgcggcaggcagtacctgcctgacccttcaaggcctgaccttcgtccagagtgctctggtttgcaccatgcatttctcaggggtccgcatttctcatgcttttctataagatctacacaccccttcagagagggctcctcgctcacctctggtagctatggatgggacaggaagctgccaacctttgtgttggacttaacacccttgcctttctgggacttggcctcaccccacccatggaatacctgcctcatcccaaagatcaggtatgggctgaatgcagccatctgagcaagggctgagggaagccatcatctaacacctctggccacccaggaccaggtctgtgtggggatgtgccttggagaccaaggcaatagtcctttccactacaggccaggggatgggacaagaagtagggaacaggcagggaaatgttaggaggtcagcctccagcaggcctagtctcaggctctaaagtactgacttttcagcaaatttcctttctggccaagccctctgagtttgaaattctgacatctgccactcctcatcccccactgtacccacaggatacatcatcgcccctctgtgaaggtggctggagcaggcctctggtccatggactgtccttcctggcccttgcatggatgcagttgtgactctggggacaatgcagccagaagctgagggaccagcacttggtgccttggaaagtagagagcaacagacacatctccaaatgggcaaggagtctctagcatgcagcccaggccttctccatacccctctccccagcatcatgagcaagggcattgcctcctctctctgctcacttcagggcccagtgcactcacttcacagtgacagccctcccctacaatccttgggcagagcatgtggtctgagggcccacagtgaaagaacagcagtggtggcaactatgccttgccttctggagcctgtagggagttttccaggcaggtcctttgccaggacagcatggtcctgccctgttgtcccgtctgctctcctcttacccacccccatgctgtaaatacttgtcatcatggactccaacagggttagagggacaggcctaatcaactgaaactcctcggagatgccatctctgtctccctgggtgccagcagccctgctgccatgttcactggggtggcactggagagccatggcagtcgtgagatattgtatgtgtatgcacatgatcatgtgtgtatgtgcgtgcgtgcgtgtgtgtgtgtgtgtgtgtgtttctgcctcattcagtttctggggtcaaatcagctccttctctccaagtgcactaccctggagagtggtggccactcaataccttttcctctagctttcatgtcttgtttttgctttccccttcctcctccctctctccctttctttccttctctcctcctttatttgaggggggaagagtgctgtacaaagtcaaacaaacaagtttacagttgtaagtgcaatgacccgagtcctccacatgaccttgtgattgtgtgctgtccttctgtgctctgtgagaactcgtggtacttcagtgtccctccccctgtattgtgacaaggtaattctgtggtatcagaataaaaggacttgatataaacaaaaaaaaaaaaa

SEQ ID NO: 53070 - DNA, 2240 bp, Homo sapiens
cgcagtcgtcgcgccgccgcgccaagcatgcagtaaaggctgaaaatctgggtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagataaaaaaaaaaaaaaaaaaaaaaaaaaaaaaaaaaaaaaaaaaaaaaaaaaaaaaaaaaaaaaaaaaaaaaa

SEQ ID NO: 53071 - DNA, 2393 bp, Homo sapiens
actttctagctgaacactcagcttcatccactccaggacagctgagcgtctggatggtgtctcaccctgttgcccaggctggaatacagtggcacgatcctggctcactgcaatctccatctcccgggttcaagcgattctcctgcctcagcctctcaagtagctgggattacagggcttcagaagctgatggcatagttatgagaggggtgaagactgcgactgcatttccaacagaccctgaggacaattgggaagaatgcgctgaatatttttgagcaatttctatatgataagcagtttttagggcaagtataggttgcactgatcctgaccttttggcctgaggatggaagtcttcagtatctgtacaactttactcccaagagctggtgtagaatgagttcctctggccatgggaggatcgcagaggggcacctgccaccagcagcccagcctcagcacttttctcttcagcgtcttcttcaaggtatttccagttgcccgccctgaactgtttcagaatgaggaggacacctggaggaatctacacgtgcatagaccaatttgcaaaagaacctgtgagccaacattattacctcagctggaagaattaataagcaacacgttcacccaagaagtatttactgagcacctactatgtgcattattttctggtgttggggctagggggcaaacgactctgacaagtctctgttctcaaggctggagtgcagcggcgcgatctcggctcactgcaagctccgcctcccgggttcacgccattctcctgcctcagcctcccgagtagctgggactacaggcgcccgcaaccacgcccggctaatttttttgtatttttagtagagatggggtttcaccatgttagtcaggatggtctcgatttcctgaccttgtgatccgcccgcccccgcctcccaaagtgctgggattacaggcgtgagccaccgcgcccggccgtagtttacattttctaaagcgtactctgccagccaagtggcaaacagacttgggcctcttaagagtggaagcaggaggaaacccgaagatcctggagagagactggtggctggtaccagtggagagggagcaaaaaggaaaatacaggatacaatttcaggaaaaatttcataccaatttcctgaggtaatttctgaactcgaacattttcagtgtcaccacattgtgtttcctgctgaatcaagtctacatcacttcggtttttaaagccttccacgatccttccctgaacactgtagttttcactgatggttggctgtttcaaactcccatgtgatccatactgtatcattaataagcaagcaaggaataacacaccctctgctattctgtgcagtgtttcaggtttttagttttctctttcaagatagaaaatccctttagagtaggaactcggctggcactttctttcacatcctgcatagcacttagcaaagttctgtacacagggcacatgtggaaattgcttattgattgattaaaagcatatatcactggcatttgtatcttcagtatttctcttgtatgaagaagggtgattatctgtcaatattcattgcatcattgaaccaatgtacaatgcattaatcatcactgaagataaccagatgaggctttattgtaatctccttctattttgctgagataatttcacttgctttagagtttatgaggccataagtggctcccatctgttgatgaacatatttctaagagtcatttagtctcaagtatggaatacttgaggggaagttaaattgtaacttttatattaagtgtcatcttagtaacagaaccaaaattggaagcatgtgttcaattttggtttttcattttcaaagctttaggtcaggcaaagaattaatttcatttgtttacaaagtagattatgcctaataaaatctattttgtttatggtcacattttaatcaatccactgctttagaaaatgagagaattctgattggctagtcattcaacatagtaaattacattattccacatccacagaacactggcctaactgcattatccagtaatgataaaaatattccttttaatacattttgagcaaggcatataccagtggtgaaacagggaagaatcttgtttattccatccttgtttgatgatcgaccacagaatataacataacacttctgtgtataagaattttttcaacattaaggataataaggacaaggtagttttcactggatccttactggtactctgaattttcactatttgtccgcatttcttctccttcccggaaatttgttttctgcgaaaaacaagtgctactttgtcaaataaagcttaaataaaattggtttcaatttatgcataat

SEQ ID NO: 53072 - DNA, 1562 bp, Homo sapiens
atcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcagcctgcgtggaagcctatgtgaaggaggcagagcagcaggcctgtagccacggctgctggagccagcccgcggagcctgagccggagcagaagagaaaggtcctggaggctccaagtggggccctctccctcttggacttgttttccaccctctgcaatgaccttgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtggaccctgtaggccccctggacaaggtgaggaaggccaagatccgagtcaagaccagcagcaaggccaaggtggagtctgaagagccacaggacaatgacttcctcagttgcatgtcccggcgctcgggtctgcctcgctggatcctggcctgctgcctcttcctctccgtgctggtgatgctgtggctgagctgctccaccctggtgaccgcgcctggccagcacctcaagttccagcctctgaccctggagcagcacaagggcttcatgatggagcccgattggcccctgtacccgccgccgtcccacgcctgtgaggacagcctaccaccctacaagctgaagctggacctgaccaagctgtaggcctccactggccccatcactgccaactgcagggggcccctcgggcctcacttgccctgagcccaggagtccaagggcagggtgggtccagccttgagcccctccacccccaaatccttcctctcctcccagtcccaccccttgccccacggagtcctggggacgcagtgccccagctgggaagagggcgggatcgggcactggttcctccttgtccccgctttcttgggggcttgctactttttgtcttctattgtgtggctttctgagtatttgaaccccagtcctgtgtcaccttcctttttccttctatgtcccctctctgcggggggggcgctgaggctgagggggagctgcgtcttgctagggcttcccccttctccccatcccggtctccagagacccagcttttgagagacagggtgtgggcatctccatgcccctataaagcgtgcctggggcttgtctggggctgg

SEQ ID NO: 53073 - DNA, 2066 bp, Homo sapiens
agcgggacatgagggctccgtctcccgagtgatggcagcgcgcgctgcttcgccgcctccgccgctcagccccggactccttacgtcagggtagcggggtcccccctccgcgcgggagccagcgaacagcgagagagcacagcagagcgcgccgcggtgccggggcgccctcactgcgctaggagccccactaaacccagcggagcggagcctggcgggaggcagcgccgcggagccagcgccggacgccgcaagcagactccccggccagcgcaagcactccctggccggcgccggaccctcggggcgccggattcgtcttgtgtgccccacgtcatgcgcgcgggcgtccgcggctctcccgaccagccccagcgcggtgggcccaggctcagaggtcccggcgcctctcgctgaagtagttgggtagccggggctgggggtcgccacgtcgggggcgcggccaggacccgcggagccggtccccgagcgcggggagcggggccgcccgcgccgtcccaccattacctccccgggcggcaaggaggagctggtggcggtcgcctcccggctgtggcagcggcggcggcgtgcctgcctggcggccgtcggcgtactcttggccatggcgctcgggctgctcatcgccgtgccgctgctgctgcaggcggcgccccgaggcgccgcgcactatgagatgatgggcacctgccgcatgatctgggaaccttacactgccgcgcccggcggggagcccccgggtgcaaaggcgcacaaccccggacccagcaccgccgccctggaagtcatgcaggacctcagcgccaaccctcctcctcctttcatccagggacccaagggcgacccggggcgaccgggcaagccagggccgcgggggccccctggagagccgggcccgcctggacccaggggccctccgggagagaagggcgactcggggaggcccgggctgccagggctgcaactgacggcgggcacggccagcggcgtcggggtggtgggcggcggggccggggtaggtggcgattccgagggtgaagtgaccagtgcgctgagcgccaccttcagcggccccaagatcgccttctatgtgggtctcaagagcccccacgaaggctatgaggtgctgaagttcgatgacgtggtcaccaacctcggcaatcactatgaccccaccacgggcaagttcagctgccaggtacgcggcatctacttcttcacctaccacatcctcatgcgcggcggcgacggcaccagcatgtgggcggacctctgcaagaacgggcaggtccgggccagcgccattgcacaggacgccgaccagaactacgactacgccagtaacagcgtggtgctgcacttggattcaggggacgaagtgtatgtgaagctggatggcgggaaggctcacggaggcaataataacaagtacagcacgttctcgggctttcttctgtacccggattaggggcgcggggggtgcgaggcggggtggctgcaggccgcccggtctccgcccgggcgcggctccttggcaaaggccactctcgattcataacacttcctgacatctcctttggaaaagacaaatccctgcgtcctccctgccccgctcctggcctcagtgcgtctgcgacccaccacgctcagggctgtgctcctggtctccatccccatcccggcaagggaggaagggacgcccgagcccttgaggcggcggcacagactttgcaaacctgattagactggacaggcagggccgggagcctgccctcctcagacagcctcctcccagtgcctagaagcggagggctccgggccctggccagggaggtaggccagagggagcgcgggcttcctggggcgtccttctttgtgacccgaaatacttgtgcagatttccctgtccatcagccaaaaccccacccacagcagaattccagcaaacagaaaattcacctctccacaccgcattccctcctgactcagactcaccgcgatgcattaaattatgtttttagactttgaaaaaaaaaaaaaaaaaa

SEQ ID NO: 53074 - DNA, 2493 bp, Homo sapiens
tcagagtaatgccaaactctctctgagtgggatgagcagagcagatgctgcaatgagatgccaaagcggctccccttcctctgtgccttgggtgcctataaattgctccggcgcgcgtttgtcagcctcctcttctcctggcaggtggtacccaggcagaattctgccttcagtctctctctcgctccgctcccggccgtgaggcgctcgccgctgctcgctcgctcctccgccccagctctgagcctcgccgtgccgaccgtgcccgccgccgccgccgctgggcgcacccgggggacgcccgggcccacgcggggctttggggtgcgcgtctattcgagttgtggtggtggcaaaggaggaagagagaaaggaggcaataaaaaaaaaaggcagcggacgggcgaactgagcgagcgaaagaagaggaggaggaggcagaaaaaggcaacttcagacggaaagttggtgcgaacaggcgcagtctgcaaaaacggaaaagtcgatcgcaggcggcggcggcataaaagtgtgagctgcccgggcgagctcaggaggcggcggctggctctgccctcccggtggccgcgccggcgccggctgcagccacaggtgcgaaggagctcgcggggggcgagggcgccccgcgcacccctcccccggcccccaccccgggctcgggacttcggctcaagtcactgggcgcccgcgctccctccccagccgcagcctccgcggggggagcaggagtcggcagcagcggccggcgcacgcacgcccaggggagttggggttcgcagggggttgttttcggctctgaagaggtccccgcccaaccttcaaaattctgtccaaaagcagacaagaggatcgccccgcgctgagccggctggtgggcagcaggaggcgcctgatcgccgccggggcgctgggggtggtgatggtgctgctgctggtgatcctcatcccggtgctggtgagctcggccggcacgtcggcgcactacgagatgctgggcacctgccgcatggtctgcgacccctacgggggcaccaaggcgcccagcaccgctgccacgcccgaccgcggcctcatgcagtccctgcccaccttcatccagggccccaaaggcgaggccggcaggcccgggaaggcgggtccgcgcgggccccccggagagcccgggccacccggccccatggggcccccgggcgagaagggcgagccgggccgccaaggcctgccgggcccgcccggggcgcccggcctgaacgcggccggggccatcagcgccgccacctacagcacggtgcccaagatcgccttctacgccggcctcaagcggcagcatgaaggctacgaggtgctcaagttcgacgacgtggtcaccaacctcggaaaccactacgaccccaccaccggcaagttcacctgctccatcccgggcatctacttcttcacctaccacgtcctgatgcgcggaggggacggcaccagcatgtgggctgatctctgcaaaaacaaccaggtgcgtgctagtgcaattgcccaagatgctgatcagaattacgactatgccagtaacagtgtggttcttcatttggagccgggagatgaagtctatatcaaattagatggcgggaaagcccatggaggaaacaacaacaaatacagcacgttttctggatttattatttatgctgactgataatgcagaaactaagcttattattctgagtttgaacactggattcgtatggctaacgtcagtgaatcaaggatcccaggggatgccaatggcagggcacctcagttgtgtatatgtggggaaatcaaatgctacctgactcacatctgtatcactcagaaacattatgtaaaaaatatcaaagcaagataagcagatgtgtgatccactaccgccaaagcaaatactccttatcgttagtgtccatgtgaatgaagtcctatatagatcacaaatttttatagacaaatctaagacattgaattatttcttctatatatatgatactttggtgtactgtgatcttgctgcttttatccatatgtcagctttggttcttgtgagtttacctgcttattatgatacttggagtccattcatagtgtggggaagaatgatttttgccctgcaggagaaggtctaattgaaataatgctgcttgtccccaaagaaattgtttgccttgtactcttgttaaccttagagctagacctgggaatgattcaacttcaagccttaacctggaattttctggatttgagggaattcccaagcctatgatctttttcacattttctttttcttatatgaattttcttttctctcttttctggtgatagtctttaaaaatagagattgacagtgtatcataggattaccctctaagtgtgaaaatgtgtaattatgtacggtatttagaaaaagcccttatgtgtccattttgtcaactgaatacatttagattc

SEQ ID NO: 53075 - DNA, 1393 bp, Homo sapiens
gaattcggcacgaggcgcccggcccctggccccagcaccctgtccgctgccgcctcagagccgggaaaagcagccggagcccccgccgcccctgccgcagcgcgggcggtcagcgcgcagcccggcacccgcagcctgcagcctgcagcccgcagcccgcagcccggagccagatcgcgggctcagaccgaacccgactcgaccgccgcccccagccaggcgccatgctgccgcttctgctgggcctgctgggcccagcggcctgctgggccctgggcccgacccccggcccgggatcctctgagctgcgctcggccttctcggcggcacgcaccacccccctggagggcacgtcggagatggcggtgaccttcgacaaggtgtacgtgaacatcgggggcgacttcgatgtggccaccggccagtttcgctgccgcgtgcccggcgcctacttcttctccttcacggctggcaaggccccgcacaagagcctgtcggtgatgctggtgcgaaaccgcgacgaggtgcaggcgctggccttcgacgagcagcggcggccaggcgcgcggcgcgcagccagccagagcgccatgctgcagctcgactacggcgacacagtgtggctgcggctgcatggcgccccgcactacgcgctaggcgcgcccggcgccaccttcagcggctacctagtctacgccgacgccgacgctgacgcgcctgcgcgcgggccgcccgcgccccccgagccgcgctcggccttctcggcggcgcgcacgcgcagcttggtgggctcggacgctggccccgggccgcggcaccaaccactcgccttcgacaccgagttcgtcaacattggcggcgacttcgacgcggcggccggcgtgttccgctgccgtctgcccggcgcctacttcttctccttcacgctgggcaagctgccgcgtaagacgctgtcggttaagctgatgaagaaccgcgacgaggtgcaggccatgatttacgacgacggcgcgtcgcggcgccgcgagatgcagagccagagcgtgatgctggccctgcggcgcggcgacgccgtctggctgctcagccacgaccacgacggctacggcgcctacagcaaccacggcaagtacatcaccttctccggcttcctggtgtaccccgacctcgcccccgccgccccgccgggcctcggggcctcggagctactgtgagccccgggccagagaagagcccgggagggccaggggcgtgcatgccaggccgggcccgaggctcgaaagtcccgcgcgagcgccacggcctccgggcgcgcctggactctgccaataaagcggaaagcgggcacgcgcagcgcccggcagcccaggcaaaaaaaaaaaaaaaaaaaaaa

SEQ ID NO: 53076 - DNA, 1793 bp, Homo sapiens
gtgcggtcctttcctctgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatctgatcacagaacaggccgatatcgcattgacccggggagctgaggtgaagggccgctgtggccacagccagtcggagctgcaagtgttctgggtggatcgcgcatatgcactcaaaatgctctttgtaaaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggcaaaaaaaaaaaaaaaaa

SEQ ID NO: 53077 - DNA, 3680 bp, Homo sapiens
gaacgtgccaccatgcccagctaatttttgtatttttagtagagacggggtttcaccatgttggccaggctggtcttgaactcgtgacctcatgatccgctcacctcggcctcccaaagtgctgggattacaggcatgagccactgacgcctggccagcctatgcatttttaagaaattattctgtattaggtgctgtgctaaacattgggcactacagtgaccaaaacagactgaattccccaagagccaaagaccagtgagggagaccaacaagaaacaggaaatgcaaaagagaccattattactcactatgactaagggtcacaaatggggtacgttgatggagagtgatttgttaagagactacagagggaggacagactaccaagaggggggccaggaaagctcctctgacgaggtggtatttcagcccaaactggaagaatgagaaagagctagccagccatcagaatagtccagaagagatggggagcactacactcactacactttggcctgagaaaatagcatgggattggaggaggctgggggaacaccacttctgccgacctgggcaggaggcattgagggcttgagaaagggcaatggcagtagcagtagaaaggacagggtaggagcagggactttgcaggtggaatcattaggtcttatcaacagatatgggcaagcaaagccaggggagaattgatggtaatgctgaggtttggagccaggctagatgggacagtggtgggtgatgcaaaggaaagaggtcaggaagcagggccagacgtggggagaaggtgtgggggtttggtttccatcttgccgagtctgccggaatgtggatgggaagaccaagaggaggagcaaggggcagaggggaagggaatcttaaagaagtcctggatgccacactcttcttccttcctcctcttccctctcctcagaggtctcactcgtggttcttcatttcctgccctgcctccatctcctctgggtgctgggaaagtggaggattagctgaagttttgcttctcggggcctgtctgaatctccattgctttctgggaggacataattcacctgtcctagcttcttatcatcttacatttccctgtagccactgggacatatgtggtgttccttcctagctcctgtctcctcctcatgcctttgctgggtatgggcatgttagggggaaggtcattgctgtcagaggggcactgactttctaatggtgttacccaaggtgaatgttggagacacagtcgcgatgctgcccaagtcccggcgagccctaactatccaggagatcgctgcgctggccaggtcctccctgcatggtatgcagcccctcccatgtttctggccactttgtcctttctcctcccgtttgcacatccctttggaactgtttcctgtgagtacatgctggggtctcccctttcttcccttgctcaggtgaatctcagccccttctcccacccaaaggttcacatggatcctaactactgccacccttccacctccctgcacctgtgctccctggcctggtcctttaccaggcttctccaccctcccctatctccaggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgcccccactcccggggcttgccgggggttgcccggggcctctggggcatggctacagctgtggcagacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccgccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctctaaaa

SEQ ID NO: 53078 - DNA, 3186 bp, Homo sapiens
gtcttttgtggacccgcacaatgatccctgagccagactggattaggatgcctcgcgactaggggtccagagacagaggcctccagttcccaggcacttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatgggcacagagaagggagctgttctgatgagaggatccagacatctcaagaagatgactgaagagtatccagcccttccccaaggagcagaagcctctctaccactgacaggcagtgcttcctgcggcgtccccggcatcctccggaaaatgtggacaaggcacaagaagaagtctgaatatgtgggagccaccaacagcgcctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattaccctgggatagggcacaggaaagaaatgtccctcgaaggcaatataaaactgccccttcttagaattgctaaagccattggtctgaaagtgactttgggaggtcataaagtttgtatctctatctttaagcaaaaaattaaactttcccagctcattttaaagacctccaaggaaggaaaaaagcaattcctctgtcttccttgtgagttgctctaaagtgtgtgattttctagtgtaaatggactttgaggcacttgtaaacacaatggttcttactgtttccattactgcatttacttcaccttgacaaggtacaattttcaaggacaaagcactatatataaagttagtagttctaatatccacttgagagtatactcaagattgattttcatggccatttggcatgattgcatgaattctctattcttttatgtgcagtttttctatagaaaaacattaaaagttaaatgttgactgctaatgttttctgaagtggcatagtctagtggaatcaataatcccttgctttggtataataatttgaacttttgaaagtgctttctcatccgttatctcttatcttcacaaaacccctgtggaagaaagcacaattattcccaatctgcagagggggaaatggaggccttcagagattacaggaccagataccaggtagtggaaccagacagcaggtccttaacttctctccagtggactccctgctttgcctactctctagcaactgacttggggaagtttttaaatggtgagagtgtgtctctgggggcaaccattgaaaagaagactctgatatgttggaacaagtaagggatttgaatgaaatacactattatatcttatacgttagcttgaaccagaaaaagttgacatttttgtaggtcaaaaacaattgagcatcaatttcatatggttcaacctcatatatgatactatgcttttcttctatcagtgaaaatgtcatcatcaattccattgtcaacattagtagccttaaaacaataacataataataatgatgataatgatacttatagctatcatctattaaatgcctatgtttcaggcatgatactaggcaatttatatatatcatcctaatctttctaaaaactctattaggtggccctatccacttaatagatgccaattcaaagaggtttaaatgattagactaaggcacctaacttatgtgagtgtcaggcttcaatgcctgtgttagagctactccttcacacaaaatagttcagaacatagagaaggaccaaggttaataaatgattttcatcccaaacactaaacatgattgatgggtagaggctgcccgaagtactgtgtaaagatggaatctgagatagaagaatgctgtggtcaattagtaattcttgcccatggagggattagtgacacatgccttgtatatttgtcatctgtggcctaaactctgcccctgaaggtttgttttctaattcagaggtttaaattaatctagcccacttaataaaaccagagatcctatgggaaatttagcctaagacagtgctggaaattgccatatgttgatacaaagaagtgtttggccacattacaggtctcagactcaactgctatgtgtgactgccgctctgtgcctatgtcttgcttttttgctgagttccctatttccatatctccaggtgaatccatgagaagcgagagggtggctgagaggcctgggcctctgggattccaccttgctatctctgctcttcaaccattgttttagactctgaacaccagatcctcatatctgaaagtgatttggagacctgggcatcaagtgctcttttaagaaggggctatcccagaggactgttcaaaagtctcattcaatagagatgttggagtccagaacaaagttagggagcaaaccagtaacctatgctggtcgtaacagaggatcctacaattacgtttgtttttaagacaggattttgctgtgttgcccagactggtctcaaactcctgggttcaagagatccatcctcccacctcagtctcctgaaagctgggatgacaggcacatgccaccacacctagctccttacaaccatttattttaacttatttcatttataactggtatctttcatttgtatgtggcagctagagatttatataggatggaagtaatttatttttaatttaaatatttcatgttgaactgtttgccttgtatggaacattttacttggccaattcaaataaaaataaagtcagctttgtttgtgaaaaaaaaaaaaaaaa

SEQ ID NO: 53079 - DNA, 3210 bp, Homo sapiens
tggggacccctgcagttgtattgcggaaaatctcgacagcggcgctagttgcgggcgatggaagccaggcaactgggggttctggggagttcaggaaaatagcagaggagcaggaagggcgcgcgcgacctggagagtctgtgtgcccccaccgcgccccagtccccggggcccagcccttcccctcggcgccctggacgcactgccggaacccggctgagaggctgcaggctgcgcgcggacctggggagcagggagggtcggcggaggctgccggcggctggcggtttcgggcaataatccctgcctctctttctctgtgtgtctactgtgtctgctccttccccgccccccggaagcaggagaagaactgccccggagcgcagcagccaccctccgaccatgccccggtgaggggggcggacttcgagggcaacttgccgcggactgcctgggcttagccagcgagctacgcgctcccgggagcccggaattgcacggcgcagcccggcggggggctatcgtctatgtcttcttggggcgcaagacgaatcggggtctcgtttttgctggaagagccgagtgttggtggcttcaggtggctgctgccgccgccgccgccgccgccgctgctagtgcggtttccgccgctggtgcgaagagaagagacacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatggaaatagtctgggaggtgctttttcttcttcaagccaatttcatcgtctgcatatcagctcaacagaattcaccaaaaatccatgaaggctggtgggcatacaaggaggtggtccagggaagctttgttccagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagaataacatataaaaatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcagatgcattccttgcgcctgctcagccagaaccagccatctcagatctttctgagcatgagtgacaacttcaggcctgtccagccactcaacaaccgctgcatccgcaccaatatcaacttcagtttacaggggaaggactgtccaaacaaccgagcccagaagcttcagtatagagtaaatgaatggctcctcaagtagggaacaaagccaagaagaatcccacctcagtgaaatgctacaactgtgaattgacgtaacctagaatgtcccccttcttgcttctctctcattctttcccccaagcctcattcattcttgggattggccctttcttcatgaaaagtgtctgcaaaaccatggcagaggaatacatctctcacacatactcacaaacacacacacaagcacttgcacatacatacaaacacatgcaaacatacctacacacacacacactcttacaacctccatcatgggaagtcaagtttcagaaacaaaagtctcattcataagaggtcttagaagaaaataaccagttaacctgatttcaattttgataccgttttcctgaactaataaatctacccaatgagacttttcagcctttgtacatacaaaattcttccaaaagagagaggagaaaatacagctctgatggcatcaaacggactttgcatcaagtaatttcagatagtgtcctaggatcctttgagggtgctggtagcaggtgagcaggacaaagttgaccaaggacacttatttctagattatgattcttctgtttactcaacaatttacaaagaaaaaaaggacagacattgaagagctacacattgtatatatatcaccacagactataaggaaatggaattatttccctctttgtcacatatctgtagtaggatttgccaagatcagaaatgatccatttgctgtttcttgttttccaaaggtcatacattgtgtttggttattgttaccagctcaataaatgtgtttaacgagttaatttcatttttctggctttggtctgttctccttccttacaggctaagccctggctccatgcaactgcattctttgatttcacttgttccttcatctacatgttttgttcatttgcagccagtttttactgagtttgtggcaatcaggaatgcatttgctaagcaagtatgactttaattccactccatggctcaatcattcacatgaggtgagcttcagcctgagatagcaggcgacagacttcttgcgtttcaagactgccatgcccccctgtgatgctcccgtgaaggaatgcactttgccttgtaagttcctgggaaaggggtatgttttctctccaggtgcagccagatctcacaaagtacaaaacgaatgcctttcttttcttgtttataatggtcactcactgtgtttggttactgtcaagaaatcaataaatgtgtttaacaagcaaaaaaaaaaaaaaaa

SEQ ID NO: 53080 - DNA, 1627 bp, Homo sapiens
cgcccccagatctgcaccgccagccgccgggagctccgggctccgggcgtagaggctgcgctgtcacatgggcggcggcgacggggccgcatttaagcggccgggggacggcgcccgcctccagcgcgtcctcgggcttggctcccgccgggagccccgttctctgcccgccgggggccccgcgccgcgccgcaccgcgccgcccccgccgggccatgcgagcgcgggccccgccgcgatgagctcgcacatcgccaaaagcgagtccaagacgtcgctgctgaaggcggcggcggcggcggcgagcgggggcagccgggctccccgccacggccctgcccgggacccggggctgcctagccgccggctacccggctcctgcccggcgacgccgcagtcgtccggggaccccagttcgcggaggcccctgtgccggccggcgccgcgagaggagggcgcgcgggggagccagcgtgtgctcccccaggcgcactgcaggccccgggaggcgctgccggccgcggcgtcccgaccttcgccgtcgtcgccgctgccgccggcccgcgggcgggatggggaggaacggggactgtccccggcgctcggcctccggggctctctgcgagcccggggccgcggggactccgttccagccgccgcgtccgaggcggacccgttcctccaccggctgcgccccatgctcagctccgcctttggccaggatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggaggcgcccaccccggacccccacccctccgcactgtgaaagactaactcctgcaactggaaagcgggggcgcccgccgacgaggaggccaccgtgccaagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaatatttccaagagcaaaaaaaaaaaaaaaaaaaaaaaaa

SEQ ID NO: 53081 - DNA, 1021 bp, Homo sapiens
aagtccctcagtcccccaggagcctccttcatggacccggggatcccaagaggggctgcctcaacttaggatgggcaactgtgtcaagtatccactgagaaatctctcaaggaaggatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggaggcgcccaccccggacccccacccctccgcactgtgaaagactaactcctgcaactggaaagcgggggcgcccgccgacgaggaggccaccgtgccaagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaatatttccaagagcaaaaaaaaaaaaaaaaaaaaaaaaa

SEQ ID NO: 53082 - DNA, 1201 bp, Homo sapiens
aagtccctcagtcccccaggagcctccttcatggacccggggatcccaagaggggctgcctcaacttaggatgggcaactgtgtcaagtatccactgagaaatctctcaaggaagatgtgccaggaggaacagaccagctacatggtggtgcagacgagcgaggaggggctggcggctgacgccgagctcccgggaccgctcctgatgctggcccagaactgcgcagtcatgcacaacctgctgggccctgcctgcattttcctgcgcaagggcttcgctgagaacaggcagcctgatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggaggcgcccaccccggacccccacccctccgcactgtgaaagactaactcctgcaactggaaagcgggggcgcccgccgacgaggaggccaccgtgccaagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaatatttccaagagcaaaaaaaaaaaaaaaaaaaaaaaaa

SEQ ID NO: 53083 - DNA, 7364 bp, Homo sapiens
gcggcggcggctgcggcggtggggccgggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatggaggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggaaacgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatatttgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacacgctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagtcggccctcgggggaggccttgcccaccttggtgaggctcctgtggcccctccctccccctcctcccctcttttactctagacgacgaataaagccctgttgcttgagtgtacgtaccgc

SEQ ID NO: 53084 - DNA, 2701 bp, Homo sapiens
tttttgcccgcctaagcgagccatagagccgtctccagagctgccggtgcctttaagaagactcggtctttcgggtcttctttttccccaatgggctccagtggtgcccgcagcaaaaggcaaacttgcctggctcatggggtgaaagggaggattgaagaatgccgcgttgggtgggtgctgagggagcgccagagtgcgctacgggcttcgctccccttcccctttccttaacccttcctagagcggaggaaccgggtcgtgctgcagcgcccaggagccagggcgctgactgtcctcggctccagaaactttgcgcggagagtgggcttgactgggcagagccgagccggctggctgacccgggaaggaacgggggaagggcggggtgagggaagaaagaccctttagcaccccgggtttctagcccgggcggcggtgtgcagctgcatgagggagctgtcccttcggcaccacggaccttaaagcctaggcgttaagacgacggaggcggggcaacaggcggggagctgtcccttcagcaccacggaccttggcgcccccagggaaaccagccggcccccgccccaggactctgtcttttctccagtttgagcgggggtgtcgggagcaggcggagagctttcctgcgaggctgtggaagcagtgaacactcttctcagcggctcgcctcccagcagtgctattttttgccatccgccctcacccccagcacacgcgctcgcacacacacgcacgcacgcacacacacacacacacacactcacacagagacctctctgggtttctttgccttgagtctcccggggctgtgagaagccaggcgcatctcaaaccgagctggcagctccaggctccggagccatgccctgcacggaccctcgtctttaccacgctcctgaggaatgaaaggaacccagggaccctcagaaggcagcagtgatgcggaccaaccccccggagcctgcacccttccgagggccataggcgacccagggaactggagagagctccagaaaggaaatcccagctttcccaaagtccctgtggatgctgacaaaaggagacctgaatttttggaagagcctgtactaggttacccggctgcagagtgattttcccctccggcactgactctccccctccaacccccagccgtccagagtaccatgaagaattatgaggatgtgtgacagaggtatccagatgttgatcaccactgtaggagcctttgccgcttttagtttaatgaccattgcagtgggcacggactactggttatattccagaggtgtgtgcaggactaaatctacaagtgataatgaaaccagcaggaagaatgaagaagtaatgacccattcggggctgtggaggacctgctgcctagaaggggctttccgaggcgtgtgcaagaaaatcgatcacttccctgaagatgctgactacgaacaggacacagccgaatatctcctgcgagctgtgagggcctccagtgtcttccccatcctcagtgtcacgctgctgttcttcggcgggctctgcgtggcagccagtgagttccaccgcagcagacacaacgtcattctcagcgcgggcatcttttttgtctctgcagggttaagcaacatcattggcatcatagtttatatatcagccaacgccggagaccccgggcagcgtgactccaaaaaaagttactcctatggttggtccttttatttcggagccttctctttcatcatcgcagaaattgtaggagtggttgccgtgcacatctatattgaaaaacatcagcagttacgagccaaatcccactcggagttcctgaagaaatctacttttgcccgcctcccaccctacaggtatcgattccggaggcggtcaagttctcgctccaccgagcccagatcccgagacctgtcccccatcagcaaaggcttccacaccatcccttccactgacatctcgatgttcaccctctcccgggacccctcaaagatcaccatggggaccctcctcaactccgaccgggaccacgcttttctacagttccacaattccacacccaaagagttcaaagagtcactgcataataatccggccaacaggcgcaccacgcccgtctgaactgacctctgacctctgccccacgcccagcacagccttgggggaagtgtacagagatgtctctgaggttgcatggcatggtccttgtgatggtattactttttacaaagaatgaaaccaaatggactcagccctctcccacattttcccctcaccctccaagtcctaacccctccatcctctctaacttttcaagccaatcccttaatgtcattcctctctctgtgtatctgtgccagatgttttcctttcttccttctttactggaaggacctccacattcttccctccttggaagaggactttactaaaagtcacaggtggtggccaggggggatttccgaatctccatcaggcgcgctcatagttgtccccattgtctacccacacaaatcctcaggaaaccaaccaccgcccaggtggccctgagggaggcattcacctttatgtgttagaaaaacatgaccagaaatcaaagatgtcagagccccgaagcagctaatgtaataagcactcatgttattaaaggttttgccttgtcgtaaccaaccga

SEQ ID NO: 53085 - DNA, 2507 bp, Homo sapiens
tggagcagctaatcctcacagacctgtaggagctggagtgggagctcaagcaggattcttcccgagtccctggcatcctcagaagcttcaactctggaggcaatgggtcgaaaggaagaagatgactgcagttcctggaagaaacagaccaccaacatccggaaaaccttcatttttatggaagtgctgggatcaggagctttctcagaagttttcctggtgaagcaaagactgactgggaagctctttgctctgaagtgcatcaagaagtcacctgccttccgggacagcagcctggagaatgagattgctgtgttgaaaaagatcaagcatgaaaacattgtgaccctggaggacatctatgagagcaccacccactactacctggtcatgcagcttgtttctggtggggagctctttgaccggatcctggagcggggtgtctacacagagaaggatgccagtctggtgatccagcaggtcttgtcggcagtgaaatacctacatgagaatggcatcgtccacagagacttaaagcccgaaaacctgctttaccttacccctgaagagaactctaagatcatgatcactgactttggtctgtccaagatggaacagaatggcatcatgtccactgcctgtgggaccccaggctacgtggctccagaagtgctggcccagaaaccctacagcaaggctgtggattgctggtccatcggcgtcatcacctacatattgctctgtggataccccccattctatgaagaaacggagtctaagcttttcgagaagatcaaggagggctactatgagtttgagtctccattctgggatgacatttctgagtcagccaaggactttatttgccacttgcttgagaaggatccgaacgagcggtacacctgtgagaaggccttgagtcatccctggattgacggaaacacagccctccaccgggacatctacccatcagtcagcctccagatccagaagaactttgctaagagcaagtggaggcaagccttcaacgcagcagctgtggtgcaccacatgaggaagctacacatgaacctgcacagcccgggcgtccgcccagaggtggagaacaggccgcctgaaactcaagcctcagaaacctctagacccagctcccctgagatcaccatcaccgaggcacctgtcctggaccacagtgtagcactccctgccctgacccaattaccctgccagcatggccgccggcccactgcccctggtggcaggtccctcaactgcctggtcaatggctccctccacatcagcagcagcctggtgcccatgcatcaggggtccctggccgccgggccctgtggctgctgctccagctgcctgaacattgggagcaaaggaaagtcctcctactgctctgagcccacactcctcaaaaaggccaacaaaaaacagaacttcaagtcggaggtcatggtaccagttaaagccagtggcagctcccactgccgggcagggcagactggagtctgtctcattatgtgattcctggagcctgtgcctatgtcactgcaattttcaggagacatattcaactcctctgctcttccaaacctggtgtctatccggcagagggaggaaggcagagcaagtggagcagggcttagcaggagcagtttctggccagaagcaccagcctgctgccagcggggcagcccctcataggaggcccaggagggagccccaaggcgtagaagccttgttgaagctgtgagcaggagaagcggtgcccaccagcttccaggtctccctgacctgcctgctctatgccccacaccctacgtgccgtggctctgtgcagtgtacgtagatagctctcgcctgggtctgtgctgtttgtcgtgaaaagcttaatgggctggccaggctgtgtcaccttctccaagcaaagccatatggagcatctacccagactcccactctgcacacactcactcccacctctcaagcctccaacctcttggccagattgggctcattaatgtcgttgcctgcccatctgcatgaatgacaggcagctccccatggtggtctgcctgtgagctcttcaagttctaatccttaactccaggattagctcccaagtgcgctgagacccagccagcacacttctggcccttctccctgcctcaatctaaaagcagtgccacaccctccaaagtggaatagaaagaagttcatgagtaagggctgcaaggaattcttatcctggccacatgtcctccgtgcacacacccaatggagttaaccttggaagttgactattttaatgtctgccaggagttctaatcctgcctctgttcccttttctctccttgaaagtccagcacaccattcttgtccttccccagtttcctcgccctccacccctccagcttcatgctcagtgttgtgcttaataaaatggacatatttttctctaaaaaaaaaaaaaaaaaaaaaaaaaaaaaaaaaaaaaa

SEQ ID NO: 53086 - DNA, 4836 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggatggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggtggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtaccctcgaccctcctgggtgttggttggagcagaactggtgaggatgtttgatccgagattttctgagctctccccaatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgtggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttctttttttttttcttttcttttttaaaaatatgtggctgtgaacttgaatgaacactgctcaaactttctgctattggggggggcgggtgggatgggaagaaggggcgtttgttttattcttggtgttttcagtgcaataaatagctacaaacttctgtgc

SEQ ID NO: 53087 - DNA, 4803 bp, Homo sapiens
agaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggatggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggtggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtaccctcgaccctcctgggtgttggttggagcagaactggtgaggatgtttgatccgagattttctgagctctccccaatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgtggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttctttttttttttcttttcttttttaaaaatatgtggctgtgaacttgaatgaacactgctcaaactttctgctattggggggggcgggtgggatgggaagaaggggcgtttgttttattcttggtgttttcagtgcaataaatagctacaaacttctgtgc

SEQ ID NO: 53088 - DNA, 3028 bp, Homo sapiens
gtgcgaatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcc

SEQ ID NO: 53089 - DNA, 908 bp, Homo sapiens
ggttgacccgggccctcctccacacccccttccttcttcgcctcctccctctttcctgcacgggggctcgggctcactataaaaggtgggagcgcgtggtgccccagcaacgacgagtttcagaacgatggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctgatcgaagcgctgcaagaagtcttgaagaagctcaagagtaaacgtgttcccatctatgagaagaagtatggccaagtccccatgtgtgacgccggtgagcagtgtgcagtgaggaaaggggcaaggatcgggaagctgtgtgactgtccccgaggaacctcctgcaattccttcctcctgaagtgcttatgaaggggcgtccattctcctccatacatccccatccctctactttccccagaggaccacaccttcctccctggagtttggcttaagcaacagataaagtttttattttcctctgaagggaaagggctcttttcctgctgtttcaaaaataaaagaacacattagatgttactgtgtgaagaataatgccttgtatggtgttgatacgtgtgtgaagtattcttattttatttgtctgacaaactcttgtgtacctttgtgtaaagaagggaagctttgtttgaaaattgtatttttgtatgtggcatggcagaatgaaaattagatctagctaatctcggtagatgtcattacaacctggaaaataaatcaccctaagtgacacaaattgaagcatgtacaaattatacataataaagtgtttttaataatt

SEQ ID NO: 53090 - DNA, 6138 bp, Homo sapiens
gctcgctcggtctccggctccggcgccggctcctgctcctcctggccgcccggggccaaggcgacgagaggttgtaaaaatccatgtgggacggccccggggcgagcatcggaaagatctctgagtggagttattttctggtacggactgtgaaaagaatgcggtgaaaattctggacaatcgtggaaatattagctcaaaccccaacttaatatagcatttcttctcttcagtaacacctcataatacaagaaaaatgtatggaagtgcaagaacaatcaccaatctggaaggtagcccttccagatcccctcgtttgccaaggtctcctcgtttgggccaccgaagaacaagtagtgggggaggtggaggaacaggcaagactctgtctatggagaatatccagtccctcaatgcagcctatgctacgtctggacccatgtatctgagtgatcatgaaggggtggcttcaacaacctacccaaagggcactatgactctgggaagggctacaaatcgagctgtatatggaggccgtgtcacagccatggggagtagtcccaatattgcttctgctggactttcccacacagatgtcctttcatacacagatcaacatggtgggctgactggctcatcccatcatcaccaccaccaggtcccctccatgttgaggcaggtaagagacagcacaatgttagatcttcaggcccagctgaaagaactgcagagagagaatgacctcctccggaaagagctagacatcaaggacagcaaattgggatcttccatgaacagtattaagactttctggagtcctgagcttaagaaggagagagtcttgaggaaagaagaggcagcgcggatgtctgtcctcaaggagcagatgagggtttcccatgaagaaaatcagcacctacagttgacaatccaggcccttcaagatgagctgcgaacccagagagacctcaaccacctcctccagcaagagagtggcaaccgaggagcggagcacttcaccatcgagctgaccgaggagaactttaggcggctccaagccgagcatgacaggcaggctaaggagctgttccttttgaggaagacattagaggaaatggagctgagaattgaaacgcagaaacaaaccctcaatgcccgagatgagtcaattaaaaaacttcttgagatgttgcaaagtaaaggcttgccatccaaaagcctggaggatgacaatgagcgaacgcggcggatggcagaggctgagtctcaggtcagccacttggaagtgattttagatcagaaagagaaggaaaacatacatcttagagaggaattgcaccgaagaagccaacttcagccggagccagccaagacgaaggctctccagactgtcatcgaaatgaaggacacaaaaatcgcttcattggaacgaaacataagggatcttgaggatgagatccagatgttaaaagccaatggtgtgctgaacactgaggaccgcgaagaagagatcaaacaaattgaggtttacaaaagtcactccaagtttatgaagaccaagattgatcagctgaagcaggaactttcaaagaaagagtcggaacttcttgccttacaaacaaagcttgaaaccctcagcaatcaaaattcagattgcaagcaacacattgaagtgctcaaagagtcacttactgccaaagaacagagggctgccatccttcagactgaggtagatgcgctgagattacgactggaagaaaaagaatctttcctcaataaaaaaacaaaacagctacaggacctcacagaagagaaggggacactggccggtgaaattcgtgacatgaaagatatgttagaagtgaaggaaagaaaaatcaatgttcttcagaaaaagattgaaaacttgcaagaacaacttagggataaagacaagcaactgaccaacctgaaagacagagtgaagtccttgcagacggattccagtaatacagatactgcactggcgacgctagaggaagctctgtcagagaaggagagaataattgagcgcttgaaagaacagcgagaaagagatgatcgggaaagactagaagagatagaatccttccgaaaagagaacaaagacctgaaagagaaggtcaatgctttacaggctgaactgactgagaaagagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaaggcacataatattgaagatgactccaggatgaaccctgagtttgcagaccaaataaaacagctcgataaagaggcgtcttactaccgcgacgagtgtggcaaggcccaagcggaagtggaccggttgctggagatcctcaaggaggtggagaatgagaagaatgacaaggacaagaagatcgcagaactggagagcttgactctcaggcatatgaaagatcagaataagaaggtggccaacctcaagcacaatcaacagttggaaaagaagaaaaatgctcagttactagaagaagtgcgcaggcgagaagacagcatggctgacaactcacagcatttgcagatagaggaactgatgaatgcactggagaagaccagacaggaactggatgccaccaaagcacgcctcgcctccacacaacagtccctggccgaaaaagaagcgcacttggccaacctccggattgagaggaggaaacagctggaggagatcctggagatgaaacaggaagcactacttgcagccatcagtgaaaaagatgcaaacattgccttgctggaattgtctgcctccaaaaagaaaaagacgcaggaagaagtcatggccctcaagcgggaaaaagaccgactagtacatcaattaaagcagcagacccagaacagaatgaagttgatggcagacaactatgatgatgaccatcaccattaccaccaccaccaccatcaccaccaccatcgatctcctgggaggtcgcaacattccaatcacaggccctctccggaccaggatgacgaggagggcatatgggcatagccgggcctgtaaaccaaagttccagttttgttttgagggctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttggcagtgtttgtataccatgatgcatggagtgtttgacgaagaaacaaaaaacaccaaaaattgcgagcctttaccctcctctatttctttaatctgttgtttgaagaaccgcattttgagggtgtaaccagtagtcacctctgggccaggttggaaaagaaatcaattttttaaaccactaatgcttgccaagaaatcgccttatgagaacatggtgtgtgtctctgacaatgcgtggcacatctaaattgatcattcataattttatctacccagtcatgtactggagagtggcaaaagtctgaggcacctgcatatctctagtccctgtgttctgcacatccccacggtggggacgccaccaagcctcagactcttaccatcccggtgcatgcaggtctccatgaagaagctgggactcattcacatttcaagatccaaatgctgtgcaaacagtgtaagcttagattttctgtaaatgaagggtcatttctctttttttttttttttaaagaaaatgtgtctgcaacatggattccaaagcattttcagcatcaaacatgaaaacattgatgaatgaggaacaatcacaaaagctgtgtctctgtatatagctctacacaacatgtatgtggatacagtcattatttaaagcacatgccagggaaaaagaccaaattttgaggtcttttacatacagtgatatggtactaaggagaattaaactcctactgcttcctctgaatattaagaaacaatttaaattgttataacttcataaaactcatgactgagtctggcaaacatgtgcaactcttgtattgctccattttcttgtcaatggaagaaacccttccacgtgtatgcaagtgggagatgaaaacctgcatttttaaaggacaaacagtgaatttaagcatgagtggccttaataaatatagttgtctttctttgctgctgtggaaaggattctaaacagatgtccctgaagtcttgcattgaatttagtcattattattactttttaaaatgttggtgcaattaactctggacctctcttgtgagccatagagatatttaaaagacaaacaccttatttgtcggggaagatgaaaccgtccctgagttgcaccattctttcttggtgcattcgcggttaagatactcaagcaggtttcttgcttctggctttgttcttgtcatcagtaagtataacaaactatgtaatgcttatgtgttgcataaacaatccaaatgcattcatgttttaaaagtttgtcctttaactatcagagggatctaggtcttggttagagaagtaagcagagttctttgcaagcttatttagcacattttgacacaatgttgcactgaaaacccaggccacaaatgtgtcccagtgaacagtttggatgtcctcaaagaagtggttctcactgcctcctacaaccaggtcttgacctgaactctgcaactgaatacttgaagtaggaagtaggaaatccagtagggaaaatagggtccttgaaacagaaaaaaaaaaccaacccatgtatagctagctatttctatgtatgtgccaattttgtcacagctcttgtttggagggatcattttctgcccaactttcattggttaaaatattactgatcttacctttatgaggtcgtataatttagtcccttaaaaattaaattctctctaacataacaacctttcccatttcgtgtaatattctctgatgtttgggggttaccaaaaatatccctttttcacatattaagaatagtctctgggtttacaacaaacactgtgatgttgggaagctatttcctttgcgcaaactttaacaggttttcttctaatcataacatagttgaaaaaagaagtttgggctaacatttaggagaagttggtcttactttgtgcaaaagcaggcttgtgctttataccccatttgatttcgatgtacagtctcaattttgtatttaatgatttttgtgtatccagtatgcacgttaacagcgtgtcaactttcatttgaaagtgggtttcaatttactttttaaacagtgtttatgacgagacctcagatgtgttgacgtaagctctatctgcaatgtttttgtgtagagtggcgattgaatgctgcccagggtcagtgtatctaattccccgagaccctcgtttgatagtgcttcttgtaatatttcttcaagtgagtggcatgtgggttgtgatattgaccatgtgattatggacatcgatatgaaaaataaataaataaaactaaggaaccctggaaactaccagtgggcatgtattagccagtcattgtaacctcgtgtctagtagaacaatgtacaaggtatgtacagttcataaatttgttgtcatgtgtatgagaagtactttgtgctgatcgccttatttatattcatcaaataaaccttgtttctttctgaagtg

SEQ ID NO: 53091 - DNA, 2573 bp, Homo sapiens
agaaagttgtgcgcagggactgggggcgggcggccaggcaggagaggaccccgccggaccagccgccctgaacgctgcgcccggcgccctggacctgatcctgcgaatccgcgctttcggtgcgagggacctggctagccgctgcctccctccctacctctgggtgacaccaggtttgggggatttttttgaccaggcgaaagtgggagtcgctggcgtcctggccatgaacacagcctcgcgttcttctcagcctgggaaggaccttctgcctctgtaactcgtccctgccgcaagccagacaggactggcacccgcgccgctgggcacccgccacccttgtggcttctctttgagtcccctctttttgttcctgctccgtggtttagctggtggtgcttgagtttggggtgagaatttattattattattattttttgccttgaggtgtgaatgtgagggtttgatgactttcagatgtctaggaaccagagtgggtgcaggggccccaggcagggctgattcttgggcggaggagagtagggtaaagggttctgcatgagctccttaaaggacaaaggtaacagagccagcgagagagctcgaggggagactttgacttcaagccacagaattggtggaagtgtgcgcgccgccgccgccgtcgctcctgcagcgctgtcgacctagccgctagcatcttcccgagcaccgggatcccggggtaggaggcgacgcgggcgagcaccagcgccagccggctgcggctgcccacacggctcaccatgggctccgggcgccgggcgctgtccgcggtgccggccgtgctgctggtcctcacgctgccggggctgcccgtctgggcacagaacgacacggagcccatcgtgctggagggcaagtgtctggtggtgtgcgactcgaacccggccacggactccaagggctcctcttcctccccgctggggatatcggtccgggcggccaactccaaggtcgccttctcggcggtgcggagcaccaaccacgagccatccgagatgagcaacaagacgcgcatcatttacttcgatcagatcctggtgaatgtgggtaattttttcacattggagtctgtctttgtagcaccaagaaaaggaatttacagtttcagttttcacgtgattaaagtctaccagagccaaactatccaggttaacttgatgttaaatggaaaaccagtaatatctgcctttgcgggggacaaagatgttactcgtgaagctgccacgaatggtgtcctgctctacctagataaagaggataaggtttacctaaaactggagaaaggtaatttggttggaggctggcagtattccacgttttctggctttctggtgttccccctataggattcaatttctccatgatgttcatccaggtgagggatgacccactcctgagttattggaagatcattttttcatcattggattgatgtcttttattggtttctcatgggtggatatggattctaaggattctagcctgtctgaaccaatacaaaatttcacagattatttgtgtgtgtctgtttcagtatatttggattgggactctaagcagataatacctatgcttaaatgtaacagtcaaaagctgtctgcaagacttattctgaatttcatttcctgggattactgaattagttacagatgtggaattttatttgtttagttttaaaagactggcaaccaggtctaaggattagaaaactctaaagttctgacttcaatcaacggttagtgtgatactgccaaagaactgtatactgtgttaatatattgattatatttgtttttattcctttggaattagtttgtttggttcttgtaaaaaacttggattttttttttcagtaactggtattatgttttctcttaaaataaggtaatgaatggcttgcccacaaatttaccttgactacgatatcatcgacatgacttctctcaaaaaaaaagaatgcttcatagttgtattttaattgtatatgtgaaagagtcatattttccaagttatattttctaagaagaagaatagatcataaatctgacaaggaaaaagttgcttacccaaaatctaagtgctcaatccctgagcctcagcaaaacagctcccctccgagggaaatcttatactttattgctcaactttaattaaaatgattgataataaccactttattaaaaacctaaggttttttttttttccgtagacatgaccactttattaactggtggtgggatgctgttgtttctaattatacctatttttcaaggcttctgttgtatttgaagtatcatctggttttgccttaactctttaaattgtatatatttatctgtttagctaatattaaattcaaatatcccatatctaaatttagtgcaatatcttgtcttttgtataggtcatatgaattcataaaattatttatgtctgttatagaataaagattaatatatgttaaaaaaaaaaaaaaaaaaaaaaaaaaaaaaaaaaaaaaaaaaaaaaaaagaaaaaaaaaaaaaaaa

SEQ ID NO: 53092 - DNA, 851 bp, Homo sapiens
cacttcaaccggttgtcgccccagtggccgccctctgagcacgtgttactgccagtctgcgtcagcgttgggtaaatacatgactggccgacgccgccgggcggggctatttaagagacagccgcccgctggtcctccctgaacttggctcagctgccgggctgctccggttggaaacgccaagccagctgcgtcctaatccaaaagccatgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatcgcagagaacggatggcgagtcccgagcgcacctgggcgccctgctggcaagatacatccagcaggcccggaaagctccttctggacgaatgtccatcgttaagaacctgcagaacctggaccccagccacaggataagtgaccgggactacatgggctggatggattttggccgtcgcagtgccgaggagtatgagtacccctcctagaggacccagccgccatcagcccaacgggaagcaacctcccaacccagaggaggcagaataagaaaacaatcacactcataactcattgtctgtggagtttgacattgtatgtatctatttattaagttctcaatgtgaaaaatgtgtctgtaagattgtccagtgcaaccacacacctcaccagaattgtgcaaatggaagacaaaatgttttcttcatctgtgactcctggtctgaaaatgttgttatgctattaaagtgatttcattctgaaaaaaaaaaaaaaaaaaaaaa

SEQ ID NO: 53093 - DNA, 2855 bp, Homo sapiens
cctggcaatcccatgtggacttctggtagaatgagcaatgcaaagaactggcttggacttggcatgtccttgtacttctgggggctgatggaccttacgaccaccgttctctcggacaccccaacaccacaaggtgaattagaagcactcctgtcagacaagccacagtcacatcagcggaccaagaggagctgggtttggaaccagtttttcgttctggaagagtacactgggaccgaccctttgtatgtcggcaagcttcattcagatatggacaggggagacggatccatcaaatacatcctctcgggagaaggtgctggcatcgtgtttaccatcgacgacaccactggagacatccacgccattcagaggctcgaccgagaggaaagagcccagtatactctaagggctcaagccctagacaggcggacgggcaggccaatggagcccgagtcagagttcatcatcaaaattcaagacatcaatgacaatgagcccaagttcctggacggaccttatgtggccactgtgccagaaatgtcccctgtgggtacctccgtcatccaagtgacagccacagatgcagatgacccgacctacggcaacagtgccagggtggtgtacagcattcttcagggccagccatatttttctgtggactctaaaacaggtgtaattaggacagcgctcatgaacatggacagagaagccaaagaatactacgaagtgattatccaagccaaggacatgggagggcagcttggaggattagctgggaccacaacagtcaacatcaccctctcagatgtcaatgataacccaccccgctttccccagaaacattaccagatgagtgtgttggaatcagctccaattagctccactgtcgggagagtgtttgccaaggacttggatgaaggcatcaatgcagagatgaaatatactattgtggatggagatggtgcagatgcctttgacattagcacagatcccaatttccaagttggtatcataactgtgaagaagcccctgagttttgaaagcaagaaaagctacaccttaaaggtggagggagccaatcctcacctagagatgcgttttctgaacttgggcccatttcaggacacaacaacagtgcacatcagtgtggaagacgtggacgagccccctgtgtttgaacctggcttttactttgtggaggtgcctgaggatgtggcgattggaacaaccatacagatcatttctgccaaggacccagatgtgaccaacaactcaatcagatactccattgatagaagcagtgaccctggaagatttttctatgttgacattacaacaggtgccctaatgacagcaagacccctagaccgggaagaattttcttggcataatatcactgtccttgctatggaaatgaacaatccctcccaggttggaagtgttcctgtcacaatcaaagtcttagatgtgaatgacaatgctccagagttccccagattctatgaagcttttgtctgtgagaacgccaaggcaggacagctgatccagacagtgagtgcggtggaccaagatgacccacgcaatggtcagcatttctactacagcttggctcctgaggctgctaacaaccccaactttaccataagggacaaccaagataacacagcacggattctaaccaggaggtctggtttccggcagcaggagcagagtgtctttcacctgcctatcctgatagcagatagcgggcagcccgtgctgagcagcacaggcacactgaccatccaagtgtgcagctgtgatgacgacggccacgtcatgtcctgcagcccagaggcctacatgctcccagtcagtttgagccggggcgccctcattgccatcctcgcctgcatctttgtcctcttagtgctggtgttgctcattttgtccatgaggcggcaccggaaacaaccatacatcatcgacgacgaggaaaacatccacgagaacatcgtccgctacgacgacgagggcggcggcgaggaggacaccgaggccttcgacatcgcggccatgtggaacccccgggaggcgcaggcgggggccgcccccaagacgcggcaggacatgctgcccgagatcgagagcctctcccgctacgtgcctcagacgtgcgcagtgaacagcactgtccacagctacgtgctggccaagctctacgaggccgacatggacctgtgggcaccgcccttcgactccctccagacgtatatgttcgagggggacggctctgtggcggggtcgctgagctccctgcagtcggccacgtcggactcggaacagagcttcgacttcctgacggactgggggccccgcttccggaagctggccgagctctacggggcgtcggagggacccgcgccgctgtggtgacggaagccaggaggcaggcgcgcgtccaaatccagacgttctccgcgggtgcttcgcggacaaggtgcagccaaccacacgagcaatactgtgctggagagtgagaatgggggtgagcaggcgaacagagctctctctggatcagctttacttgggtagattaagttaaataagcaaaaggaaacccagaaggaagagggcagaatctttaattacctttttttcttttctttttgatttttctgacactgtgtgcgaaggcttggagtccaaggtgttctgacaagggtggcttttctctgccattcgctaaggcctttgtcacttttccaccacagaaaggctctggccttggatacagagatgccaattgaaagcagaaagttctactctcgtatctgttttttatcttatcttattctccatttaagagtttt

SEQ ID NO: 53094 - DNA, 3060 bp, Homo sapiens
cagctgtgaagatactataaaaagggaagagaaggaccgagacagaagcaacaacggaactgtcagtgcggagtagggctaaactcagttccattgttaagcaaggaaaaacaaacaatacattgaatttgacaacccactgaagttgcagataatgaggacttaccattatataccattattcatctggacctatatgttccatacagttgacaccatcctattacaagaaaaacctaacagttatttatcaagcaaaaagatagcgggtctgacaaaagatgacggtaaaatgctacgtcgcaccaagcgtggctggatgtggaatcagttcttcttattggaagagtacacaggtactgacacacaatatgtaggcaagcttcacactgaccaagataaaggagatggaaatttaaaatacatactaacaggagatggggctggcagtctatttgttatagatgaaaatacaggagacattcatgctgcaaagaaactagacagagaagaaaaatctctgtacattcttcgtgccaaggctatagacagaaaaactgggcggcaggtggaaccggaatcggaatttatcattaaaatacatgatatcaatgacaatgagccaaaatttacaaaagacttatacactgccagtgttcctgaaatgtctggagtcggtacatctgttatacaagtaactgcaacagatgcagatgacgccaactatggaaatagtgccaaagtggtctatagcatattgcaaggacagccatatttttcagtggacccagaatcaggcataataaaaactgcattaccagacatgagcagagaaaatagagagcagtaccaggttgttatacaggccaaagacatgggtggccagatgggaggcctttctggaaccaccacagtgaacatcacgctgacagatgtcaacaacaaccctcctcgatttccccagagtacgtatcaatttaattctcctgagtctgtacctcttggaactcatcttggaaggataaaagccaatgaccctgacgtgggggaaaatgcagaaatggagtatagcattgctgaaggagatggtgcagacatgttcgatgtcatcactgacaaggatacacaggaagggattataactgtcaaacagaatttagattttgaaaatcaaatgctctatactttaagagtggatgcaagtaacactcaccctgatccacgattcttacacctgggacctttcaaagatacagctgtggtcaaaatatctgtggaagatatagatgagcctcctgtgttcactaaagtctcttacttgatagaagtagatgaagatgtaaaggagggcagtatcattggacaggttacagcatacgatccagatgccaggaacaatttaataaagtactctgttgatcggcatactgatatggaccgtatttttggtattcactcagaaaatggttctattttcactttgaaagcccttgaccgggaatcatctccttggcataacatcactgttacagccacagaaataagtaacccaaaacaaagtagccacatccctgtcttcatcagaattctagatataaatgaccatgctccggaatttgccatgtattatgaaacatttgtttgtgaaaatgcaaaacctgggcagttgattcagactgtcagtgtcatggataaggatgaccctccccgaggtcacaaattcttttttgaaccagtgccagaatttactctcaatccgaatttcaccattgtagataataaagataatacagcaggaatcatgactcggaaagatggctacagtcgcaacaaaatgagcacctacttattgccgattttaatctttgacaacgattatccaattcaaagcagcactggtacactcactatccgtgtgtgtgcctgcgataatcaaggaaacatgcaatcctgcaccgcagaagccctgatcctttcagccggcctgagcacgggagctctcgttgcgattctactctgtgtcctcatactgcttattttagtcgtgttgtttgctgcattgaagaggcaaagaaaaaaggaacctctgataatttcaaaagacgatgtccgggacaacattgtgacctacaacgatgaaggcggcggggaagaagatacccaagcttttgacattggcacattaaggaatccagaggcaagagaagacagtaaacttagacgggatgtaatgcctgaaactatttttcagataaggaggactgtgcctctgtgggaaaatattgatgtacaagattttatccatcgaagattaaaagaaaacgacgcagacccaagtgcacctccatatgattcgctggcaacgtatgcctatgaagggaatgattccatagcagattcgctcagttctttggaatctctcacagctgattgtaaccaagattatgattacctcagtgactgggggcctcgtttcaaaaaacttgccgatatgtatgggggtgatgatagtgaccgagactaagaggattgtttgacttaatcaatattagtggaagtactgtctatgttattagattgagtggcctgcattctcttcctgggaggaaatctttcaaaaattgaagttacaaacaatacgtagatgttgtcaagtagggatttgcttaatcagtaagtctttgtgaatgaatacgaatgatacagatttttaaaaaagtaataaccagttcaccctctttgcctaacaatctcggaaggaaaatatatcacatcaataatcaataaaaataagtaaaaggctttttgtgccttttcttaggtataataatttataaatgttttcttaactgactttcagtcacctttacaattaaactaaatattgtgcaaccgctttgtaaattaatatgaagaagatatatccctaatgaaataggaatgactattactgccatatttatttagttgaagaatgtctttgtgttaattcattcatatttttataaatgtatatttatatttttgtatttttatgaaataaactagtatttataaaac

SEQ ID NO: 53095 - DNA, 3870 bp, Homo sapiens
gagcgccgggaccgcggcggcggggccgcggcgcgcattgcggagggcgcggagcgcaggagctgccgcctgccgggcagatccaagggggcagcacgcttcccgggagcgcccccgcctcctctccggggccgccgcaggctcggtgagcggttttatccctccggccggcaggctgggcgcgcaggggcgcgagcccccgcccggcgcgcagcagcaccatgggcacggtgctgtccctgtctcccagctaccggaaggccacgctgtttgaggatggcgcggccaccgtgggccactatacggccgtacagaacagcaagaacgccaaggacaagaacctgaagcgccactccatcatctccgtgctgccttggaagagaatcgtggccgtgtcggccaagaagaagaactccaagaaggtgcagcccaacagcagctaccagaacaacatcacgcacctcaacaatgagaacctgaagaagtcgctgtcgtgcgccaacctgtccacattcgcccagcccccaccggcccagccgcctgcacccccggccagccagctctcgggttcccagaccgggggctcctcctcagtcaagaaagcccctcaccctgccgtcacctccgcagggacgcccaaacgggtcatcgtccaggcgtccaccagtgagctgcttcgctgcctgggtgagtttctctgccgccggtgctaccgcctgaagcacctgtcccccacggaccccgtgctctggctgcgcagcgtggaccgctcgctgcttctgcagggctggcaggaccagggcttcatcacgccggccaacgtggtcttcctctacatgctctgcagggatgttatctcctccgaggtgggctcggatcacgagctccaggccgtcctgctgacatgcctgtacctctcctactcctacatgggcaacgagatctcctacccgctcaagcccttcctggtggagagctgcaaggaggccttttgggaccgttgcctctctgtcatcaacctcatgagctcaaagatgctgcagataaatgccgacccacactacttcacacaggtcttctccgacctgaagaacgagagcggccaggaggacaagaagcggctcctcctaggcctggatcggtgagcactgtagcctgcgtcatggctcaaggattcaatgcatttttaagaatttattattaaatcagttttgtgtacagtatgtgtctagcaaagccaccaagggcctcacctttcccacagtctctccctggggtttttttcatccctgccaagaactctgggcacttttgaactcacgagccttgcgcaaaacccagaagatgtattcagagccacccaggccactgacctcccactttggggaactcaaaggactgacctgcccctgccgcctgtgcccttgctgggtccagggtaggcaaggctgccggctgcaccctgtatggagctagagaggggcctctggctgcctggcccagggaggaattggggtttctggttggaggcccttttctggctcctgtgtggagttattcactctcccagaggctcctggagccagccaccctaactgagctgccagtggggtcgtgaggcaagatccccgccacccggggacatcttcaatctaggcgaggcgaagctgagcgggtctagtggaaagattgtgtctggtcgtttgaccacacaccgccctgatttgctgttttctttttttagggagaagggcttttctttagtggagaaatggaactcgcccccctacccccttgtctgctgctcccagccacgttggtggtattggccgatgagctggtttgactcattaatttctctcaatttgggtcccagctaaagaggtggggtgaagctggggacagctttcctgggtgagtttttcttttgaataatgtagtgcagtcaccctgtggcaaatgccaggacagctgcaggtgcccattagcaacgcctgccttctgggcaaggtgagggatgccataccttgagaccaagccggtgcccacctaagggctaaggcctcttgctggtgcacatgacatttgtcctgcagagctggggggaaggcgatgtggtgaccccacccccacccgttaatttaaagctgtttctaaacagttgagtttcttctaaagaggaagccttgcccagcaaggaccagtgagacagccggatcttggagacaattacaagacggggagtgagactcctgattgctctggaagcctgctgatttctacaactgatcatttgcagctgctggttttggtttccaccttaccctactggctgtaaaaacacaaatgtgtactttattgattttctttctaattctcccgcattggtggcttgggacttgggagagggagcaagccttcctccatggcccatcactcggctgtggagaacaaagaccaatgtgaagacactacagaggattctgtcttccaggcccagtccactggggagtgctggaatggggacctggggtggggaggcagagggtcactttacataggattaagttcgaggtggctaccgatttcagcacatgcactactgaaatttacacaaaaagaaagctgtgaaattgaagtcccaatttaagagtcctgaggcagaacctggtggctggaggcattcccagaggtggggaagagagcctgcccggccggagaacatctgccttgctgcacctgaggcccagcagagccgttcctgggactgtcagataatcggtgcagcggtggaaggagcctgcggctgctggcacagacttcacacagcacctcctctctgctgggtttccacacagcctgtcttcagatcctgctgccgcgtgcgaccagaggtgggaggcccctggtggcatggaagagggagggtcagtgccaagtctcaggaggagggcgcatgtgtgtatcaccctcagctggcggaacctggctgcgaactgtgcagttacgttgcatccacaggattccagttgcgtgtctgtttccttctctttctccgtatttatttttttattcttcggaggaggtggacatttcggaagtggtggggactaagggaagaactctctagttccctcagtgtgaagcctgtcgtgttctctccccttgcactggtcatcagtattgtgtaaaggaacaactgatatacttgagtgtgcaagcaaagaacccatttgccatgctgctatgaagactacttttagatcaacaataaaaaaaaacctacaaaaaaacctttattctttaattgttgcttttacggtgatattgtgcatgcaaaccaggagcattttgtgtcttaagaaaaataatcttagaacagatggctgtgaaaattacacccatgcacagaacaagccacaggaataatagttcaggatttggtttttctctttttcttgtaaacctggagggttgatatattctttccatgcagttattagaacttagttttgttccaacagttaaacttgcaatgaaaagaaaatgtgccatttttttcactcagaattattcatagctgtatatttgaaactgctaattacacacgtgtgatgtatgttggttttttagtgcaatttcttctgtagctattctttgaccaaactgtgggtattgttaatattaatttatatttgtctcattttgtatgtatgtgtagtgtgtttgtgagtatgtgtggtttataatctgacaaagtcatgaagctcagtttggctgtaatttaattccccttcccttatttttatttatttttgtactgtgctgattcaataaaatgcactgaccatccaaaaaaaaaaaaaaaaa

SEQ ID NO: 53096 - DNA, 2495 bp, Homo sapiens
agccgcctagcagccaccttcccccgccagtccgcgcgcccgggccggggctaggccccccaccgccgggtcccccggggctgcagtagcagcggcgccgcccgcggctcccgctggggcctgggcgccggccccgctctgcaggatgggcacagtgctgtctctttcgcctgcctcctcggccaagggccggaggcccggcgggctgcccgaggagaagaagaaggcgccgcccgcgggggacgaggcgctggggggctacggggcgccgccagtgggcaagggcggcaaaggcgagagccgactcaagcggccgtccgtgctcatctcggcgctcacctggaagcgcctggtggccgcgtccgccaagaagaagaaaggcagcaagaaggtgacacccaagccggcatccacgggccccgaccccctggtccagcaacgcaaccgcgagaaccttctccgcaagggccgggatccccccgacggcggcggcaccgccaagcccctggcggtgccagtgcccaccgtgcccgcggctgccgccacctgcgagccaccgtcggggggcagcgcggccgctcagccgccgggctcgggcgggggaaagcctccgccgccgcctcccccagccccgcaggtggcgccgccggtgcctggcggctcgccgcggcgggtcatcgtgcaggcgtccaccggcgagctgctgcgctgtctgggcgacttcgtgtgccgacgctgctatcgcctcaaggagctgagcccgggcgagctggtgggctggttccgcggtgtggaccgctcgctgctgctgcagggctggcaagaccaggccttcattacgcctgcaaacctggtgttcgtgtacctgctgtgccgcgagtcgctgcgtggggacgagctggcgtcggccgccgagctgcaggccgccttcctcacctgcctctacctcgcctactcctacatgggcaacgagatctcctacccactcaagcccttcctcgtggagcccgacaaggagcgcttctggcagcgctgcctgcgcctcatccagcggctcagcccgcagatgctgcggctcaacgccgacccccacttcttcacgcaggtctttcaagacctcaagaacgagggcgaggccgccgccagcggcgggggcccaccgagcgggggcgcgcccgccgcctcctcggccgccagggacagctgcgcggccggaaccaagcactggactatgaacctggaccgctagggatacccaggggccgcgcccatcccccgccccagcccctgacacacactcggaccccccgggaccacaaagccaccgccgctgttaccgccgctcagcgccccggctgggcggaggaggagacgcccatgcccctcaggggaaagtggagaccgggacaccagaggccgcggtgtttggatttgctgggcgtggagtggggacggaagatgagcgcgggaaaggcactccaacctcactcttcccgtctgtctgcgcccccatttctccatttctgccggggtctcccccttcccttcagcccattccccctcggttttatccatttccttgcctcctttttgtgtcttcatttttcctcctgtctgcattcctctctctctctctccctctctctcctgttcctctctttcttcctccctctccctgcctttccattttccgttccttgggtttgtgtgtctgcatctccatcttaccccttgcctgactgtaccccgtagacccctgtttctcctcctgcacctgtgtccccatctgcccttcttgttgctcctgtcatgtgtcaccatcttccctcctgtctgccttcttcctccacttgtgtcagcttgcatttttttattcctgactgagtcaccacacccctctcccctgatcaaagggaatattagtttttaatttggatcgactgaggtgccaggagaaactgcagtcccaggtatccagacagccaccaggatggtccctcgccccacccccaccgcctctccccaccttttccaacgtgttgcatgctgggagctggggggtgtgggggaaggggctgccggcttctttcaggaggctgaggtttggaggcaaaatcaacctgggagaccaccccggccgcggcgcctcagtggacaggtgggaggaaaagaaaacttcttaccttggaggagggacatcccgcttccttatccttagcttttttgttgctcctccccactgccccttttaatttatttggttgtttgcggagggaggggggaggggggtaggctgggccgggaactgtccgaggtgctgagctggggcgggaccggaatcctcccggtagggtaccagggactgagttgggcctggggccgtgtccaaggtgccaatgatgcgggccgacagagcgggccgcactgtctgtctgtccgtctgtcccggaaagaactataaagcgctggaagcgcctgcaaaaaaaaaaaaaaaa

SEQ ID NO: 53097 - DNA, 3938 bp, Homo sapiens
ggggccttctgaggtttgggggctgtagggccatgggcctcagggccagaggtggttgttagcctggcaagacaggtctgggcaacatgcatgcccagaggcagttcgttgtagctgcagtgagagcagaagtcagacgacatgaggtggccaagcaggctctaaaccgcctcaggaagctggcagagagggtggacgaccccgaactccaggacagcatccaggcctcattggacagcattcgagaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacggactgtaccccatctggagacctgagccccctgagtcgggaaccccctccttctcccatggtgaagaagcagaggaggaaaaaattgacaacaccatccaagactgaaggctcggctgggcaggctgaagaggaaaactttgagttcctgatcgtgtccagcacgggtcagacgtggcactttgaggcagccagttttgaggagcgggatgcctgggtccaggccatcgagagtcagatcctagccagtctgcaatgctgtgagagcagcaaggtcaagctgcgcacagacagccaaagcgaggccgtggccatccaggcgatccggaacgccaaggggaattcaatctgcgtggactgcggggcccccaaccccacgtgggccagcttgaacctgggcgccctcatctgcatcgagtgttctggcatccaccgcaacctgggcacacacctgtcccgcgttcgctcgctggacttggacgactggccacgggagctgaccctggtgctgacggctattggcaacgacacggccaaccgcgtgtgggaaagcgacacgcgaggccgtgccaagccctcgcgggactcttcgcgggaggagcgcgagtcgtggattcgcgccaagtacgagcagctactgttcctggcgccgctgagcacctcggaggagccgctgggccgccagctgtgggccgccgtgcaggcccaggacgtggctaccgttctcctgcttttggcccatgcgcgacacgggccgctcgacaccagcgtagaggacccacagctgcgctccccactccacctggcggccgagctcgcccacgtcgtcatcacgcaactgctgctgtggtacggcgcggacgtggcggcccgtgacgcccagggccgcacggcgctgttctacgcccgccaggctggaagccagctgtgcgccgacatccttctccagcacggctgcccgggtgagggcggcagcgcggccaccacgcccagcgcggccaccacgcccagcatcaccgccacgcccagcccccgccgccggagcagcgccgctagcgtgggccgcgccgacgccccggttgcgctggtatagttgcccagcgggagagacacccccatccccacgcgggccgggcacgaccacaccgggcggaccgctggacagacgcacccactcacctctccgatccgcaccccgccccacgggagcacttcctacccccacgagggcacagcccccacgccttccagaagacacaaactcacctccctctccccaacgaggcatggagaccccagctcaacacgccccctctccattgtttccacactcggattgctctgggtctacccgctcggggttcgcggaaggggaggtccccagcggtacgggctcctaggcgcttggacatgcccgcttgtgccccctaggggcggaaagaagacccggtcctgcccgagctcaacaatcccagggcgggagcccatacccaggctggctcctggggcgacgccacgccagagggagggtttagtacatgggagggctagccccgggacttggggccaatacggaaaccctaccccttccatgctcatctcactgcccagtgaagggggcaagggcagcgaggggcaggacccctgctgctcatgggggtgggggttcccaaccctttccgtgaaagggaccgtgagtagtggaaaccaggacgtcccctacacctacccatgggtggaagctaaagagtccggggggaaccaagagcctgggtccctcccactactatcttgggagggagaagggatggagcaggagcgggctaagagggctgcgggggccttgtaatttattgctttgttccccaacatggggatgggggcgggcaggggcgtggggagggcgttttggggtaggggaagcccagggtgggcagggggtgggttggggtgggggtgctctcgggttgtgtctgtgaccgtgactgcgtacctgtgactgtgcagcgcccgtggtgatctggggtagggggcacccctacagtgggacccctcccccattattctttctgtccagcccctccctcccactggagcagctccagagccattcctcacccccgtgacctctcccagccagggctgagaggattcgaggtggctgggagggtttccaggccccctgccccttccccacaaactgggtgatagggcggacttacctggcccagccctgcctccctcagccaacccagcccttgggctgtctgtgtcagtggtttccggtctttttttttttttttttttctggctaaaatagtttgcaaaggaccaggtaattggggaggggagagaggtgggggcaagggggaaatgcccccccatctccttggaggcagtggtgtgaatcttcttcaacagcaattaaagagga

SEQ ID NO: 53098 - DNA, 2734 bp, Homo sapiens
gctcggcgctgtagccgccgctgccgccgctgctcttggctcggggacgcgggcgggcgctccgagaggctctggtgcctgcggctgctgctctcctccgacgcccggggctgcggcgctccgggtcccggcccctgtcccggcatctctcgggtccctgagccccggccacgggtcccgcgtccggccggagagaacgcactcagctgctcgagccgccccgggctcgcgcccccgggccatgaagaggggcccgtgaggcgcgcgcggagtcggaggaagaggagggaggagggaggccgaggaggagggcgcgggaggcggaggatgccgccgcggctgctgccgccgccgccacccgcgggtccccggcgaccctgactccagacccgaggatggagccggcgctgggcgctgcagctgctcccggcgcgtccccgaccaggtagctggtgtcacttcggtgtggttggaagaagactttctccccagctgcattcccggaggcgccctttcgacctggaggccgggtctgctggccacagggctgccgcactggctgggactgccagctgggcctggagacgctggtggctgtggactccccagcttggagcagtccctctttgacctcaccccttggagaagcaaccccatgaaggtgcccagccatgcaatgttcctggaaggccgtcctcctccttgccctggcctccattgccatccagtacacggccatccgcaccttcaccgccaagtcctttcacacctgccccgggctggcagaggccgggctggccgagcgactgtgcgaggagagccccaccttcgcctacaacctctcccgcaagacccacatcctcatcctggccaccacgcgcagcggctcctccttcgtgggccagctcttcaaccagcacctggacgtcttctacctgtttgagcccctctaccacgtccagaacacgctcatcccccgcttcacccagggcaagagcccggccgaccggcgggtcatgctaggcgccagccgcgacctcctgcggagcctctacgactgcgacctctacttcctggagaactacatcaagccgccgccggtcaaccacaccaccgacaggatcttccgccgcggggccagccgggtcctctgctcccggcctgtgtgcgaccctccggggccagccgacctggtcctggaggagggggactgtgtgcgcaagtgcgggctactcaacctgaccgtggcggccgaggcgtgccgcgagcgcagccacgtggccatcaagacggtgcgcgtgcccgaggtgaacgacctgcgcgccctggtggaagacccgcgattaaacctcaaggtcatccagctggtccgagacccccgcggcattctggcttcgcgcagcgagaccttccgcgacacgtaccggctctggcggctctggtacggcaccgggaggaaaccctacaacctggacgtgacgcagctgaccacggtgtgcgaggacttctccaactccgtgtccaccggcctcatgcggcccccgtggctcaagggcaagtacatgttggtgcgctacgaggacctggctcggaaccctatgaagaagaccgaggagatctacgggttcctgggcatcccgctggacagccacgtggcccgctggatccagaacaacacgcggggcgaccccaccctgggcaagcacaaatacggcaccgtgcgaaactcggcggccacggccgagaagtggcgcttccgcctctcctacgacatcgtggcctttgcccagaacgcctgccagcaggtgctggcccagctgggctacaagatcgccgcctcggaggaggagctgaagaacccctcggtcagcctggtggaggagcgggacttccgccccttctcgtgacccgggcggtgcgggtgggggcgggaggcgcaaggtgtcggttttgataaaatggaccgtttttaactgttgccttattaacccctccctctcccacctcatcttcgtgtccttcctgcccccagctcaccccactcccttctgccccttttttgtctctgaaatttgcactacgtcttggacgggaatcactggggcagagggcgcctgaagtagggtcccgccccccccaccccattcagacacatggatgttgggtctctgtgcggacggtgacaatgtttacaagcaccacatttacacatccacacacgcacacgggcactcgcgaggcgacttctcaagcttttgaatgggtgagtggtcgggtatctagtttttgcactgtcttactattcaaggtaagaggatacaaacaagaggaccacttgtctctaatttatgaatggtgtccatcctttccccatccctgcctcctgcccctgacgcccatttccccccttagagcagcgaaactgccccctcctgcccgcccttgcctgtcggtgaggcaggtttttactgtgaggtgaacgtggacctgtttctgtttccagtctgtggtgatgctgtctgtctgtctgagtctcgtggccgcccctggaccagtgatgactgatgaatcttatgagcttctgattgatctcggggtccatctgtgatatttctttgtgccaaaaagaaaaaaaaagagtggatcagtttgctaaatgaacattgaaattgaaatgctttatctgtgttttctgtaaataaaagagtgcaataatcgaaaaaaaaaaaaaaaa

SEQ ID NO: 53099 - DNA, 1184 bp, Homo sapiens
agtgacagccagccgggcccggtggcggagaggaagtgcggtccgcgccaagcccgtccccgccgacgccggctccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccggatcgctgacaaagcattctaccagcagccagatgctgatatcatcggctacgtggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtattttttttcttggcttaaagggtgtgttgttgactctttttacacttatttattatcattctcacttctctggaagcca

SEQ ID NO: 53100 - DNA, 1121 bp, Homo sapiens
gttagagaagggggacacaaatgtcttcaggcttaggtccctgggggctcccagtcctgcccctgttcctctactcacatcccagctcctcccagtttcttttcggacctcctcctctccccttccttctctattccaggctgggttgggctctaagcaaggggagggattagagcctccttcctctctgcccctccccatgggtctctagggggctggtgcaggcagcagcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattctaaaaaaaaaaaaaaa

SEQ ID NO: 53101 - DNA, 1217 bp, Homo sapiens
gttagagaagggggacacaaatgtcttcaggcttaggtccctgggggctcccagtcctgcccctgttcctctactcacatcccagctcctcccagtttcttttcggacctcctcctctccccttccttctctattccaggctgggttgggctctaagcaaggggagggattagagcctccttcctctctgcccctccccatgggtctctagggggctggtgcaggcagcagcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattctaaaaaaaaaaaaaaaaaa

SEQ ID NO: 53102 - DNA, 1399 bp, Homo sapiens
cgcaggatgagcgatcggggcccgggcagccggcagcggacgcgccccccgagcccaccggcccgcgccccgcgccccccacggccccgcggtcccggtcccggccgcatcacccacgtcccccgagccccacgggccatgcccggccggccctaagcgcgggccggggggcgtccccttgcgcccgggccccgcgctggcgccccccgggccgccgcccggcgcgggggccatggcgttcaccttcgccgcgttctgctacatgctcaccctggtgctgtgcgcctccctcatcttctttgtcatctggcacatcatagcctttgatgagctgcggaccgacttcaagaaccccatcgaccaggggaaccctgcgcgggcacgcgagcgtttaaaaaacatcgaacgcatctgctgcctcctgaggaagctggtggtcccagaatactccatccacggcctcttctgtctgatgtttctgtgtgcagcagagtgggtgaccctgggcctcaacatccccctcctcttctaccacctctggaggtacttccaccgtcctgcagatggctctgaggtcatgtatgatgcggtctccatcatgaatgctgacattctcaactactgccagaaggagtcctggtgcaaacttgccttctacctgctctccttcttctattacctgtacagtatggtttatacgttggtgagtttctaagggggaagccggccagggagcgagcccagaacggaccggacgcctgtgcacccccagccctgccccttggccgcagaggcctcagccctggggagggagggggcactggtgcccccagcctctccaacccccaaactgctgctgcggggaaccccccccaccccgccttcagagccctcccccttggactagagcggctgggcagagctctaaacaggggcaggggctcctctgccagcctgtgggcatggcagtcattcctggaaggggcaggacctccggccttgtccatttcgggggaaacttgggccctgccaaggggcagagcttgaccctggaaattctgggccatccccctccacccccaccctgaggctccccctgcaggtgggggggtacccgcaccgggaatgagcaggctcagcaggggggcagccccacccctagtctgccctcccctctcccccaggctctttctccagccctgtctccatctgccccaacctcagcccaccttgtctcttggacctattttctatgtcgcctggaggagtccggcaccccctccccggccatttgtgacaaaatatgaataaactactgcaaatatgtgggaaaaaaaaaaaaaaaaaaaaaaaaaaaaaaaaaaaaaaaaaaaaaaaaaaaaaaaaaaaaaaaaaaaaa

SEQ ID NO: 53103 - DNA, 7650 bp, Homo sapiens
acacacacgcgccctcacccgccaccgccgccgcggccgccgccgcacccggacagcgagcggctgaggccgccagggcccaaaggacagcggcccagacaggggctggcggcccggccggccccggctcaccgactcgggcagcatccacctgccccagccaacacccttctctcgccccaggtcctttctcagcctccagctgggctgtccccaagctgagctgaggctcttctcctccgatccccacctctgcccggacatccaccatggggacagccaccaggaggaagccacacctgctgctggtagctgctgtggcccttgtctcctcttcagcttggagttcagccctgggatcccaaaccaccttcgggcctgtctttgaagaccagcccctcagtgtgctattcccagaggagtccacggaggagcaggtgttgctggcatgccgcgcccgggccagccctccagccacctatcggtggaagatgaatggtaccgagatgaagctggagccaggttcccgtcaccagctggtggggggcaacctggtcatcatgaaccccaccaaggcacaggatgccggggtctaccagtgcctggcctccaacccagtgggcaccgttgtcagcagggaggccatcctccgcttcggctttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggccatcctttcctgagctctgggtatactaccagtcacagaacgtcagagctggaagaagccttagagctcaacttcttcaagcccctcactttacagatgaggaaatggaggtggtccagagagggtctgggattcccaaggtcacacagcccagaagagatggggctgggttaagaactcgagtcttccacctttctgttcaaggctgtttgtctacccagaggaaggaggcactgctgaatggctatggcctggctaagaaggtgattagtcagtagggtgtgaaaattctacttcaaggggttcggattggtgatcatggggattggcatggctgggttcccgtccaaggtgtgggcagagcttctaccaaacttcaacatggagggctgacttgaagctccctgtccccctcactcttgccccaagaaaagaggccaaagcaagagcagattccctaggcaagagcagcagcacaactaggaaaccccaaagcccatgctccgacaggtggcccttcacagggggcagcgggacaggcatcttgaagggcatatgtcctcggaagctccgagcctgttttctgtagtttatagttagagctctattttgttatggttttttaaacttttaagtcctgctctattttcctgggcaggtttatgttgatgtttacccactacaattttttaaaaatataagctcacatgccttttccctgccacagccaaacccccactgcaccctacccacccacccctagcccaggtcagctttcctggagctggctaatgaaagcctcctcacctcttcccaacccttacaagcaagggtgctaggggctcagctatacgaccattctccctgacagggagtccaaacttggcctagcatccctcctggcccccctctggccacgacttggcctgtgcctggttctctatcagaaaggggatgctgaacaaaacctccttccaagttttatccaattcgttcctcattgcctcgggctgcgtcaggggaagcaggggacaggtgtccagttgctgggccgagggaggagctggtttggcataggacctaaccagtgaagctagaggctacagccactaaacttgcttcaggccaacgatagttactcacaagtaagtaccttaatgctaatgaggtccactaaaaaggggaggaaggcagacctcctgggagacccacgaagggtttttagccagggaaaactgagccccaggaaaacctaaccactgggcaggcagaatttgtttgagggatagaacgacaacaaaataaatgttcctgcagcctgagatttcaggtagagtactgactaaggtttaataagacaataggtgacctgaggacatgcaagcttgtaaaatgcaacagcctcctgctagagtgacttgtacatgagcttgcttgcagaagactagattagatgtttctcaggatcccctcctgcgcaggggttctctgattttcgtgttctctgcccagatgggctgggggagttgagagtgtgcttattttcactgcgatcatgagaccacagttctgggttatctcctctcatacatcaagccccagaggaggcggcaagaggaacagccacaaacaagtactttaccccacagcttagtggccagtaaacaccctggggactaggaaaaggaaccaactgtaggcacctctccagggcctagggagacaagtgtcctctcttctgcatacatttgggctccccttacagagccctttgccctggctctctggtccttgttgctctaacagtccagatgtacacccagcctcagggggaaggcagctctctccagacagagtctcagggcccagcaaggtcaggttatctgctttcattcagggcaacaaatgatacaaatggtgccagggagtggcaaggccatgggggtaggtgggggtgtctttttcttttcataaagtaacaacagacgagactgaggttaaacatcagaaaaaaacctctggaatgaccttcctcattccaggaggccctggaataaggaagaggcttctttctgagggagctttgaggaattttgacagctgttgacatgggatttgggaaaggtgaagctgtgactggaggggcaggagatggtccaagtgtccatccagagatgagactcttagaatcaaagtgttcagcccaggaagtcttggagatcccaccttctgtggccctgcaccttatgggaagccattaagggggctcatctaggaattctggttacagcccagtgctcatcccagcgtatgctgcctctttagggcagccccaagggccagccagcctgtactctgggcaagagcccaaaatggctaggaatgtttgactcccttaatctcttccccagctacagaggaatcttttctctgcctggtctcagaatgggactgccaactggctcattggtgggagacacagtatcctcaaacctgtggccactggcatgacagtggtgctctgtctccctgggtgacacccaccctaggcttcctcctggatgtgatggggattgccagagaggctcttagcataaaaggcattaggtgggcatttttctgtgtgcccccaaaaagctccatggaaacaggcacctggtagctgcggaacacccgtggacttgtgtatatggtcataggctttgggaagacaggacgtaaaggaaaatgagagaaacaaaatgggtcagatagctttggccacagccccaggcagcctttggggcctatgacacttagtgcccttagatgggatacatcttgcctcggccccaagactcctccaacttacccgtcccatccagggcctgcacagcttagagaggctcacagcttggcaaatgctagggcttcatcagaccactgacttgactcagtgtttgttaaaatggaaccactcccgttggcctactgtttctctcctgtacttcttgtaatgatagttatttattgactctggtagcaggcagttcttaaataaagatggtttctcaacctgttggggaaaaaaaaaaaaaaa

SEQ ID NO: 53104 - DNA, 948 bp, Homo sapiens
gcgttccaaaataagagcaaattcgctctaaacacaggaaaagacctgaagctttaattaaggggttacatccaaccccagagcgcttttgtgggcactgattgctccagcttctgcgtcactgcgcgagggaagagggaagaggatccaggcgttagacatgtatagacacaaaaacagctggagattgggcttaaaatacccaccaagctccaaagaagagacccaagtccccaaaacattgatttcagggctgccaggaaggaagagcagcagcagggtgggagagaagctccagtcagcccacaagatgccattgtcccccggcctcctgctgctgctgctctccggggccacggccaccgctgccctgcccctggagggtggccccaccggccgagacagcgagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatccgcgcgccgggacagaatgccctgcaggaacttcttctggaagaccttctcctcctgcaaataaaacctcacccatgaatgctcacgcaagtgtaatgacagacctgaataaaatgtattaagcagcagtgatctttcctctcctccttcccaagtcatttgaaaagtgtttgttatttaaattccaataatgcccaatactgacgtgtcttgagtaatttggaacccaaagtgaagatctttgataaagatttttttgtggttcgactggactgtgctgagtgcgggcactgggcttttcttctgatgttcattatggtgctgggaagctctgtctttgatttaaaataaaatagctaaaggctacacaaaaaaaaaaaaaaa

SEQ ID NO: 53105 - DNA, 2018 bp, Homo sapiens
gccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggagatgcagtgggactgtatcaaccccaagtatcgggacaagaagaagaattacaagagctcagggacggtagtgctggcccagtgcacggtggagaaggtgcacaccttcctggattacatcatgggtggctgccagatcagcttcacggtggccattgacttcactgcctccaatggggacccgaggagcagccagtccctgcactgcctcagtccccgacagcccaaccactacctgcaggccctgcgtgcagtgggaggcatctgccaggactatgacagtgataagcggttcccagcttttggctttggggctcgaatcccccccaacttcgaggtgtcccatgactttgctatcaactttgacccggaaaatcctgaatgtgaagagatctcaggggtcatcgcctcctaccgtcgttgcctgccccagatccagctctacggccccaccaatgtggcccccatcatcaaccgtgtggctgagccggcccagcgggagcagagcaccggccaagccacgaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagcaaaaaaaaa

SEQ ID NO: 53106 - DNA, 12643 bp, Homo sapiens
gagactttgtgcccccgttggagagatggttgagtcctcgtcaaggttgctgtggtatcccagaaacaccattcactccgagctgtgaccgcgcaccaacaacagcaacaactccactgcgccgggctgaggagcaggaattaggagctcgcgaataatatgaaagggatccgcaaaggggaaagccgagcaaaggaatccaaaccctgggagcctggcaagcgaagatgcgctaaatgtggccgcctagacttcatcctgatgaagaaaatggggattaaaagtggatttacgttttggaacctcgtctttttattgacggtgtcttgtgtgaaaggatttatttatacatgtggtggaactttaaaaggacttaatggcactatagaaagccctggttttccatatggatatccaaatggtgcaaactgcacatgggtaataatagcagaagaacgaaatagaatacaaattgtttttcagtcatttgctctagaagaagaatacgactacttatcattatatgatggacatcctcatcctacaaactttaggacaaggttaacaggattccatctgccacctccagtgacaagtaccaaatctgtgttctcactacgtttgaccagtgattttgcagttagtgctcatggatttaaggtatattacgaagaattgcagagtagctcttgtggaaatcctggtgttccacccaaaggtgtattatatggcacaagattcgacgtcggggacaagatccgctacagctgtgtaactggatacatccttgatggccaccctcagctcacctgcatagccaattcagttaatacagcttcgtgggattttcctgttcctatctgtagagctgaagatgcttgtggaggaacaatgagaggatccagtggcatcatatccagccctagttttcctaatgagtaccataacaatgctgattgcacttggaccattgtagcagagcctggggacacaatttcactcatatttactgattttcaaatggaagagaaatatgattacttagaaatagaaggttctgagccacctaccatatggttatctggaatgaatataccaccaccaattatcagcaacaaaaactggctcagactgcattttgttacagacagcaatcatcgataccgtggatttagtgctccctatcaagtgaaaaaggccatagattttaaatctagaggatttaaattgtttccagggaaagacaacagcaacaagttttctatcttaaatgagggaggtattaaaacagcttccaatttatgcccagatccaggagaaccagaaaatgggaagagaatcggatcagattttagccttggatcaactgtgcagttctcttgtgatgaagattatgtcctacagggcgcaaagagcatcacctgtcaacggatagctgaagtttttgctgcttggagtgatcacaggcctgtgtgtaaagtgaaaacgtgtggctctaatcttcaaggaccaagtggtacctttacatctcccaactttccgttccagtatgacagcaatgcacaatgtgtctgggtcatcacagcagtgaatacaaataaggttatccagataaattttgaagaatttgatctggagattggctatgataccttgacaattggcgatgggggcgaagttggagatcctaggacagtgctccaagtgctgactggaagctttgtaccagacttgatagtgagcatgagtagccaaatgtggctgcaccttcaaacggacgaaagtgttggatctgttggtttcaaggttaactacaaagaaattgagaaagaaagttgtggtgatcctggtacacccttatatggaattagagaaggcgatggattttctaatcgtgatgttttaaggtttgaatgccagtttgggtttgaattaattggagagaaatccattgtttgtcaagagaataaccaatggtctgcaaacatacccatctgtatctttccctgcctgtctaactttactgcaccaatgggaacagttctttctcctgattacccagaagggtatggaaataatttaaattgcatctggacgataatctctgatccagggagccggatacatctttctttcaatgactttgacctggaatcccagtttgatttccttgctgttaaagatggtgactctccagaatccccaattcttggaacctttactggggctgaggtgccttcccatcttactagtaatagtcacatactgcgattggaatttcaggctgaccactcaatgtcaggacgtggctttaacatcacttacaacacatttggacataatgaatgccctgatcctggaataccaatcaatgcacggcggtttggggacaactttcaattaggaagttcaatttcagttatttgtgaagaaggatttattaaaacccagggaacagaaacaattacatgtattcttatggatggaaaagtaatgtggagtggactgattccaaaatgtggagccccatgtggtggccatttttcagctcccagtggagtgattctctcaccaggatggccaggatactacaaagactctttgaattgtgagtgggtgattgaagctgaacctggacactctatcaaaattacatttgaaagatttcagactgaactgaattatgatgttctggaagttcatgatgggccaaatcttctgtcacccttgcttggatcttacaatggcacccaagtgccccagtttctatttagtagcagtaattttatataccttctatttacaacagacaacagtcgttccaataatggtttcaagattcattatgaaagtgttacagtgaacacgtattcttgtttggaccctggcatacctgtacatggccgtcgctatggtcatgatttctccattggctctactgtttcatttagttgtgattcaggatacaggttgagtcatgaagagccccttctatgcgaaaaaaaccactggtggagtcatccacttccaacctgtgatgcattatgtggaggagatgttagagggcctagtggaacaatcttatcacctggttacccggaattttatccaaattctctgaattgtacatggactgttgatgtaacccatggaaaaggtgtgcagttcaacttccacacttttcatttggaagaccatcatgactacttactgatcacagagaatggcagttttacccaaccactggcacgcctgactggttcagatcttcctccaacaatcaatgctggtctctatggaaatttcagggctcaattgcgtttcatttcagatttttcaatatcatatgaaggatttaacataacattctctgaatataaccttgaaccttgtgaagatcctggcattcctcaatatggtagtcgaatcgggttcaactttgggattggtgacactctgaccttctcatgctcttcgggttatcgactggaaggaacatcagagatcatctgtcttggtggtggccgacgagtgtggagtgcacctctgccaaggtgtgtggctgaatgtggtgcatctgcaacgaataatgaaggaattttgctgtctccaaattatccactcaactatgaaaacaaccatgaatgcatttatagtattcaggttcaagcaggaaagggaatcaatatttcagccagaacatttcatttagcacaaggagatgttcttaagatttatgatggaaaagataaaacgactcatctactaggtgcttttactggtgcatctatgcgcggactgacacttagtagtacttcaaatcaactctggctagaatttaattccgatactgaagggacagatgaaggctttcaacttgtgtataccagttttgaactctcacactgtgaagatcctggcattccacaatttggatacaagatcagtgaccaaggccactttgctggtagcaccatcatttatggatgcaatccaggctacactctccacggaagtagccttctcaagtgcatgacaggggagagaagggcatgggactatcctctgccttcctgtattgctgaatgtggaggtcgttttaaaggagaatcatcaggaagaatcttatctcctggctatccttttccatatgacaataacctgcgttgcatgtggatgattgaggtagatcctggaaatattgtcagcttgcagtttcttgcttttgatacggaagcatcacatgatatactccgagtctgggacggtccaccagaaaatgatatgcttttaaaggaaattagtggatctcttattcctgaaggaattcatagcaccctcaatatagtaaccatccagtttgacacggatttttatattagcaaatctggatttgcaattcagttttcaagttctgttgccactgcgtgtcgtgacccaggggtccccatgaatgggactcgaaatggggatggaagagaacctggggacactgttgtttttcaatgtgacccaggatatgaacttcaaggagaggaaagaataacctgcattcaggtagaaaatcggtacttctggcagcccagcccaccagtctgtatagcaccctgtggaggcaatttaacaggatcttcaggctttattctttcaccaaacttccctcatccatatccgcatagcagagactgtgactggactatcaccgtcaatgcagactatgttatctccttggcgttcatcagttttagcatagaaccaaactatgacttcctctatatctatgatggaccagacagtaatagcccactgattggaagttttcaagacagcaagttaccagagagaatagaaagcagctcaaatacaatgcatttggcttttcggagtgatggatctgttagttacactggatttcatctagaatacaaagcaaaactgcgagagtcctgctttgatccaggcaatataatgaatggcaccagacttggaatggattataaattagggtcaacagtcacctattactgtgatgctggttatgttcttcaaggttattcaacactcacctgtatcatgggagatgatggaagacctggatggaatagagccttgccaagttgtcatgcgccctgtggaagtcgttcaacaggttcagaaggcactgttctatcaccaaactatccaaaaaattacagtgtgggacataattgtgtttattctatagcagttccaaaggagtttgtggtgtttggccagtttgtatttttccagacatcactccacgatgttgttgaggtgtatgatgggccaactcagcaatcttctctgttatcttccctctcaggatcccattcaggagaatcacttccactgagttcaggtaatcagatcacaattcgatttacttcagttggaccaataacagctaagggatttcactttgtttaccaagctgttcctagaacaagttctacacaatgcagttctgtgcctgaaccaagattcggaagaagaattggcaatgaatttgcagtcggttcatcggttctttttgattgtaatccaggatatattctccatggatccatagcaattaggtgtgaaacagtgcccaattctttggcccagtggaatgattccttacctacttgtattgtgccctgtggtggaattttaactaagcgcaaagggactattttgtcacctggataccctgagccttatgacaacaatctgaattgtgtgtggaagatcacagtgccagagggagctggcattcaagtgcaagttgttagctttgctacagaacataattgggattctctggacttttatgatgggggagacaacaatgctccaagacttggaagctattcaggaacaacaataccccatcttttgaatagtacgtctaataatctgtatctaaattttcaatcagacatcagtgtttctgctgcaggatttcatcttgaatacacagcaattggtttggattcctgtcctgaaccacaaactcctagcagtggaattaaaattggagacagatatatggttggagatgtagtatcctttcagtgtgatcaaggatattctcttcagggtcactctcacattacatgtatgccaggacctgtaagaagatggaattatccaatcccaatttgtttagctcagtgtggtggtgctatgtcagacttcagtggtgtgatcctcagtcctgggtttcctggaaactatcccagcagtttagattgcacatggacaataaatctacccataggttttggtgtacatctccagtttgtaaatttttctacagaaaccatacatgattatttggaagtacgaagtggatcctcagaaactagtactgttattggccggcttagtggtcctcaaataccatcttccttattcagcaccacccatgaaaccagcttatattttcacagtgactattcacaaaacaaacaagggtttcatattgtataccaagcctatcagttgcaaagctgtcctgatccacgcccgtttcgaaatggttttgtaattggtaatgattttactgtgggtcaaaccatttcatttgaatgtttcccaggatacacattaattggaaattcagctctcacatgccttcacggagtcagtcgtaattggaatcatccacttccaaggtgtgaagctctttgtggtgggaatataactgcaatgaatggcaccatttattctcctgggtatcctgatgaatatccaaactttcaagattgtttttggcttgtaagagtaccccctgggaatggcatctacatcaattttactgtccttcaaacagaaccaatatatgatttcattactgtatgggatggaccagaccaaaattcacctcagatcggtcagttcagtggcaataccgctttggaatcagtctacagtacttcaaatcagattctaatcaaattccacagtgatttcacaacaagtggcttttttgtgctcagttatcacgcctatcaactaagggtgtgccaacctccaccacctgtgcccaatgctgaaattttgacggaagatgatgaatttgaaataggtgatattattaggtatcagtgtcttccaggatttactttagttggtaatgcaattctgacgtgcagattaggagaacgactgcagatggatggagcacctccagtttgtcaagtgctctgtcctgccaatgaattacggctagattctactggagtcatattgagccctggatatcctgacagttacccaaatcttcaaatgtgtgcatggagcatttcagtggaaaagggttataatatcaccatgtttgtagaattcttccagacagaaaaggaatttgatgttcttcaggtgtatgatggaccaaatattcaaagtccagtgcttatttccctcagtggggattattcatctgcttttaatataacaagcaatggtcatgaagtatttcttcagtggtcagcagatcatggcaataacaaaaaaggcttccggataagatatatagctttctactgtagtacaccagaatccccacctcatggatatattatcagtcagacaggtgggcagcttaacagtgtggtccgttgggcctgtgatcgaggattccgacttgttggaaaaagcagtgctgtgtgcagaaagtcttcctatgggtatcatgcatgggatgcgccagtccctgcctgtcaagcaatttcctgtgggattcctaaagctccaacaaatggaggaatactaacaacagactatttggtaggaacgcgagttacctatttttgtaatgatggatatcgattgtcatccaaagaactcactacagctgtatgccaatcagatggaacatggagcaatcataacaagacccctcgctgtgttgttatttcctgtggagaactacctacacctccaaatggaaataagattggaactcaaacttcatatggctcaacagctatctttacctgcgacttgggattcatgcttgtgggctctgctgtaagggaatgcctttcctcaggtctttggagtgaatctgaaaccagatgcctagcgggtcattgtggaattccagaactgattgtgaatggtcaagtcattggagaaaattatggatatagagacacagttgtatatcaatgtaatcctggttttcgattgattggttcttcagtgaggatatgtcaacaggatcacaattggtctggtcagctcccatcctgtgtgcctgttagctgtggtcaccctggtagtccaatttatggaagaacaagtggaaatgggttcaactttaatgatgtggtaacattctcatgcaatattgggtatcttatgcaagggccaacaaaggcacagtgccaggccaacagacagtggagccatcctccacctatgtgcaaagtggtcaactgttctgatcctggaattccagccaattctaaaagagaaagtaaaatagaacatggaaattttacttacggcactgtggtattctatgactgcaatcctggatattttttatttggatcttcagttttgatatgtcaaccaaatggacaatgggacaaacctttaccagaatgtatcatgattgactgtggacaccctggcgttcctcctaatgcagtcctgtctggcgagaagtatacttttgggtctactgttcactattcctgcacaggaaagcgttcccttttaggccagtcatcaagaacctgccaattgaatggccattggagtggatcacaacctcattgttcaggtgatgctactgggacatgtggcgatccaggtactcccggccatggctctagacaggaaagcaatttcagaactaaaagtactgtacgttatgcttgtgatactggttacatccttcatggctcagaagaaagaacatgtttagctaatggcagttggaccggaaggcagccagagtgcaaagctgtgcagtgtggtaacccaggaaccacagccaatgggaaagtcttccgaattgatggcacaacattttctagttcagtcatttattcctgcatggagggatacatcctttctggaccttcagttagacagtgcacagccaatggaacatggtctggaactttacctaactgtacaataatcagttgtggagacccaggtataccagccaatggactgagatatggagatgattatgtggttggacaaaatgtttcttacatgtgccagccaggctacacgatggaattgaatggctccagaatcaggacttgtacaattaatggcacatggagtggagtaatgccaacttgtagagctgttacctgcccaactcctccccagatctctaatggaaggctggaaggaacaaatttcgactggggctttagtattagctacatctgttctccaggctatgagctatccttccctgctgttttgacctgtgtagggaatggtacctggagtggtgaagtaccgcagtgcttaccaaagttttgtggtgaccctggtatacctgcccaaggaaaaagagaaggcaaaagctttatataccagtcagaggtttcattcagctgcaattttcctttcatattagtgggatcaagcaccagaatatgtcaagcagatggcacttggagtggttcatcacctcactgcatagagcctacccaaacctcttgtgaaaacccaggtgtgcctcggcatggatctcagaacaatacattcggatttcaagtaggaagtgttgtacagttccattgcaaaaaaggacaccttctccaagggtctacaacacgcacctgcctccctgatcttacgtggagtgggattcagcctgaatgcataccccacagctgtaaacagccagaaactcctgctcatgcaaatgtcgtagggatggaccttccatctcatgggtatacactgatttatacctgtcagcctggcttcttcttagcaggtggaacagaacatagagtgtgtagatccgataacacctggactggaaaagttcccatttgtgaagctggttctaaaatattggtgaaagatcctagacctgcactgggaacacccagcccaaagctaagtgttcctgatgatgtatttgcccaaaattatatatggaaaggctcttacaatttcaaaggaaggaaacaacccatgaccttaacagttactagtttcaatgcttccactgggagagttaacgcaacactgagcaatagcaacatggagctgctactttcaggggtatataaaagccaggaagctcgcctaatgttacgcatatatcttattaaagtacctgctcatgcttctgtgaagaaaatgaaggaagaaaattgggcaatggatggctttgtttctgctgagcctgatggagctacttatgtatttcaaggatttattcaaggcaaagattatggacaatttggcctacaaagactgggactgaatatgtcagaaggttcaaattcttcaaatcaacctcatggtacaaatagtagttctgtagccattgctattcttgtgcctttttttgcacttatatttgcaggatttggattttatctttataaacaaaggactgcacctaaaacacagtatacaggatgttcagttcatgaaaataacaatggccaagcagcttttgaaaatcccatgtatgacaccaacgcaaagtcagtggaagggaaggcggtacgatttgatcccaacttgaacacggtttgcacaatggtataacgaggcaacctttgccttcttcagaagcttggaaatcgacacacaaaacagtgcacatttagttcactgctaaacaaattaaagcacacttttcaggacttgctgggtcaccttttcctgaggaatgatacagaagagtgttttttcataaactggaccataattcttcatgtttaccatggagagttttacagaaatttggctgcactctgagagtgcttactcacagtttatttgctttttttaaaaaggagattattctaaaatataaacttatttgcatatattggaggagcatccactatcagtatttctgtgctttataaactatattagagggactgggtttaaaaaaaaagatatagggtagaaataagagctatacttacaagagtcaatagatcactgacttctctttaactgtcctgagctacatcacgcccacaaatctgtctttcataccactctatctgccattcattcttgttaaatgaggcattgttttctttatttaagattgagttatgactttaaatgtttatgagctagtttatgcctcggaagacataaggtttcccattccaatttgaatctttctatttctttagcatcatattgctcttcttcttttagactggttgtcatagtttctgcaaagggcaagttcattgtgctaccctcccaattcccccattatggagtaaccagtattattcagtgagctatggggtagtgtttcactccttgcttcaatatggttttttcctatttatttttattattttttaatcccaaatgtgatagtagcttcagtatgtttcctcacccaaaaaccatttggctggcagaaattatctagaaaaattattattttgcagttatctgagacaccaaacttaccatcctttattttacaatatttttgatcgaccaaataaaatgtcctaataatctactctatttatatctacatttccttccagctgagtcttcaaatttagcattattttgacacttttaattttcatttaacaatggattagaaaaatattttggtctagccactaaacataatgactgaaaaaaattattattataaatcaccaatataaatttattgcctacaattgtggacttatcatatttttatatatttttaaatttctgtacctttattgttaaacaccaagtttcacatacaagaggtttctttcattgtcaaattaagatatgtatttgtaagttattggtggctcatttaaactgtatcatacagtaatgccagcatttttatttaataggtcatcgtcttccttttatagctgttttacttcattgaatacgatcatgtacccagtgttaactctttgttgttgtccctttcaaatatggataactctgtgaacagtcttgactttttgtatcatgagacagagtgcctaagagaaacccttgcacctgggagcgctgcttggctctatctctacaacatttaatgaatttcttgtaaaccactttgagatacattgttttggaaattcatacaattttctcaacatggtactctactggcaggatgcagttttaaattttatgccatcagttatttattcttgtttattcaaatgactgcaataacaatgattcattcattaatgttaaggctaatacatttaagatcttgtttaaacaatgtttcttctgcaactggctactcctcttatattaatgcatacacttttgtaaagaagtatatttttatgaaaagaaactttgtaaaagtatgatgtaaattttcagtgcaatgtaaacaaaataaaaatggataattgcttttgtaaaaaaaaaaaaaaaaaaaaaaaaaaaa

SEQ ID NO: 53107 - DNA, 13150 bp, Homo sapiens
gagactttgtgcccccgttggagagatggttgagtcctcgtcaaggttgctgtggtatcccagaaacaccattcactccgagctgtgaccgcgcaccaacaacagcaacaactccactgcgccgggctgaggagcaggaattaggagctcgcgaataatatgaaagggatccgcaaaggggaaagccgagcaaaggaatccaaaccctgggagcctggcaagcgaagatgcgctaaatgtggccgcctagacttcatcctgatgaagaaaatggggattaaaagtggatttacgttttggaacctcgtctttttattgacggtgtcttgtgtgaaaggatttatttatacatgtggtggaactttaaaaggacttaatggcactatagaaagccctggttttccatatggatatccaaatggtgcaaactgcacatgggtaataatagcagaagaacgaaatagaatacaaattgtttttcagtcatttgctctagaagaagaatacgactacttatcattatatgatggacatcctcatcctacaaactttaggacaaggttaacaggattccatctgccacctccagtgacaagtaccaaatctgtgttctcactacgtttgaccagtgattttgcagttagtgctcatggatttaaggtatattacgaagaattgcagagtagctcttgtggaaatcctggtgttccacccaaaggtgtattatatggcacaagattcgacgtcggggacaagatccgctacagctgtgtaactggatacatccttgatggccaccctcagctcacctgcatagccaattcagttaatacagcttcgtgggattttcctgttcctatctgtagagctgaagatgcttgtggaggaacaatgagaggatccagtggcatcatatccagccctagttttcctaatgagtaccataacaatgctgattgcacttggaccattgtagcagagcctggggacacaatttcactcatatttactgattttcaaatggaagagaaatatgattacttagaaatagaaggttctgagccacctaccatatggttatctggaatgaatataccaccaccaattatcagcaacaaaaactggctcagactgcattttgttacagacagcaatcatcgataccgtggatttagtgctccctatcaaggttcttctacattgacccacactacctccactggtgagttagaggagcataacaggactaccactggtgctattgctgttgctagcacacctgcagatgttactgtatccagtgttacagctgtcaccatccatagactttccgaggaacagcgagtgcaagttacgagtctcagaaattcaggtctggaccccaacacgtccaaggacgggctctctcctcatccagcagatacacaaagtaccaggagaagaccaagacatgctgaacagatagaaagaactaaagagcttgcagttgttactcatagagtgaaaaaggccatagattttaaatctagaggatttaaattgtttccagggaaagacaacagcaacaagttttctatcttaaatgagggaggtattaaaacagcttccaatttatgcccagatccaggagaaccagaaaatgggaagagaatcggatcagattttagccttggatcaactgtgcagttctcttgtgatgaagattatgtcctacagggcgcaaagagcatcacctgtcaacggatagctgaagtttttgctgcttggagtgatcacaggcctgtgtgtaaagtgaaaacgtgtggctctaatcttcaaggaccaagtggtacctttacatctcccaactttccgttccagtatgacagcaatgcacaatgtgtctgggtcatcacagcagtgaatacaaataaggttatccagataaattttgaagaatttgatctggagattggctatgataccttgacaattggcgatgggggcgaagttggagatcctaggacagtgctccaagtgctgactggaagctttgtaccagacttgatagtgagcatgagtagccaaatgtggctgcaccttcaaacggacgaaagtgttggatctgttggtttcaaggttaactacaaagaaattgagaaagaaagttgtggtgatcctggtacacccttatatggaattagagaaggcgatggattttctaatcgtgatgttttaaggtttgaatgccagtttgggtttgaattaattggagagaaatccattgtttgtcaagagaataaccaatggtctgcaaacatacccatctgtatctttccctgcctgtctaactttactgcaccaatgggaacagttctttctcctgattacccagaagggtatggaaataatttaaattgcatctggacgataatctctgatccagggagccggatacatctttctttcaatgactttgacctggaatcccagtttgatttccttgctgttaaagatggtgactctccagaatccccaattcttggaacctttactggggctgaggtgccttcccatcttactagtaatagtcacatactgcgattggaatttcaggctgaccactcaatgtcaggacgtggctttaacatcacttacaacacatttggacataatgaatgccctgatcctggaataccaatcaatgcacggcggtttggggacaactttcaattaggaagttcaatttcagttatttgtgaagaaggatttattaaaacccagggaacagaaacaattacatgtattcttatggatggaaaagtaatgtggagtggactgattccaaaatgtggagccccatgtggtggccatttttcagctcccagtggagtgattctctcaccaggatggccaggatactacaaagactctttgaattgtgagtgggtgattgaagctgaacctggacactctatcaaaattacatttgaaagatttcagactgaactgaattatgatgttctggaagttcatgatgggccaaatcttctgtcacccttgcttggatcttacaatggcacccaagtgccccagtttctatttagtagcagtaattttatataccttctatttacaacagacaacagtcgttccaataatggtttcaagattcattatgaaagtgttacagtgaacacgtattcttgtttggaccctggcatacctgtacatggccgtcgctatggtcatgatttctccattggctctactgtttcatttagttgtgattcaggatacaggttgagtcatgaagagccccttctatgcgaaaaaaaccactggtggagtcatccacttccaacctgtgatgcattatgtggaggagatgttagagggcctagtggaacaatcttatcacctggttacccggaattttatccaaattctctgaattgtacatggactgttgatgtaacccatggaaaaggtgtgcagttcaacttccacacttttcatttggaagaccatcatgactacttactgatcacagagaatggcagttttacccaaccactggcacgcctgactggttcagatcttcctccaacaatcaatgctggtctctatggaaatttcagggctcaattgcgtttcatttcagatttttcaatatcatatgaaggatttaacataacattctctgaatataaccttgaaccttgtgaagatcctggcattcctcaatatggtagtcgaatcgggttcaactttgggattggtgacactctgaccttctcatgctcttcgggttatcgactggaaggaacatcagagatcatctgtcttggtggtggccgacgagtgtggagtgcacctctgccaaggtgtgtggctgaatgtggtgcatctgcaacgaataatgaaggaattttgctgtctccaaattatccactcaactatgaaaacaaccatgaatgcatttatagtattcaggttcaagcaggaaagggaatcaatatttcagccagaacatttcatttagcacaaggagatgttcttaagatttatgatggaaaagataaaacgactcatctactaggtgcttttactggtgcatctatgcgcggactgacacttagtagtacttcaaatcaactctggctagaatttaattccgatactgaagggacagatgaaggctttcaacttgtgtataccagttttgaactctcacactgtgaagatcctggcattccacaatttggatacaagatcagtgaccaaggccactttgctggtagcaccatcatttatggatgcaatccaggctacactctccacggaagtagccttctcaagtgcatgacaggggagagaagggcatgggactatcctctgccttcctgtattgctgaatgtggaggtcgttttaaaggagaatcatcaggaagaatcttatctcctggctatccttttccatatgacaataacctgcgttgcatgtggatgattgaggtagatcctggaaatattgtcagcttgcagtttcttgcttttgatacggaagcatcacatgatatactccgagtctgggacggtccaccagaaaatgatatgcttttaaaggaaattagtggatctcttattcctgaaggaattcatagcaccctcaatatagtaaccatccagtttgacacggatttttatattagcaaatctggatttgcaattcagttttcaagttctgttgccactgcgtgtcgtgacccaggggtccccatgaatgggactcgaaatggggatggaagagaacctggggacactgttgtttttcaatgtgacccaggatatgaacttcaaggagaggaaagaataacctgcattcaggtagaaaatcggtacttctggcagcccagcccaccagtctgtatagcaccctgtggaggcaatttaacaggatcttcaggctttattctttcaccaaacttccctcatccatatccgcatagcagagactgtgactggactatcaccgtcaatgcagactatgttatctccttggcgttcatcagttttagcatagaaccaaactatgacttcctctatatctatgatggaccagacagtaatagcccactgattggaagttttcaagacagcaagttaccagagagaatagaaagcagctcaaatacaatgcatttggcttttcggagtgatggatctgttagttacactggatttcatctagaatacaaagcaaaactgcgagagtcctgctttgatccaggcaatataatgaatggcaccagacttggaatggattataaattagggtcaacagtcacctattactgtgatgctggttatgttcttcaaggttattcaacactcacctgtatcatgggagatgatggaagacctggatggaatagagccttgccaagttgtcatgcgccctgtggaagtcgttcaacaggttcagaaggcactgttctatcaccaaactatccaaaaaattacagtgtgggacataattgtgtttattctatagcagttccaaaggagtttgtggtgtttggccagtttgtatttttccagacatcactccacgatgttgttgaggtgtatgatgggccaactcagcaatcttctctgttatcttccctctcaggatcccattcaggagaatcacttccactgagttcaggtaatcagatcacaattcgatttacttcagttggaccaataacagctaagggatttcactttgtttaccaagctgttcctagaacaagttctacacaatgcagttctgtgcctgaaccaagattcggaagaagaattggcaatgaatttgcagtcggttcatcggttctttttgattgtaatccaggatatattctccatggatccatagcaattaggtgtgaaacagtgcccaattctttggcccagtggaatgattccttacctacttgtattgtgccctgtggtggaattttaactaagcgcaaagggactattttgtcacctggataccctgagccttatgacaacaatctgaattgtgtgtggaagatcacagtgccagagggagctggcattcaagtgcaagttgttagctttgctacagaacataattgggattctctggacttttatgatgggggagacaacaatgctccaagacttggaagctattcaggaacaacaataccccatcttttgaatagtacgtctaataatctgtatctaaattttcaatcagacatcagtgtttctgctgcaggatttcatcttgaatacacagcaattggtttggattcctgtcctgaaccacaaactcctagcagtggaattaaaattggagacagatatatggttggagatgtagtatcctttcagtgtgatcaaggatattctcttcagggtcactctcacattacatgtatgccaggacctgtaagaagatggaattatccaatcccaatttgtttagctcagtgtggtggtgctatgtcagacttcagtggtgtgatcctcagtcctgggtttcctggaaactatcccagcagtttagattgcacatggacaataaatctacccataggttttggtgtacatctccagtttgtaaatttttctacagaaaccatacatgattatttggaagtacgaagtggatcctcagaaactagtactgttattggccggcttagtggtcctcaaataccatcttccttattcagcaccacccatgaaaccagcttatattttcacagtgactattcacaaaacaaacaagggtttcatattgtataccaagcctatcagttgcaaagctgtcctgatccacgcccgtttcgaaatggttttgtaattggtaatgattttactgtgggtcaaaccatttcatttgaatgtttcccaggatacacattaattggaaattcagctctcacatgccttcacggagtcagtcgtaattggaatcatccacttccaaggtgtgaagctctttgtggtgggaatataactgcaatgaatggcaccatttattctcctgggtatcctgatgaatatccaaactttcaagattgtttttggcttgtaagagtaccccctgggaatggcatctacatcaattttactgtccttcaaacagaaccaatatatgatttcattactgtatgggatggaccagaccaaaattcacctcagatcggtcagttcagtggcaataccgctttggaatcagtctacagtacttcaaatcagattctaatcaaattccacagtgatttcacaacaagtggcttttttgtgctcagttatcacgcctatcaactaagggtgtgccaacctccaccacctgtgcccaatgctgaaattttgacggaagatgatgaatttgaaataggtgatattattaggtatcagtgtcttccaggatttactttagttggtaatgcaattctgacgtgcagattaggagaacgactgcagatggatggagcacctccagtttgtcaagtgctctgtcctgccaatgaattacggctagattctactggagtcatattgagccctggatatcctgacagttacccaaatcttcaaatgtgtgcatggagcatttcagtggaaaagggttataatatcaccatgtttgtagaattcttccagacagaaaaggaatttgatgttcttcaggtgtatgatggaccaaatattcaaagtccagtgcttatttccctcagtggggattattcatctgcttttaatataacaagcaatggtcatgaagtatttcttcagtggtcagcagatcatggcaataacaaaaaaggcttccggataagatatatagctttctactgtagtacaccagaatccccacctcatggatatattatcagtcagacaggtgggcagcttaacagtgtggtccgttgggcctgtgatcgaggattccgacttgttggaaaaagcagtgctgtgtgcagaaagtcttcctatgggtatcatgcatgggatgcgccagtccctgcctgtcaagcaatttcctgtgggattcctaaagctccaacaaatggaggaatactaacaacagactatttggtaggaacgcgagttacctatttttgtaatgatggatatcgattgtcatccaaagaactcactacagctgtatgccaatcagatggaacatggagcaatcataacaagacccctcgctgtgttgttgttacatgtccaagcatcaattcctttatcttggaacatggaagatggcgaattgtgaatggctcccattatgaatacaaaaccaaagtagttttcagctgtgaccctggttatcatggactaggtcctgcctccatcgaatgtcttcctaatggtacttggagttggagaaatgaaagaccatattgccaaattatttcctgtggagaactacctacacctccaaatggaaataagattggaactcaaacttcatatggctcaacagctatctttacctgcgacttgggattcatgcttgtgggctctgctgtaagggaatgcctttcctcaggtctttggagtgaatctgaaaccagatgcctagcgggtcattgtggaattccagaactgattgtgaatggtcaagtcattggagaaaattatggatatagagacacagttgtatatcaatgtaatcctggttttcgattgattggttcttcagtgaggatatgtcaacaggatcacaattggtctggtcagctcccatcctgtgtgcctgttagctgtggtcaccctggtagtccaatttatggaagaacaagtggaaatgggttcaactttaatgatgtggtaacattctcatgcaatattgggtatcttatgcaagggccaacaaaggcacagtgccaggccaacagacagtggagccatcctccacctatgtgcaaagtggtcaactgttctgatcctggaattccagccaattctaaaagagaaagtaaaatagaacatggaaattttacttacggcactgtggtattctatgactgcaatcctggatattttttatttggatcttcagttttgatatgtcaaccaaatggacaatgggacaaacctttaccagaatgtatcatgattgactgtggacaccctggcgttcctcctaatgcagtcctgtctggcgagaagtatacttttgggtctactgttcactattcctgcacaggaaagcgttcccttttaggccagtcatcaagaacctgccaattgaatggccattggagtggatcacaacctcattgttcaggtgatgctactgggacatgtggcgatccaggtactcccggccatggctctagacaggaaagcaatttcagaactaaaagtactgtacgttatgcttgtgatactggttacatccttcatggctcagaagaaagaacatgtttagctaatggcagttggaccggaaggcagccagagtgcaaagctgtgcagtgtggtaacccaggaaccacagccaatgggaaagtcttccgaattgatggcacaacattttctagttcagtcatttattcctgcatggagggatacatcctttctggaccttcagttagacagtgcacagccaatggaacatggtctggaactttacctaactgtacaataatcagttgtggagacccaggtataccagccaatggactgagatatggagatgattatgtggttggacaaaatgtttcttacatgtgccagccaggctacacgatggaattgaatggctccagaatcaggacttgtacaattaatggcacatggagtggagtaatgccaacttgtagagctgttacctgcccaactcctccccagatctctaatggaaggctggaaggaacaaatttcgactggggctttagtattagctacatctgttctccaggctatgagctatccttccctgctgttttgacctgtgtagggaatggtacctggagtggtgaagtaccgcagtgcttaccaaagttttgtggtgaccctggtatacctgcccaaggaaaaagagaaggcaaaagctttatataccagtcagaggtttcattcagctgcaattttcctttcatattagtgggatcaagcaccagaatatgtcaagcagatggcacttggagtggttcatcacctcactgcatagagcctacccaaacctcttgtgaaaacccaggtgtgcctcggcatggatctcagaacaatacattcggatttcaagtaggaagtgttgtacagttccattgcaaaaaaggacaccttctccaagggtctacaacacgcacctgcctccctgatcttacgtggagtgggattcagcctgaatgcataccccacagctgtaaacagccagaaactcctgctcatgcaaatgtcgtagggatggaccttccatctcatgggtatacactgatttatacctgtcagcctggcttcttcttagcaggtggaacagaacatagagtgtgtagatccgataacacctggactggaaaagttcccatttgtgaagctggttctaaaatattggtgaaagatcctagacctgcactgggaacacccagcccaaagctaagtgttcctgatgatgtatttgcccaaaattatatatggaaaggctcttacaatttcaaaggaaggaaacaacccatgaccttaacagttactagtttcaatgcttccactgggagagttaacgcaacactgagcaatagcaacatggagctgctactttcaggggtatataaaagccaggaagctcgcctaatgttacgcatatatcttattaaagtacctgctcatgcttctgtgaagaaaatgaaggaagaaaattgggcaatggatggctttgtttctgctgagcctgatggagctacttatgtatttcaaggatttattcaaggcaaagattatggacaatttggcctacaaagactgggactgaatatgtcagaaggttcaaattcttcaaatcaacctcatggtacaaatagtagttctgtagccattgctattcttgtgcctttttttgcacttatatttgcaggatttggattttatctttataaacaaaggactgcacctaaaacacagtatacaggatgttcagttcatgaaaataacaatggccaagcagcttttgaaaatcccatgtatgacaccaacgcaaagtcagtggaagggaaggcggtacgatttgatcccaacttgaacacggtttgcacaatggtataacgaggcaacctttgccttcttcagaagcttggaaatcgacacacaaaacagtgcacatttagttcactgctaaacaaattaaagcacacttttcaggacttgctgggtcaccttttcctgaggaatgatacagaagagtgttttttcataaactggaccataattcttcatgtttaccatggagagttttacagaaatttggctgcactctgagagtgcttactcacagtttatttgctttttttaaaaaggagattattctaaaatataaacttatttgcatatattggaggagcatccactatcagtatttctgtgctttataaactatattagagggactgggtttaaaaaaaaagatatagggtagaaataagagctatacttacaagagtcaatagatcactgacttctctttaactgtcctgagctacatcacgcccacaaatctgtctttcataccactctatctgccattcattcttgttaaatgaggcattgttttctttatttaagattgagttatgactttaaatgtttatgagctagtttatgcctcggaagacataaggtttcccattccaatttgaatctttctatttctttagcatcatattgctcttcttcttttagactggttgtcatagtttctgcaaagggcaagttcattgtgctaccctcccaattcccccattatggagtaaccagtattattcagtgagctatggggtagtgtttcactccttgcttcaatatggttttttcctatttatttttattattttttaatcccaaatgtgatagtagcttcagtatgtttcctcacccaaaaaccatttggctggcagaaattatctagaaaaattattattttgcagttatctgagacaccaaacttaccatcctttattttacaatatttttgatcgaccaaataaaatgtcctaataatctactctatttatatctacatttccttccagctgagtcttcaaatttagcattattttgacacttttaattttcatttaacaatggattagaaaaatattttggtctagccactaaacataatgactgaaaaaaattattattataaatcaccaatataaatttattgcctacaattgtggacttatcatatttttatatatttttaaatttctgtacctttattgttaaacaccaagtttcacatacaagaggtttctttcattgtcaaattaagatatgtatttgtaagttattggtggctcatttaaactgtatcatacagtaatgccagcatttttatttaataggtcatcgtcttccttttatagctgttttacttcattgaatacgatcatgtacccagtgttaactctttgttgttgtccctttcaaatatggataactctgtgaacagtcttgactttttgtatcatgagacagagtgcctaagagaaacccttgcacctgggagcgctgcttggctctatctctacaacatttaatgaatttcttgtaaaccactttgagatacattgttttggaaattcatacaattttctcaacatggtactctactggcaggatgcagttttaaattttatgccatcagttatttattcttgtttattcaaatgactgcaataacaatgattcattcattaatgttaaggctaatacatttaagatcttgtttaaacaatgtttcttctgcaactggctactcctcttatattaatgcatacacttttgtaaagaagtatatttttatgaaaagaaactttgtaaaagtatgatgtaaattttcagtgcaatgtaaacaaaataaaaatggataattgcttttgtaaaaaaaaaaaaaaaaaaaaaaaaaaaa

SEQ ID NO: 53108 - DNA, 13042 bp, Homo sapiens
tacacccctcggccctttggaggaccggagagccggacgacgccgcagcccttgggggagtccagcgccagctggcgaaaagaagcttcatcttccagatcatccgggaaaggggcagaggtggccggttgttgcgactcataaacaacctcttcagcacaacccggttgaatgtggagttggttcctttgctggaaacctgtacagcttgaccgacagacagcctcaggatttatttatacatgtggtggaactttaaaaggacttaatggcactatagaaagccctggttttccatatggatatccaaatggtgcaaactgcacatgggtaataatagcagaagaacgaaatagaatacaaattgtttttcagtcatttgctctagaagaagaatacgactacttatcattatatgatggacatcctcatcctacaaactttaggacaaggttaacaggattccatctgccacctccagtgacaagtaccaaatctgtgttctcactacgtttgaccagtgattttgcagttagtgctcatggatttaaggtatattacgaagaattgcagagtagctcttgtggaaatcctggtgttccacccaaaggtgtattatatggcacaagattcgacgtcggggacaagatccgctacagctgtgtaactggatacatccttgatggccaccctcagctcacctgcatagccaattcagttaatacagcttcgtgggattttcctgttcctatctgtagagctgaagatgcttgtggaggaacaatgagaggatccagtggcatcatatccagccctagttttcctaatgagtaccataacaatgctgattgcacttggaccattgtagcagagcctggggacacaatttcactcatatttactgattttcaaatggaagagaaatatgattacttagaaatagaaggttctgagccacctaccatatggttatctggaatgaatataccaccaccaattatcagcaacaaaaactggctcagactgcattttgttacagacagcaatcatcgataccgtggatttagtgctccctatcaaggttcttctacattgacccacactacctccactggtgagttagaggagcataacaggactaccactggtgctattgctgttgctagcacacctgcagatgttactgtatccagtgttacagctgtcaccatccatagactttccgaggaacagcgagtgcaagttacgagtctcagaaattcaggtctggaccccaacacgtccaaggacgggctctctcctcatccagcagatacacaaagtaccaggagaagaccaagacatgctgaacagatagaaagaactaaagagcttgcagttgttactcatagagtgaaaaaggccatagattttaaatctagaggatttaaattgtttccagggaaagacaacagcaacaagttttctatcttaaatgagggaggtattaaaacagcttccaatttatgcccagatccaggagaaccagaaaatgggaagagaatcggatcagattttagccttggatcaactgtgcagttctcttgtgatgaagattatgtcctacagggcgcaaagagcatcacctgtcaacggatagctgaagtttttgctgcttggagtgatcacaggcctgtgtgtaaagtgaaaacgtgtggctctaatcttcaaggaccaagtggtacctttacatctcccaactttccgttccagtatgacagcaatgcacaatgtgtctgggtcatcacagcagtgaatacaaataaggttatccagataaattttgaagaatttgatctggagattggctatgataccttgacaattggcgatgggggcgaagttggagatcctaggacagtgctccaagtgctgactggaagctttgtaccagacttgatagtgagcatgagtagccaaatgtggctgcaccttcaaacggacgaaagtgttggatctgttggtttcaaggttaactacaaagaaattgagaaagaaagttgtggtgatcctggtacacccttatatggaattagagaaggcgatggattttctaatcgtgatgttttaaggtttgaatgccagtttgggtttgaattaattggagagaaatccattgtttgtcaagagaataaccaatggtctgcaaacatacccatctgtatctttccctgcctgtctaactttactgcaccaatgggaacagttctttctcctgattacccagaagggtatggaaataatttaaattgcatctggacgataatctctgatccagggagccggatacatctttctttcaatgactttgacctggaatcccagtttgatttccttgctgttaaagatggtgactctccagaatccccaattcttggaacctttactggggctgaggtgccttcccatcttactagtaatagtcacatactgcgattggaatttcaggctgaccactcaatgtcaggacgtggctttaacatcacttacaacacatttggacataatgaatgccctgatcctggaataccaatcaatgcacggcggtttggggacaactttcaattaggaagttcaatttcagttatttgtgaagaaggatttattaaaacccagggaacagaaacaattacatgtattcttatggatggaaaagtaatgtggagtggactgattccaaaatgtggagccccatgtggtggccatttttcagctcccagtggagtgattctctcaccaggatggccaggatactacaaagactctttgaattgtgagtgggtgattgaagctgaacctggacactctatcaaaattacatttgaaagatttcagactgaactgaattatgatgttctggaagttcatgatgggccaaatcttctgtcacccttgcttggatcttacaatggcacccaagtgccccagtttctatttagtagcagtaattttatataccttctatttacaacagacaacagtcgttccaataatggtttcaagattcattatgaaagtgttacagtgaacacgtattcttgtttggaccctggcatacctgtacatggccgtcgctatggtcatgatttctccattggctctactgtttcatttagttgtgattcaggatacaggttgagtcatgaagagccccttctatgcgaaaaaaaccactggtggagtcatccacttccaacctgtgatgcattatgtggaggagatgttagagggcctagtggaacaatcttatcacctggttacccggaattttatccaaattctctgaattgtacatggactgttgatgtaacccatggaaaaggtgtgcagttcaacttccacacttttcatttggaagaccatcatgactacttactgatcacagagaatggcagttttacccaaccactggcacgcctgactggttcagatcttcctccaacaatcaatgctggtctctatggaaatttcagggctcaattgcgtttcatttcagatttttcaatatcatatgaaggatttaacataacattctctgaatataaccttgaaccttgtgaagatcctggcattcctcaatatggtagtcgaatcgggttcaactttgggattggtgacactctgaccttctcatgctcttcgggttatcgactggaaggaacatcagagatcatctgtcttggtggtggccgacgagtgtggagtgcacctctgccaaggtgtgtggctgaatgtggtgcatctgcaacgaataatgaaggaattttgctgtctccaaattatccactcaactatgaaaacaaccatgaatgcatttatagtattcaggttcaagcaggaaagggaatcaatatttcagccagaacatttcatttagcacaaggagatgttcttaagatttatgatggaaaagataaaacgactcatctactaggtgcttttactggtgcatctatgcgcggactgacacttagtagtacttcaaatcaactctggctagaatttaattccgatactgaagggacagatgaaggctttcaacttgtgtataccagttttgaactctcacactgtgaagatcctggcattccacaatttggatacaagatcagtgaccaaggccactttgctggtagcaccatcatttatggatgcaatccaggctacactctccacggaagtagccttctcaagtgcatgacaggggagagaagggcatgggactatcctctgccttcctgtattgctgaatgtggaggtcgttttaaaggagaatcatcaggaagaatcttatctcctggctatccttttccatatgacaataacctgcgttgcatgtggatgattgaggtagatcctggaaatattgtcagcttgcagtttcttgcttttgatacggaagcatcacatgatatactccgagtctgggacggtccaccagaaaatgatatgcttttaaaggaaattagtggatctcttattcctgaaggaattcatagcaccctcaatatagtaaccatccagtttgacacggatttttatattagcaaatctggatttgcaattcagttttcaagttctgttgccactgcgtgtcgtgacccaggggtccccatgaatgggactcgaaatggggatggaagagaacctggggacactgttgtttttcaatgtgacccaggatatgaacttcaaggagaggaaagaataacctgcattcaggtagaaaatcggtacttctggcagcccagcccaccagtctgtatagcaccctgtggaggcaatttaacaggatcttcaggctttattctttcaccaaacttccctcatccatatccgcatagcagagactgtgactggactatcaccgtcaatgcagactatgttatctccttggcgttcatcagttttagcatagaaccaaactatgacttcctctatatctatgatggaccagacagtaatagcccactgattggaagttttcaagacagcaagttaccagagagaatagaaagcagctcaaatacaatgcatttggcttttcggagtgatggatctgttagttacactggatttcatctagaatacaaagcaaaactgcgagagtcctgctttgatccaggcaatataatgaatggcaccagacttggaatggattataaattagggtcaacagtcacctattactgtgatgctggttatgttcttcaaggttattcaacactcacctgtatcatgggagatgatggaagacctggatggaatagagccttgccaagttgtcatgcgccctgtggaagtcgttcaacaggttcagaaggcactgttctatcaccaaactatccaaaaaattacagtgtgggacataattgtgtttattctatagcagttccaaaggagtttgtggtgtttggccagtttgtatttttccagacatcactccacgatgttgttgaggtgtatgatgggccaactcagcaatcttctctgttatcttccctctcaggatcccattcaggagaatcacttccactgagttcaggtaatcagatcacaattcgatttacttcagttggaccaataacagctaagggatttcactttgtttaccaagctgttcctagaacaagttctacacaatgcagttctgtgcctgaaccaagattcggaagaagaattggcaatgaatttgcagtcggttcatcggttctttttgattgtaatccaggatatattctccatggatccatagcaattaggtgtgaaacagtgcccaattctttggcccagtggaatgattccttacctacttgtattgtgccctgtggtggaattttaactaagcgcaaagggactattttgtcacctggataccctgagccttatgacaacaatctgaattgtgtgtggaagatcacagtgccagagggagctggcattcaagtgcaagttgttagctttgctacagaacataattgggattctctggacttttatgatgggggagacaacaatgctccaagacttggaagctattcaggaacaacaataccccatcttttgaatagtacgtctaataatctgtatctaaattttcaatcagacatcagtgtttctgctgcaggatttcatcttgaatacacagcaattggtttggattcctgtcctgaaccacaaactcctagcagtggaattaaaattggagacagatatatggttggagatgtagtatcctttcagtgtgatcaaggatattctcttcagggtcactctcacattacatgtatgccaggacctgtaagaagatggaattatccaatcccaatttgtttagctcagtgtggtggtgctatgtcagacttcagtggtgtgatcctcagtcctgggtttcctggaaactatcccagcagtttagattgcacatggacaataaatctacccataggttttggtgtacatctccagtttgtaaatttttctacagaaaccatacatgattatttggaagtacgaagtggatcctcagaaactagtactgttattggccggcttagtggtcctcaaataccatcttccttattcagcaccacccatgaaaccagcttatattttcacagtgactattcacaaaacaaacaagggtttcatattgtataccaagcctatcagttgcaaagctgtcctgatccacgcccgtttcgaaatggttttgtaattggtaatgattttactgtgggtcaaaccatttcatttgaatgtttcccaggatacacattaattggaaattcagctctcacatgccttcacggagtcagtcgtaattggaatcatccacttccaaggtgtgaagctctttgtggtgggaatataactgcaatgaatggcaccatttattctcctgggtatcctgatgaatatccaaactttcaagattgtttttggcttgtaagagtaccccctgggaatggcatctacatcaattttactgtccttcaaacagaaccaatatatgatttcattactgtatgggatggaccagaccaaaattcacctcagatcggtcagttcagtggcaataccgctttggaatcagtctacagtacttcaaatcagattctaatcaaattccacagtgatttcacaacaagtggcttttttgtgctcagttatcacgcctatcaactaagggtgtgccaacctccaccacctgtgcccaatgctgaaattttgacggaagatgatgaatttgaaataggtgatattattaggtatcagtgtcttccaggatttactttagttggtaatgcaattctgacgtgcagattaggagaacgactgcagatggatggagcacctccagtttgtcaagtgctctgtcctgccaatgaattacggctagattctactggagtcatattgagccctggatatcctgacagttacccaaatcttcaaatgtgtgcatggagcatttcagtggaaaagggttataatatcaccatgtttgtagaattcttccagacagaaaaggaatttgatgttcttcaggtgtatgatggaccaaatattcaaagtccagtgcttatttccctcagtggggattattcatctgcttttaatataacaagcaatggtcatgaagtatttcttcagtggtcagcagatcatggcaataacaaaaaaggcttccggataagatatatagctttctactgtagtacaccagaatccccacctcatggatatattatcagtcagacaggtgggcagcttaacagtgtggtccgttgggcctgtgatcgaggattccgacttgttggaaaaagcagtgctgtgtgcagaaagtcttcctatgggtatcatgcatgggatgcgccagtccctgcctgtcaagcaatttcctgtgggattcctaaagctccaacaaatggaggaatactaacaacagactatttggtaggaacgcgagttacctatttttgtaatgatggatatcgattgtcatccaaagaactcactacagctgtatgccaatcagatggaacatggagcaatcataacaagacccctcgctgtgttgttgttacatgtccaagcatcaattcctttatcttggaacatggaagatggcgaattgtgaatggctcccattatgaatacaaaaccaaagtagttttcagctgtgaccctggttatcatggactaggtcctgcctccatcgaatgtcttcctaatggtacttggagttggagaaatgaaagaccatattgccaaattatttcctgtggagaactacctacacctccaaatggaaataagattggaactcaaacttcatatggctcaacagctatctttacctgcgacttgggattcatgcttgtgggctctgctgtaagggaatgcctttcctcaggtctttggagtgaatctgaaaccagatgcctagcgggtcattgtggaattccagaactgattgtgaatggtcaagtcattggagaaaattatggatatagagacacagttgtatatcaatgtaatcctggttttcgattgattggttcttcagtgaggatatgtcaacaggatcacaattggtctggtcagctcccatcctgtgtgcctgttagctgtggtcaccctggtagtccaatttatggaagaacaagtggaaatgggttcaactttaatgatgtggtaacattctcatgcaatattgggtatcttatgcaagggccaacaaaggcacagtgccaggccaacagacagtggagccatcctccacctatgtgcaaagtggtcaactgttctgatcctggaattccagccaattctaaaagagaaagtaaaatagaacatggaaattttacttacggcactgtggtattctatgactgcaatcctggatattttttatttggatcttcagttttgatatgtcaaccaaatggacaatgggacaaacctttaccagaatgtatcatgattgactgtggacaccctggcgttcctcctaatgcagtcctgtctggcgagaagtatacttttgggtctactgttcactattcctgcacaggaaagcgttcccttttaggccagtcatcaagaacctgccaattgaatggccattggagtggatcacaacctcattgttcaggtgatgctactgggacatgtggcgatccaggtactcccggccatggctctagacaggaaagcaatttcagaactaaaagtactgtacgttatgcttgtgatactggttacatccttcatggctcagaagaaagaacatgtttagctaatggcagttggaccggaaggcagccagagtgcaaagctgtgcagtgtggtaacccaggaaccacagccaatgggaaagtcttccgaattgatggcacaacattttctagttcagtcatttattcctgcatggagggatacatcctttctggaccttcagttagacagtgcacagccaatggaacatggtctggaactttacctaactgtacaataatcagttgtggagacccaggtataccagccaatggactgagatatggagatgattatgtggttggacaaaatgtttcttacatgtgccagccaggctacacgatggaattgaatggctccagaatcaggacttgtacaattaatggcacatggagtggagtaatgccaacttgtagagctgttacctgcccaactcctccccagatctctaatggaaggctggaaggaacaaatttcgactggggctttagtattagctacatctgttctccaggctatgagctatccttccctgctgttttgacctgtgtagggaatggtacctggagtggtgaagtaccgcagtgcttaccaaagttttgtggtgaccctggtatacctgcccaaggaaaaagagaaggcaaaagctttatataccagtcagaggtttcattcagctgcaattttcctttcatattagtgggatcaagcaccagaatatgtcaagcagatggcacttggagtggttcatcacctcactgcatagagcctacccaaacctcttgtgaaaacccaggtgtgcctcggcatggatctcagaacaatacattcggatttcaagtaggaagtgttgtacagttccattgcaaaaaaggacaccttctccaagggtctacaacacgcacctgcctccctgatcttacgtggagtgggattcagcctgaatgcataccccacagctgtaaacagccagaaactcctgctcatgcaaatgtcgtagggatggaccttccatctcatgggtatacactgatttatacctgtcagcctggcttcttcttagcaggtggaacagaacatagagtgtgtagatccgataacacctggactggaaaagttcccatttgtgaagctggttctaaaatattggtgaaagatcctagacctgcactgggaacacccagcccaaagctaagtgttcctgatgatgtatttgcccaaaattatatatggaaaggctcttacaatttcaaaggaaggaaacaacccatgaccttaacagttactagtttcaatgcttccactgggagagttaacgcaacactgagcaatagcaacatggagctgctactttcaggggtatataaaagccaggaagctcgcctaatgttacgcatatatcttattaaagtacctgctcatgcttctgtgaagaaaatgaaggaagaaaattgggcaatggatggctttgtttctgctgagcctgatggagctacttatgtatttcaaggatttattcaaggcaaagattatggacaatttggcctacaaagactgggactgaatatgtcagaaggttcaaattcttcaaatcaacctcatggtacaaatagtagttctgtagccattgctattcttgtgcctttttttgcacttatatttgcaggatttggattttatctttataaacaaaggactgcacctaaaacacagtatacaggatgttcagttcatgaaaataacaatggccaagcagcttttgaaaatcccatgtatgacaccaacgcaaagtcagtggaagggaaggcggtacgatttgatcccaacttgaacacggtttgcacaatggtataacgaggcaacctttgccttcttcagaagcttggaaatcgacacacaaaacagtgcacatttagttcactgctaaacaaattaaagcacacttttcaggacttgctgggtcaccttttcctgaggaatgatacagaagagtgttttttcataaactggaccataattcttcatgtttaccatggagagttttacagaaatttggctgcactctgagagtgcttactcacagtttatttgctttttttaaaaaggagattattctaaaatataaacttatttgcatatattggaggagcatccactatcagtatttctgtgctttataaactatattagagggactgggtttaaaaaaaaagatatagggtagaaataagagctatacttacaagagtcaatagatcactgacttctctttaactgtcctgagctacatcacgcccacaaatctgtctttcataccactctatctgccattcattcttgttaaatgaggcattgttttctttatttaagattgagttatgactttaaatgtttatgagctagtttatgcctcggaagacataaggtttcccattccaatttgaatctttctatttctttagcatcatattgctcttcttcttttagactggttgtcatagtttctgcaaagggcaagttcattgtgctaccctcccaattcccccattatggagtaaccagtattattcagtgagctatggggtagtgtttcactccttgcttcaatatggttttttcctatttatttttattattttttaatcccaaatgtgatagtagcttcagtatgtttcctcacccaaaaaccatttggctggcagaaattatctagaaaaattattattttgcagttatctgagacaccaaacttaccatcctttattttacaatatttttgatcgaccaaataaaatgtcctaataatctactctatttatatctacatttccttccagctgagtcttcaaatttagcattattttgacacttttaattttcatttaacaatggattagaaaaatattttggtctagccactaaacataatgactgaaaaaaattattattataaatcaccaatataaatttattgcctacaattgtggacttatcatatttttatatatttttaaatttctgtacctttattgttaaacaccaagtttcacatacaagaggtttctttcattgtcaaattaagatatgtatttgtaagttattggtggctcatttaaactgtatcatacagtaatgccagcatttttatttaataggtcatcgtcttccttttatagctgttttacttcattgaatacgatcatgtacccagtgttaactctttgttgttgtccctttcaaatatggataactctgtgaacagtcttgactttttgtatcatgagacagagtgcctaagagaaacccttgcacctgggagcgctgcttggctctatctctacaacatttaatgaatttcttgtaaaccactttgagatacattgttttggaaattcatacaattttctcaacatggtactctactggcaggatgcagttttaaattttatgccatcagttatttattcttgtttattcaaatgactgcaataacaatgattcattcattaatgttaaggctaatacatttaagatcttgtttaaacaatgtttcttctgcaactggctactcctcttatattaatgcatacacttttgtaaagaagtatatttttatgaaaagaaactttgtaaaagtatgatgtaaattttcagtgcaatgtaaacaaaataaaaatggataattgcttttgtaaaaaaaaaaaaaaaaaaaaaaaaaaaa

SEQ ID NO: 53109 - DNA, 2005 bp, Homo sapiens
cgcgccatggggcgagccgggggcgggggcccgggccgggggccgccgccactgctgctgtttctgggggccgcgctggtcctggcctctggggccgtgccggcgcgtgaggcgggcagcgcggttgaggccgaagagctggtgaagggcagcccggcgtgggagccgcctgccaacgacacgcgggaagaagccggcccaccagcggctggggaagatgaggcgtcgtggacggcgcccggtggcgagctggccgggccagaagaggtgctgcaggagtcggctgcggtgaccggcaccgcctggctggaagctgacagcccaggcctgggaggagtgaccgcagaggcgggcagcggcgatgcccaggcccttccagctacgctccaggctccccacgaggtcctcgggcagtcaatcatgccccctgccattcctgaggctacagaggccagcgggccaccctcccccacccccggcgacaagctgagcccagcttctgaactccccaaggagagccccttggaggtttggctgaacctggggggcagcacacccgaccctcaagtgccagagctgacttacccatttcagggcaccctggagccccaaccggcatcagatatcattgacatcgactacttcgaaggactggatggtgagggtcgtggcgcagatctggggagcttcccagggtcaccaggaacctcagagaaccaccctgatactgagggagagaccccttcctggagcctgcttgacttatacgatgatttcacccccttcgatgaatctgatttctaccccaccacatccttttatgatgacttggatgaagaggaggaggaagaggaggatgacaaagatgcagtaggaggtggagacctagaagatgaaaatgagcttctagtgcccactgggaagcctggtctggggcccgggacaggccagcccaccagtcggtggcatgctgtccctccacagcacactctggggtcggtccccggcagcagcatcgccctcaggccccgcccaggagagccaggcagggacttggcctccagtgaaaatggcactgagtgccgcagtggctttgtgcggcataacggctcctgccggtcagtgtgcgacctcttcccaagttactgtcacaatggcggccagtgctacctggtggagaacataggggccttctgcaggtgcaacacgcaggactacatctggcacaaggggatgcgctgcgagtccatcatcaccgacttccaggtgatgtgcgtggccgtgggctcggctgccctcgtcctgctcctgctcttcatgatgacggtgttctttgccaagaagctctacctgctcaagacggagaataccaagctgcgtaggaccaacaaattccggaccccatctgagctccacaatgataacttctccctctccaccattgccgagggctctcacccaaatgatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaactttttaaaaagttaaaaaaaaaaaaaaaaaa

SEQ ID NO: 53110 - DNA, 1272 bp, Homo sapiens
ggggggctcgcgcgctgcttgcctgcctcggtctccgccgctccaggggcgggtggggtgggctgagccggagcccgggccgccgccgccgccgccggggagaggccgaacgcgcagccggcgcgggtccctgagagagcgcggccgccgggcggtcggtccccgtccgggtcgaagccaggggcgcgcggcgatgtgagccatgagcgcgacgtggacgctgtcgccggagcccctgccgccgtcgacggggcccccggtgggcgcgggcctggacgcggagcagcgcacggtgttcgccttcgtgctctgcctgctcgtggtgctggtgctgttgatggtgcgctgcgtgcgcatcctgctcgacccctacagccgcatgcccgcctcgtcctggaccgaccacaaggaggcgctcgagcgcgggcagttcgactacgcgttggtgtgaggggcgcggcgccccctaggcggccctgcgccggggtctcagagggccggcccggcggggggcgccgcggggccaggactgcgctcaggatcccgccccggagcccccagcccgggggagagggggagggagttgagagaagcccagcccctccccctcgagacccctcccatgtcccttcctggcctggccggagccccacctcgtgcctttatccgccctgtcccttcctctctgcgcatctcacccgcccggctggcccccacccccgactctgaatcccgggcgggaggaggacccccgcaccgccccctccccagcgtgtaagtggctctgctattgtgcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcaaaaaaaaaaaaaaaaaaaaaaaaaaaaaa

SEQ ID NO: 53111 - DNA, 2138 bp, Homo sapiens
atgagccccgggctgctgctgctcggcagcgccgtcctgctcgccttcggcctctgctgcaccttcgtgcaccgcgctcgcagccgctacgagcacatccccgggccgccgcggcccagtttccttctaggacacctcccctgcttttggaaaaaggatgaggttggtggccgtgtgctccaagatgtgtttttggattgggctaagaagtatggacctgttgtgcgggtcaacgtcttccacaaaacctcagtcatcgtcacgagtcctgagtcggttaagaagttcctgatgtcaaccaagtacaacaaggactccaagatgtaccgtgcgctccagactgtgtttggtgagagactcttcggccaaggcttggtgtccgaatgcaactatgagcgctggcacaagcagcggagagtcatagacctggccttcagccggagctccttggttagcttaatggaaacattcaacgagaaggctgagcagctggtggagattctagaagccaaggcagatgggcagaccccagtgtccatgcaggacatgctgacctacaccgccatggacatcctggccaaggcagcttttgggatggagaccagtatgctgctgggtgcccagaagcctctgtcccaggcagtgaaacttatgttggagggaatcactgcgtcccgcaacactctggcaaagttcctgccagggaagaggaagcagctccgggaggtccgggagagcattcgcttcctgcgccaggtgggcagggactgggtccagcgccgccgggaagccctgaagaggggcgaggaggttcctgccgacatcctcacacagattctgaaagctgaagagggagcccaggacgacgagggtctgctggacaacttcgtcaccttcttcattgctggtcacgagacctctgccaaccacttggcgttcacagtgatggagctgtctcgccagccagagatcgtggcaaggctgcaggccgaggtggatgaggtcattggttctaagaggtacctggatttcgaggacctggggagactgcagtacctgtcccaggtcctcaaagagtcgctgaggctgtacccaccagcatggggcacctttcgcctgctggaagaggagaccttgattgatggggtcagagtccccggcaacaccccgctcttgttcagcacctatgtcatggggcggatggacacatactttgaggacccgctgactttcaaccccgatcgcttcggccctggagcacccaagccacggttcacctacttccccttctccctgggccaccgctcctgcatcgggcagcagtttgctcagatggaggtgaaggtggtcatggcaaagctgctgcagaggctggagttccggctggtgcccgggcagcgcttcgggctgcaggagcaggccacactcaagccactggaccccgtgctgtgcaccctgcggccccgcggctggcagcccgcacccccaccacccccctgctgagggggcctccaggcaggacgagactcctcgggcaagggccgtgcccgcccacctctgctgcccacggccacccacccttctcccctgccccgtcccctgggccacccttcacgctggcttccagcgggccctctgccgaccgcctgcttcacacccctcagcgctccctgtcgcctgcggactccatggcccttcctggactggcccttgcccaactcccagccaccaccactgtccctaccactgagcccttgcacaggccacttgctcagacgagacaccctaactcttgctcactccctaaagccctcttcaggggtcacctcctccaagaagccctccttgccaccccccgccggcaggggcccctcctctgtgctccctcggtcacctgtgctacctctaacaccacactgaccacactgtatcgtgagtgtccgttgacgtgaccaattgccctgccaggctgtcagcgcctcaagggtagggtctgcgtgtgatttgtctctgagccccctgtgcccacccagggcccggcacagagtcgatgctcaataaatgtgtgttgactgcaaaaaaaaaaaaaaaaaaaaaaaaaaaaaaaaaaaaaaaaaaaaaaaaaaaaaaaaaaaaaa

SEQ ID NO: 53112 - DNA, 2232 bp, Homo sapiens
atggctgtctccgcatctccagtgatctctgcaacttccagcggcgccggcgtcccggggggcttattccgggccgaacccctgtactcgactcccagagagccccctcgtcttactcctaatatgatcaatagtttcgtggttaataaccacagcaacagtgccggaggcggcggcaggggcaacaccaacaccaacgagtgccgcatggtcgacatgcacgggatgaaggtggcttcgttcctgatggacggccaggaactgatctgcctgccgcaagtctttgatctttttctcaagcacctggtgggaggcttgcacactgtgtacaccaagctgaagagactggatatatcccccgtggtgtgtactgttgagcaggtccggatcctccgcgggctgggggccatccagcccggggtaaaccgctgcaaactcatcaccaggaaagacttcgaaactttgttcaccgattgcaccaatgccagaaggaagaggcaaatgacaagaaaacaagctgttaacagttcaagacccggcaggccccctaagcgttctttgggagtgttgcaggaaaatgcccgccttctgacccatgcagtcccaggcctcttatcgccaggacttatcactccgacaggtataacagctgcagcgatggctgaggcgatgaaacttcagaagatgaagcttatggctatgaacactcttcagggaaatggaagccaaaatgggaccgaatcagagcctgatgatcttaattctaacacaggtggaagtgaatcctcctgggataaagataagatgcagtctccatttgctgcacctggaccccaacatggaattgctcatgcagccctagctggccagccaggcattgggggtgctccaaccctcaatccactgcagcagaaccacctgctaaccaatagactggatctgccatttatgatgatgcctcatcccctacttccagtcagcttacctcctgcatcagttgccatggcaatgaatcagatgaaccatctcaatactattgccaacatggctgctgcagcacagattcacagtccactctccagagctggtacctctgttataaaggagcggatcccagagagtccttctcctgctccttctctagaagagaatcatcgtcctgggagccagacctcttcccacaccagcagcagtgtgtccagctctccctctcagatggatcatcatttggaaagaatggaagaggtaccagttcaaattccaataatgaagtcacccttggacaagatacagctgactcctgggcaggcattgcccgctggattccctggaccattcatttttgctgatagtctgtcctccgtggagactctgttgaccaacattcagggtctgctgaaagttgctttggataatgctcgcatccaggagaagcagattcaacaagaaaagaaggagctgcgactggagctctatagagagagagaaattagagaaaaccttgaaagacaacttgcagttgagcttcaaagcagaactactatgcaaaagcgcctgaagaaggagaaaaaaaccaagagaaaattgcaggaagccttggaatttgaatcaaagcgccgggagcaagtggagcaggcacttaagcaagccaccactagtgacagtggcctgaggatgttaaaagatactggaattccagatattgaaatagaaaacaatgggactcctcatgatagtgctgctatgcaaggaggtaactattactgtttagaaatggcacaacagttgtattcagcctgaaaggtcctcgctggctttacataaatgaagatgcttgtgattccagtttatctctgaaactattcaacatggagttatttcagttttgtttatcagcaaagctttgtttactgaaggagctatttaatctatgttacattaaaaaagaaacgcgtgtacattttaaaagcaatgatgtaaactttgttcttgcattagactgaccagtttaaaaatatgaactaaaacctaatggctaaagtaacttgaccatatttgatgcttttctatgctcatttcaacttggctttttgtcttttaaatttttaaaaaatgcagtagtgtgttagagactagaaagttatatgtatggtttccctgttctactatacataacgttaaagtacaccttctttgttaaaaatgtacttgctaaacttcagcgtaaataaa

SEQ ID NO: 53113 - DNA, 3158 bp, Homo sapiens
cctcgctcccggaccccacggctgcaaactgatctggcgcgcggggaggaggagagcgcaggcgagcgaacccgcgagagagggagagagcgagcgagcaacagcgagagcgagagcgagagagccgggaggcagagggagtagtgaccgccttccggagccgggattcatgcctgtcctcgggaccagcgaaggggactttacggctgagtatgagccaggctgctaggagccaggtacccccacgcctgcagtccccgcgccgtgcccggaatgcgagctggacgcagggctctcccaagttcccaccgagccgaataaaaagcgtccgcccgcagctctccgccaaagacggacattgactccaggactccacagaatggagcaagaatgagaggaaaaaggccggcagaaaagcatgaactggaggtttgttgagctcctctacttcctgtttatatggggccgtatctcagtgcagccctcccaccaggaaccagctgggacagaccaacatgtctccaaggaatttgattggctcatttcagacagggggcctttccaccactccaggagctacctatcctttgtggaaagacaccgtcaaggatttacaaccagatataaaatatacagggagtttgcccgttggaaggtgaggaacacagccatcgagaggagagatctggtccgccatccagtgcccctcatgccggagtttcaaaggagcatccgcctgcttggcaggagacctaccactcagcagttcatcgataccatcatcaaaaagtacggcacccacctgctcatctcagccacattgggaggggaggaggctttgaccatgtatatggacaaaagtcgcctcgacaggaagtcagggaatgccactcaaagtgttgaagctctgcaccagctcgcatcatcctactttgttgaccgtgatggtaccatgaggaggcttcatgagatccagatatcaactggagcaatcaaggtcacagagacacgcactgggcctctgggctgtaacagttatgacaatctggactctgtgagttccgtccttctgcaaagcacggagagcaaactgcaccttcaaggtcttcagataatctttcctcagtatctgcaagagaagtttgtccagtcggccttgagctatatcatgtgcaatggggagggggagtacctgtgccagaacagccagtgtcgctgccaatgtgccgaggagtttccgcagtgcaactgccccatcacggacatccagatcatggagtacacgctggccaacatggccaagtcttgggccgaagcttataaggacctggagaattcagatgagtttaaatcatttatgaagcgcctccccagcaaccacttcctgaccatcggaagcatccatcagcactggggcaatgactgggacctgcagaaccgctacaagctcctgcagagtgccacggaggcacagagacaaaagatccaacgcactgcccgcaagcttttcggcctcagtgtacgctgtcgccacaatcccaaccaccagctgcctagagagaggacaattcagcagtggcttgcaagggtccagtcactcctctactgtaatgagaatgggttttggggaaccttcctggagagccagcggagctgcgtgtgccacggcagcaccacgctgtgccagcgccccatcccctgcgtgataggcgggaacaacagctgcaccatgtgcagcctggccaacatctccctctgtggctcctgcaacaagggctacaagctgtatcgaggccgctgtgaaccacagaacgtggactcggagcggagcgagcagttcatcagctttgagactgacctggacttccaggacctggagctgaagtacctgctgcagaagatggactcacgcctctacgtccacaccaccttcatcagcaacgagatccgcctcgacaccttctttgaccctcggtggcgcaagcgcatgtccctcactctcaagagcaacaagaaccgcatggacttcatccacatggtgatcggcatgtccatgcgcatctgccagatgcgcaacagcagcctggaccccatgttctttgtctatgtcaacccctttagcgggagccattcggagggctggaacatgcccttcggggaatttggctacccacgctgggagaagatccgtctccaaaacagccagtgctacaactggactcttttgctgggcaatcggtggaaaacatttttcgagacggtccacatctacctacgtagtcggactcggctacctaccctactgcgaaatgagactggccagggccccgtggacctgtcggatccctccaagaggcagttctacatcaagatctcagacgtgcaggtgtttgggtatagcctgaggttcaacgccgacctcctgcgcagtgcagtgcagcaggtcaaccagtcctacacacagggcggccagttctattcctcttcgtcagtgatgctcctcttgttggatattcgggaccgaattaatcgcctggcccctcctgtggccccggggaaaccccagctggacttgttctcctgtatgctgaaacaccgcctgaaactgaccaacagcgagatcatcagggtgaaccacgccttggacctgtacaacacggagatcctcaaacagtcggaccagatgacagccaaactctgctaacccgggactccttgccatggacttttcctgttgttgtacacacacaacagaacaaaatgaagcaaaacaaaacaaaaaaacccacaaaaatttgtaaaatgtaattaatattcaaagaaaaggaggaaaatcttcatttgttggaaatgaaaacgttctagcaactgtataaaagcgttgggcatgtttgttatttctatactcactctgtcatgaagaagggtctcagccttttgtggagcattgagggagttgcttcttaggcctcaggtgctgtattgggggagaagggagaaagcatatgcaatgaattgtaaagatctctgctgtgcaggtgctaagattaaacactaaaaagaaagagagatatatgtaatgtacaactgacactgccatttttcctttttggaggaaatggacatagataaagaagatatttcttcggttaagattt

SEQ ID NO: 53114 - DNA, 3744 bp, Homo sapiens
ggggtggggtggggcaggatgctggatggcccactgttctccgaggggcctgacagcccccgggagctccaggatgaggagtctggcagctgcctctgggtgcagaagtccaagctattggtgatagaagtgaagactatttcctgtcattatagtcgccgcgccccttctcgacagcccatggacttccaggccagccactgggctcgcgggttccagaaccgcacgtgtgggccgcgcccgggatccccacagccgccgccccgccggccctgggcctccagggtgctgcaggaggcgaccaactggcgggcggggcccctggccgaggtccgagctcgggagcaagagaaaaggaaagcggcgtcgcaggagcgggaggccaaggagaccgagcgaaaaaggcgcaaggctggtggggcccgacggagccccccgggtcgaccccgcccggagccccgcaacgcccctcgggtggcccagctggcagggctccctgctcccttgcggccggagcgcctggcgcctgtggggcgagcgccccgtccatccgcgcagccgcagagcgacccagggtcggcgtgggcggggccctggggaggtcggcggcccgggcccccaagctacgaggctcacctgctgctgagaggttctgccgggaccgccccacgacgccgctgggaccggccgccaccctacgtggctccaccttcttacgaaggcccccataggaccttggggactaagagaggccccgggaactctcaggtgcccacttcatcagccccagctgcgactccagccaggacagacggagggcgcacaaagaagaggctggatcctcggatctaccgggacgtcctcggggcttggggtctccgacaggggcaaggtctcttggggggatccccaggctgtggagcggccagagcaaggccagagcccggcaagggggtcgtggagaaaagcctggggctggctgctgctgacctgaacagtggtagcgacagccatccccaagccaaagctacagggagcgcaggcaccgagatagctcctgcggggtctgcaactgcggctccctgtgccccgcatcccgctcccagatccaggcaccacctcaagggctcgagggaagggaaagaaggagaacagatctggtttcccaaatgctggattccctcccctaaaaagcagccgccccgccatagccagacactccccagaccctgggctcccggaggcaccggatggagagaatctctgggtcttggagagggggcaggaccggagaccctggagggttggaaggcgacccgccgtgcccacaccttgccccgcagttcccagggcctgtcccgtggggaaggcgtctttgtcattgacgccacgtgcgtagtgatacgatcccaatatgttccaaccccccgaacccagcaggtgcagcttttgccctctggggtgacacgcgtggtgggggattcccccagccaatcgaagcccggcaaggaggagggtgaaggggccacggtctttccttccccttgtcaaaagcggctgtcgagcagtcgccttttacaccagcccggcgggggccgcgggggcgaagctgagggcgggaggccgggggactccacactggaggagcgcactttccgcatcttggggctcccggcccccgaagtaaacctgcgggacgcccccacgcagccaggtagcccagagcaccaagccttaggcccagcagcttcgggagcccagggcagagccgaggggtcggaagtggcggtggtccagcggcgcgccggccggggctgggcgcggaccccagggccctacgccggggccctgcgagaagccgtgtcccgtatccgccgccacacagcccctgactcggacacggacgaagctgaggagctcagcgtccatagcggctcctctgatggaagcgacacagaagccccgggcgcctcctggcggaatgagaggaccctgcccgaggttggaaacagttcgccagaggaagatgggaagacagcggaactgagcgacagtgtcggggagatcctagatgtcataagccaaaccgaggaggtcctcttcggggtgagggacatcagagggacccaacagggaaataggaagaggcagtgagaggccccttcttgtatttgtgtccccaacgcatccatccttgggtccactggtccccattcttccccacagacttcctttgcttctcttttccttgtatctttacccatacctgttctcatccttgaaatataaatgaaaggaagggaagcatatgcccattaatgattttgtttcaggagaggtgagaatgagcagatttaattaatgtctgttatgttcagggcacaagggtgagctcttcgcaggggctgatgcactgggtgtggagctgagcagagaggcctaaccaggatcaggcaggagggcagggatggtggcagccataggagggcagggtagggtagggcctctgaggaggagggaaaaagtgaaggagaggctttggacctggtgacagagtgatcagatgacagaggggttcttgggagaagaggcataggtccagcaacaaccaacaaagcagaaggagggctcaccttggtgtcacaagtcttggatttcaatcccaactctgccactgagttgctggttgactgaggccagtcactttccctctccaggcctccaggcctcctggtatataaaatgatggtattctaaggtccatccttccgtctctgacattttgagatctttggaaaggactctatctcatcctcccctcgacaagccaagaatgagaattgggaataagtgaacagagtttgagggtttctgggcggcctccgtgtcacccaaagtcatgatcaattcaggagactgcccaaggcttgcagaagaggtaagggagtgaggcactcctatcccagtctcccaggtttggttgagggctccccaaggcagggcaagatagcggccctgtcactgaccctggcctgtggtggtctgagctggggagggaaggacaccaatgaatcagcttgggacctctttaggccttccccttttcctccaccccgatgctccttagtgatgctctgaggcgtggccacgatctccctcccaggtggtatcgcccacctgaaaaaatcctgagaatttctcccatcttggcctcttccagaaaccggccaggcaaggaaagaggccggtcaccagaagccagcaggcgtggggtgtgatactctctatagccactacagggcgcgcgcaggtcgcggatctccccagttgctaatcccggctctgccactcaatcctatccctagttcccgagcgcgggtcccccgccttgcagtctccagccgtgcggggccgggagcaggcctccggcctcccagacttctagagcccgccgggcccatctttgtactcatccaccccagccggcttgggactcagacaccgaagtctttttttttttctctccgatccttggacacctcctctgtctgccatttattagccatgtgaacttggccacatcacttcacctccctgagcctcagtttcctcatctgtcaaatgggggtttataaacacctacctcgcagggttgttgtgaggatttaatgcgataatgtatgtaaagcgccttgcacactgcctggcacacagtaggcgctcaataaatctaagcttcccttt

SEQ ID NO: 53115 - DNA, 3926 bp, Homo sapiens
atgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccgaactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgcagactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaatagaagttttaaactatgtgcctaatcaatgtgtttcccaccaaagattcagaaaacaatgcttgagagaaatgggttaatgcataattaattaagcattgtggagcaaatttagggttcctgtgattaattttgtgatgactaaaatgctggaaagcaagtgagttgcccattaattatgattaaaattctcacctttcacagacagacaataagccagacaacacaatcaaagctcaatagatgatttcttgcttttttcagtcatttataaatataggtgtaatttttcatggatcagttaagtacacttgaaggaagtaaatgattgtatcagtttatttctagtataaatgggtacctgtaataatactgagctcttggaagcgaatcatgcatgcaattagctccctcctcctcacctactccactcccatctttatgacatttcaaatgtttatttggaaacaacagcctagatcactgttgaaggtgttcatggcatagttggagtctctgactgtttaaagaaatcacagaacagtacttttcttttagtgtttcattaagcctatgatgtaaaatgaaatgcttctgagcagtcttgtaatattgttcattcatattgacctgcatctcatcattgcatgttttatgttttcaaacatgccataaggaaaacgagtgcctgaactgcatgatttattagtttctctccactctgcattaaagtgctaatgattt

SEQ ID NO: 53116 - DNA, 4107 bp, Homo sapiens
acacaccctgcgctgccctgtcctgcgcgagtggagctctgaagaagctctgagcggagttgtgttcttccccaggtgcgtcctggctgagagttggagctctccagcaacatgcctgagcagagtaacgattaccgggtggccgtgtttggggctggcggtgttggcaagagctccctggtgttgaggtttgtgaaaggcacattccgggagagctacatcccgacggtggaagacacctaccggcaagtgatcagctgtgacaagagcatatgcacattgcagatcaccgacacgacggggagccaccagttcccggccatgcagcggctgtccatctccaaagggcacgccttcatcctggtgtactccattaccagccgacagtccttggaggagctcaagcccatctacgaacaaatctgcgagatcaaaggggacgtggagagcatccccatcatgctggtggggaacaagtgtgatgagagccccagccgcgaggtgcagagcagcgaggcggaggccttggcccgcacatggaagtgtgccttcatggagacctcagccaagctcaaccataacgtgaaggagcttttccaggagctgctcaacctggagaagcgcaggaccgtgagtctccagatcgacgggaaaaagagcaagcagcagaaaaggaaagagaagctcaaaggcaagtgcgtgatcatgtgaaggcccttcctgcgggaggagcagctgtgtgtccccggcacctcactcccccaaaatgacacccaccgtcgtcagggtagcatgtataatgcccacgtgttaaacattgcatttaatcgagatgcgtcctattgtccttaagagggcgtttcacaccaccaacagtaagccacccactctggagtcacagaatctgccaggcggttcaagtgaaaaccaacacactcagcatccctgggaactgagaggtgccagcaattgctgaaggtggcgatgaacacccgaaggtgggagggaggactggtacccacaaagcaacatgtaccgagaggactaaatgtcatctacgtgcatgtgagagcgtgttaacctagagttacctgcaccaaccccagacagaagccaatcacatctttgggggaggggaggggcaggaagaggtgagaagatcagatggtccaaagtggaccacacttggtccattttacacttttttaaaggggattaaaaaacacagcctctcccccaaagggtgtccgttcttaattcccacctggcctgttaggagccttgctaccctgaggggatgtgttcaccttacctagacctagttaggaagtatcattttaagctattagagtatttatcttcatgtgcagggataagtgcactaacagtgtgctgctctgtcggaagttcttcagtttttaagtgaggatatcgtgacagtattaaaacatcgcaataatgttcctgtgtgttatacatcgagggttttagaaatgtgattttcttcttttgacctgtgaggagtataacttctttcagccctcagattttaaatacaagcaaataaactcactatttttagacgtttttttcctccaaggtggttttcttctcttaaataactcgatctgtacccagctgggtagcagccagcaaaggccatcagacaaccagaagcacatccatttttgtagtgtcacaaacatgtatatgccacactttgcaccttaatgaaatactttgaaacagaagttattcactgtgtttttgatgatctatctgtattggaaatatgttcctggaaaatgcatttaaataatagtaaattctcttgcatgttccattatacgtgtcttctaagagctgttcaatacagtattcactctagaaacaattatctttttctcttaatgattttgtgtgcatctttaatctttcaagccaaattacagctatttcaggtttcctgtgttagcttggggataggatggtggctggagacaggcaggcttctctgccctgggaagagcccactcagcttaattgctctgccatcgtagagcctggttggacttggcttcctgaaaactcccactgatagtgcctgttagatctcctgtttgtttcagttggcagaacatttactggccccaactgtggcatcatcctctcagcagtcttcctgtcacccgcctggcaggcagaaggagctgcagtcctacgtgggcctgcctgggggggtgggggctgcatggctgttgggtggcagtgtcagcacagggagggcttaagttggggatgtttgaccaggccacctcctgcaactgctgtttctcctgtccctcctatgcagggcttgcagcagcagcagtgtggccatctccatcccccaaagcacacttgctctctcaatatgtcctagttttcttcagccttttctggttcagttcccttgtcctgatctcatcctctctggtctcccaataactcacccttgggatgtgtttagagcgtgggaggtgcctttgagaactgcttgactccatgatctcctagaacaaaaccgccctgactttacagggggaacactcatgctgagctgagaaagcagagaagtggcgtgggagccagctgggggtgaagagcatttgggccagtcccgtggcccccttcagattcctcaagcaggattgttctgttctaaaaagctgttgcacagcattcgcaatgagatctttagttggcggattttctggaacatttgtttttcaacttgtcccgacattttttttctgtttctattctgagagagagatgatcaagttttaatttgggtataggttaaatggaagaagaaacagaacttcatggccaaagtagacctatagattttgattgggttctttgttaacagtagaatgcgatctttgccactgactgtagtattaataaggttttaatgtgagatattcctgcaaaccatcccatttctactgattgtaagtcagaatttcttttatccctttcaaatcagtttctacatgtttaagtgttcagggcttcatcagcatgagaagtttgtaattactgaaagtctgatttcattcaggacacattttttccttcatattttttctgtgaatttataggctaggaaggctattgaagcctcaattatgggtcttcattttgagatcgttttctatgagctgaactgaggatatcaatggttatctcaaaatcgtcttttaggagatccccaattgactcagagtttgaggagttagtatcacagaattagatttttttaaagcatttgtacgtttccattcccaaatatgtagctgtggttcttgaaaacacatcctacattgcatatgggcatagcagtttttgacccaggcagaataagttaatatttaattaaatattgctttgaagatggcgctctgggcatgagcatggggctccatgacttcccttctatccccatgagcccctcctccatccagcgacaagccatgggcatgcatacaatgcagcaagaccaacacaagagcaatattgaattgttcattctatctaaaattacatgtatataaaatatataatttatcttcctgcatttttgaagtataaagtcataaattgtacatatctgtaagctagtatatttgtttcactgtttgtaatatttaagaaatgctcattctttgtagaacaaaaatgtattaaatattttaaaaattgctctgtgatacttaatttttttccccaaaatttgtaatgtgttgcttctacataagttctctggaaatatctacaactaataggacacatgtaaatccttgaagacacatcctggaattcataccccacaaggacagtgtgtatacaaagtatttgcagagcatgacttttatatgtgtgggatatcaatgtgtatatttatatttaaagtgtatttattgttacaagtctattctctattatattttatttactctgcggttataaaaatcacccttgcatacaagtttctagttgccagtgatgttctggaaataatgggagatattacaataaagctacagttatgacaccctg

SEQ ID NO: 53117 - DNA, 5750 bp, Homo sapiens
ataaccccgcacaccgacttgcatgcaattatcatagcccgagtgctcctccgttgagagacttcgcccccgagaccgctgactgtgaatgacaaatcaaaagtcagggttgcagaatcagccggactttcctgctcatttgcagcagagggaggaagcagagaatgaaagattctgaaaataaaggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccagctacacaaagggagatttagacttcacttatgttacctccagaattattgtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtctcagaatgcagttggcccattaggcaggctcccagtctgcacaacctttttgctgtgtgtcggaatatgtataactggctactgcagaatcccaaaaatgtctgtgttgtccactgcttggatggacgggcggcatcatcaattctggttggtgctatgttcattttctgtaatctctactctactcctggcccagccattcgattgctatatgcaaagcgaccaggaattggactttcaccatcccataggagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaaagaatatcgtgtccaagatggaaaaatcttcattcccttgaacatcactgtgcaaggagacgtggttgtttccatgtatcacttgaggtcaaccattgggagccggctacaggctaaggtgaccaacacacagatattccagcttcagtttcacactggattcataccactggacacaacagttttaaagttcaccaagcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggacaggctccaatagatatccctccagacaaccccaggcattacggacaaagtggtttctttgcctctctctgttggcaagatcagaaatcggagaagtcattctgtgaggaggaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtgccacctttgacccatttggagcaccttctaaaccatcaggtcaggatttgctgggttcttttctgaacacatccagtgcttccagtgacccctttctccagccaacaagaagtccttcgcccacagtacatgcttctagtacgcctgctgtgaacattcagccagatgtttctggaggttgggactggcatgctaaaccaggaggctttggaatgggaagcaagtcagctgccaccagcccaaccggatcctcgcatggtactcccacccatcaaagcaaaccccagactctggatccttttgccgaccttgggacactaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttggaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaatatttgtataaatctaagttatttgggtacttgtaggaatacaatgaggagcttgaatgccaccttctgacatgatttacttttaaggaaagttatgaggagagaatacaaaaagcatgcaccaaaatgtaatctgacaggatttctggatttatacgtaatcactcctgccccaacacacacacacacacacacacacacacacacacacatgcacgcacacatgattttgattatgctacatgatatatgtttcaaaaagaattagcatagaaatcctggtctcctagccaaaaaaatcaaaggattttcaaaaaaacgaatctgtatgttgaggcaaaaggattgaacctggaagtctgggactttatcatagaaacaaagtctcagatattttagttctttggaaacaaatgctgtaattcaaaagcatttgacctgtcactgtactatctacatgtggaagaatgttcaagttgaatcctaatgccgtgaatgaaacacagtctgtgtagggaatgagcaaaaaagttgaattccaattgctttttggccttttggctaaaataaatgtagcatctaattttatcagttt

SEQ ID NO: 53118 - DNA, 3253 bp, Homo sapiens
gggcgcgcggctgcagcggcggagccggagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctgaggagcgtcagccatgccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaatgtc

SEQ ID NO: 53119 - DNA, 3216 bp, Homo sapiens
gggcgcgcggctgcagcggcggagccggagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaatgtc

SEQ ID NO: 53120 - DNA, 7644 bp, Homo sapiens
agagccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcagggactttctccctcgagggtcgggcattgtaacaagacgacctcttgtgctgcagcttgttacttctaaagcagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacgtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcaggtgattcgcaaggggtggctcaccatcagcaacattggcatcatgaaaggcggctcgaagggatactggttcgtccttactgcggaaagcttgtcctggtataaagatgatgaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagggaacaacaaagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacagccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaagccggagaccacccccatcaccaactcgtcccactataatccgcccactagaatcctccctgttagactaaacgaagtgtctggcatggcaattaatcactaatgaattatgcgaaagcaacatatttgataaccgttgcagtaaatcatgagtagtcgcatgtgtggacatcagtaggcaagtaaccagttttactaatgcattcatcgctcatcttcattgctcatggtatgtcaaacctttggggtttgactcagaaactgctaaccttttagaggctttatatgttgtactgaccaaggtaggtttgtatagcagccctatactttggggatcatttgcctaccatggcatatatttgaaattgctttggacaagttttctaggctatctaccaggtagctcattaaacgtaattcttcagatatgagatagtgggcttagacctaagccatacatatttcttttcccacattctgtttaggatgacagtaattctgttgtctaccattaatgctactacctactccataattgcctatttagctcctcttttcttcctttttatttcataagactgctaggaagtgattttttaaaattaggactccttaagaataaacttttccagaagcacgaggtagtttgcaaaggaaaagtctgcactgtttgctctaaagagcttctcctcattccaatgtgttttgcttcatgctagaagcatatgcaacagtgaataaaagcttctttttttgttaatcagtcaataaatttggctaattagtttcagagttcaaggaagaagcaaaatatcacatctctagaagtgttgggaaaaatataatttctttctttacttatattcacctcatggtaggttatattgaaggctgacatggagaatgtttacttttctatttggcatagctaactacactttgatactaactccagttttactattattattttggttggaaaaaaaattcactctttacgtgctaatttgtaatcttgttttgtaagaatttatcctacccttgaaacaggctcagtgtaactgtatatccattctaggctttcttaataaatcttgaggctatgggataatcacatttaaagaatggttcctgaaatgaagtcagtagaaatggcatgggataagagcagagctcacacttttacagttgcagtatttcaaagtccctatccaggtcactccagaaaagggtattgaaacgttgaaatctaaagcaaatttgcaatttcttaagatttctaaaatttaccagaacagtttagcctgggggttaatagttaagtcttgaggctaagttttggactaccaaggaccagatgattcacatgtaggaaacagccagaagccaactggaattttgtgtgctaactgttcccagacagcagagcaagtattcactgagtaggggtgtcccatgacactatttcatattctacagaagtaaatcaggtttcaccaactgaaatgtctccctttgaaagtagcaaacatgatttgtatgttaacttaactttaatttcctgtgtagtttacacccagagcagatactcataaagtataaagtaaaaacttttaaccattattaaacagagaacttgccatgttgagtgccattgtattgaacttattctaaaggcttatgctaacccatttataattggtaaaaatcagaaaatacaagatttacataaaggtcatttcaacttttaaggttaccagtgattgtataaaaacatcacaatcctaaatcctctcgtatctcaccccaaaccccaaactgggggaaaaaaagttaactctttgtgaatggaaccaatgtgcaagatacatactgcatttttaaaatagtgtctcagctaaatggaaaactgttaagcaaacatccatagtaaaacaaataatcttcagtgagatctttttataaaacttcttgtttttaggattccctttgcttcttcctttgaattctctaaaataggcagctaacggattatatacttcagggtttggctttgtgctaaatgtggttttgtgttttgctgtatttcaaaattttccttctgttaaaggaaaatattgtgaataaccactggtgtgttcttagatcagcacaaaccatgtcaaaaaaaattggagatttttttccaattttccttccactgatcttaggcagtaataaacaatggcatttgtcatctttggcacttgcttttagattatagtcccacagttgcactgccccaattgtctacctttgtgggtacatttttgttctttactcctaagttatttctcatagaacccagcctactctagaatttcagcagtgacattggagaatatttttaatttgctgcagtactatgtcatattattagtatgaatctcatttcccaaagggtttgtattctgctaaaaggagatgccaatgttgaatgaagtctgaaactctagtatgtgcatagtttgacgtgcagcatgcacaccaggccttaagatgggaatgtagcttaatgattttctgtttcccataccatttctaatcttttgtgtaattttctcttaactgattgctctgatattgtaaacacaatagatgtagctctatcatgtctagcataatttaaaaaatcagtgtttttaggatttgggaaaataaactgtaaatgtttatttgataggtaaatatagttttattgtcacatgctaaatattgcatgcatattgactaattggaataaccatttactcaattatggacagcttattgaaatagtattgatttagaaaaagtatattgcatttctaaaaaacatctaccaaggttactcgtctgaatattgcttttagccgtgttttataacatagacgagcagtagggtctgtttattagcaaatttcctatttgttccaatacaaactcactttattctaaagtatattaatgaaaccagttcctgtgatgtaactgtaagccttctcgacttagacttaaaaagtggtcacatagattaattttgtgactttttagtatagactgtagccataattctcaaatatgaaatgggacctaataccagtatgtgataaatgttgatgttttctgtgtacaaacacattttctatgcatgtgtctctgtgtatatggcatatacctagtaagtatgtttctgtaagtatgtgtattttatgtccatttgagtaggtaggtaggttttaaaaatactagttaaaatgccacaagcatgagtgtgattgtatgtgcactgtgtgtatatatataaatatatgtatatgtatggttgtaaatatctatgtatacatgtacttagtatgtgtggtatcaggatattttttaaactgtgataatacaacagatagctttgaatgatctgccataacatgtggtaacaatagttcatttctcataacatatatgaggtatacaaaattttctaactccagattgtagtcattttgagaggtacaaagctcataattaccatgacaacatggtaatgtccatagacatttgtatctgaatccacaagaagatctgaatctaagaaggaattacctttgacaatatttttcggtaagaagtaaaacctctggagacctatctttaagatctctaattggaattataaattatttttggattgctgagctgaatcttaaaaagccaagttgatatacatagtcatttttcctctatggtagaagtaaaaaaaaaaaaaaaggacatagcaacattaaagtagtggatttttctgagtaaatttgctgaaaatataagagagaagctatctaataccttggaggtaggtcatccactttttcaggtaaacatttttcatttggcaaatggcataattatttgaaagtgacaggaatctcctcagaatgaagaataaagcctaataggtctctaactgttgaactcatgaaagaagatagtgtatgagacttaagccatgagttttgtatcatttcaattagaagactactagctgtgagctcagagtttaatgtaaatgaatctagatgattttgaagaaatgattattcgttcaccagatcactcattgtacattctaaaaagctcaaatgagtcttctagatactcttactcatcctgtctggttgctatgtttaaaattatgtggtgctgtgtaggtgaaactttaagaatatttttgaagcatatgtaatatatgcactgctatttgtgtgtgtgtgtgtgtgtctttgtatatatgtaagaatgtgtgtatgtgtgagagcaagagagaggaaactcaaagaggagtgtttgtcttaagacctgttcatactggtatattggtgagacttctcacttctggttggaggtttcacatatggctcaactcaagtcattaatctctttttaatttttactcttgaattccttaaacttcgctcattatgaaatgttttaaaattatgacaaaaattactctgtctaaccacttgccttgtctgctaccagtttgttaaaaattattccccccaaccagtaattccaccagtactacttgatttgtgttatatttcctatgtacatgtacagcctttgttttgcttgcttgtctatttttactttcccttttttgggtcaaatttttcttttgctttgtttgaagaaggaatatacagaagtaaaatcttgtcttctctgctgattctttaattaatatgagccggatactttccactgtcttcttggcactttcaggatttcttaatgctgatatatggactcttagaatggaatttttgaagaaaaatctcaaagcctgtatcgttcttgaaggtcacatgtacctattgtgaaaatgtgaagctgtatttctgaagctgaaataaattataacatttgaaggaaaaaaaaaaaaaaaa

SEQ ID NO: 53121 - DNA, 8755 bp, Homo sapiens
gcggggccgcgcccggcacggccatgtggacccccacggaggaggagaaatacggcgtagtgatatgcagctttcgaggatctgtccctcaagggttggtcttagaaataggagaaacagtccagattcttgaaaaatgtgaaggttggtacagaggagtttcaacaaagaagccaaatgtgaaggggatctttcctgcaaattacattcacttgaaaaaggcaattgtcagtaatagggggcagtatgaaactgtggttccacttgaagattctattgtgactgaggttacagcaactctacaagaatgggcaagtttgtggaaacagttgtatgtgaaacacaaagtagatcttttctacaaactacgccatgtgatgaatgaacttattgacctgcgaaggcagctactgtctggtcacctgactcaggatcaggtgcgggaggttaagcggcacatcaccgtgcgcctggactggggtaatgaacatttgggcctggacctggtgcctcggaaggactttgaagtagtggactcggaccagattagtgtctcagatctctataagatgcatttatctagccggcagagtgtacagcaaagcacatcccaggtagatacaatgcgcccacgtcatggggaaacatgtcggatgccagtgccacatcacttcttcctcagcctgaagagtttcacttacaatactattggggaagataccgatgtcttcttttccttatatgacatgagggaaggcaagcagatcagtgagcggtttctggtaagactgaacaagaatggtgggccgaggaacccagagaagatagaacgaatgtgtgccctttttacagatctgagcagcaaagatatgaagagagatttgtatatcgttgcccatgtgatccgaataggccggatgctcctgaacgactcaaagaaaggtcctcctcacctgcactacaggcgaccatatggctgtgcggtcctaagcatcttggatgtcctacagtcactcacagaagtaaaggaagaaaaggattttgttcttaaggtttacacgtgcaacaacgagagtgagtggtcccagatccacgagaacatcatccgaaagtccagtgccaagtactctgcccccagcgccagccatggtcttatcatttctctgcagcttcttcgtggagacatggaacagattcggagagaaaatcccatgatatttaataggggattggcaattacaagaaaattgggatttcctgatgtcattatgccaggtgatatccgcaatgacctgtacctaaccctggagaagggggatttcgagagaggaggaaagagtgtacaaaagaatattgaagtgaccatgtatgtgctttatgcagatggagaaatcttgaaggattgcatcagcttgggttcaggagagccaaataggagttcctaccactcctttgtcctctaccacagtaatagtcctcgctggggagaaattatcaaattgcctatccccattgaccggttccggggctcccacctgcgctttgagttcagacattgttccacaaaggacaaaggggaaaagaaactctttggctttgcattctcaaccctgatgcgtgatgatggcaccaccctctcagatgatattcacgagctttatgtgtacaagtgtgatgagaatagcacgtttaataaccatgctctgtacctgggcctgccctgctgcaaagaggactacaatggctgccctaatattccttctagcctcatcttccagcgcagcaccaaagagtctttcttcatctccactcagctctcctctaccaaactcacccagaatgtggacctcctagctctgctgaagtggaaagccttccccgaccggatcatggatgtactagggcggctgcggcatgtcagtggggaggaaattgttaagtttctgcaggacatcttagatacactctttgtgattttggatgataatacagagaagtacggcctgttggtttttcagtctctggtgttcatcatcaacctgctccgagacatcaagtattttcactttcgacctgtgatggacacgtatatccagaagcactttgctggagctctggcatacaaggagctcatccgctgtttgaagtggtatatggactgctcagcagaactgattcgacaggaccacattcaagaagctatgcgggccttggagtaccttttcaagttcattgtacagtcacggatcctgtactcacgagccacttgtggaatggaagaggaacaattcagatccagtatccaagaacttttccagtccatccggtttgtgctcagtctggacagccgaaactcagaaacactcctttttactcaggctgcactcctcaattctttcccaaccatctttgatgagcttctgcaaatgttcaccgtgcaagaggtggcagagtttgtgagagggacactggggagcatgcccagcactgtgcacattgggcagtcaatggacgtggtcaagctgcagtccattgccaggacagtggatagccgcctgttttctttctcagaatcccgccgcatcctgcttcctgtggttctccatcacattcaccttcacctgaggcagcagaaagagctgctaatttgctcagggattcttggcagcatcttctccatcgtcaagaccagctctctggaggcagatgtcatggaggaagtagagatgatggtggagagcctcctggacgtgctcttgcagactctgctcaccatcatgagcaaatcgcacgctcaggaggcggtaagagggcagcggtgcccgcagtgcacagccgagatcactggcgagtatgtgtcctgccttctctcactgctccgccagatgtgtgacacccatttccagcacctcctggacaacttccagagcaaagatgaactcaaggaatttctgctgaagattttttgcgtgttccggaacctgatgaagatgagtgtcttccctcgggactggatggtaatgagactgctcacaagcaatattatagtcactactgtccagtacctgtcctctgcactgcacaagaatttcacagagactgactttgactttaaggtgtggaattcttactttagcctggcagttctattcataaatcagccaagccttcagctagaaattatcacctcagccaaaaggaagaagattctagataagtatggggacatgcgtgtaatgatggcctatgaactgttcagcatgtggcagaatttgggtgaacataagatccactttattccgggaatgattggtccttttctgggtgtgacactggtcccacagccagaagtacggaatatcatgattcccatctttcatgacatgatggactgggagcagagaaaaaatggcaacttcaaacaggtggaggccgagttgattgacaagctggacagcatggtgtcagaagggaaaggtgacgagagctacagggagctcttcagcctactaacccagctgtttgggccctaccccagcctgctggagaaggttgaacaagaaacatggcgcgagaccggcatttcctttgtgacctcagtcacccgcctcatggaacgtcttcttgactacagggactgcatgaaaggagaggaaacagagaataagaagataggctgcactgttaacctgatgaatttttacaaatctgagattaacaaggaagaaatgtatatccgctacatccataagctttgtgacatgcacttgcaggccgaaaactacacagaggccgcatttaccctgctcctttactgtgagctgctgcagtgggaggaccggccactacgggaattcctccactacccatcgcagacagagtggcagcggaaggagggactgtgccggaagatcattcactacttcaacaaaggcaagagctgggagtttgggatcccactgtgcagggagctggcgtgtcagtacgagagcctctatgattaccagagcctcagctggattcggaaaatggaggccagctactatgacaacattatggagcagcaacgcctggagcctgagttctttcgggtcggcttctatggcaggaagtttcctttctttcttcggaacaaagaatacgtgtgccgtggccatgactacgagaggctggaggccttccagcagaggatgctcagtgagtttccgcaggctgtcgccatgcagcaccccaaccatcctgatgacgccatcctacagtgcgatgcccagtacttgcagatctatgcagtgacgcccattccagattatgtggatgttctgcagatggatagggtaccagatcgagtcaagagcttctatcgcgtcaacaatgtgaggaagttccggtatgacaggccttttcacaaaggccccaaggacaaggagaatgaattcaagagcctgtggattgaacgtaccacactgaccctgacccacagcttgcctggcatctctcggtggtttgaagtggagaggagggaactggtggaggtgagccctctggagaatgccatccaagtggttgagaataagaaccaggagctacgctccctgatcagccagtatcaacacaagcaggtgcatggcaacattaacctgctaagcatgtgcctgaatggtgtcattgatgcagctgtcaatggaggcattgcacgctatcaggaggccttctttgataaagattacatcaacaagcacccaggagatgctgagaagatcacccagctcaaggagcttatgcaggagcaggttcatgtccttggagttgggctagcagttcatgagaagtttgtgcacccagaaatgcggcctctgcataagaagctaattgatcagttccagatgatgcgggccagtctctaccatgagtttccaggtttggataagctaagtcctgcatgttcaggcaccagcaccccacggggaaatgttctggcatcccatagccccatgagtccggagagcatcaagatgacccaccggcacagccccatgaacttgatgggcacaggccgccattcatcatcctctctctcctcacatgcgtctagtgaagcaggaaacatggtgatgctgggtgacggctccatgggtgatgctcctgaggacctgtaccaccacatgcagctcgcgtatcccaaccccaggtaccaaggctcagtcaccaacgtctctgttctgtcctcgtcccaggcaagcccttcttcctccagcctgagttccactcactcagcaccatcccagatgattacctctgccccttccagtgcccgaggctctccctctctgccagataagtaccgccatgcccgtgaaatgatgttgttgctgcccacataccgggaccgcccaagcagtgccatgtatccagcagccatcctggagaacggacagccgccgaatttccagcgagccctgttccagcaagtggtcggagcctgcaaaccctgcagtgatcccaatctgtctgtggctgaaaaaggtcattactccctacactttgacgccttccaccaccctctgggtgatacccccccagccctccctgcccggaccctgcgcaagtctcctctccaccctatcccagcctcccccacaagcccccagtcaggtctggacggcagcaactctacgctgtccggcagtgccagcagcggcgtgtcctccttgagtgagagtaactttgggcactcctcggaggccccacctcgcactgacaccatggactccatgccaagtcaggcctggaatgctgacgaagatcttgagccaccctacctccctgtccactacagcctctctgagtctgccgtcctggactccatcaaggcccagccatgccgaagccactcagccccagggtgcgtcatccctcaggaccccatggacccgcctgcgctgccgcccaagccctaccacccccgcctgccggccctggagcacgatgagggggtgctgctgcgtgaagagactgagaggcctcgaggcctgcaccgcaaggctccattgcctcctgggagcgctaaggaggagcaggcccgcatggcctgggagcacggccgaggggagcagtgaggggcaacgaggcggctgggatgccgccctcagtaagcagcttgccaatcactccaggtctgaaaagcaagtcccccagccccaccccagggagccagagaggcttgcactcaggagagaaccacccccaagtctccgttctactgccgtgaactcatgtgttgccatgtacagaggccacagcagcatgaagggttgtggcttccctttttatttttttacatttccatttctatgggttttcctttctttcctttatgcagtagatgctttcttcctcctgcagttctggaccatgtggagctacatggagaaattgcacagacagaatcactttgccacactgcagggcccaggagtgggagcccaggccctccctccagggtagagatgcaccgaatggaaattgcactaaggacctcttcctttgctgtatggacagaagagttcatggttgcattcagggattgcaaggaccatatagacatgtcacaggtggaaaaagggccacaagccgttttgcacaaatgcctgcccacctgcccctcttccatccaggagtgtgctactgaggggctggctggaccaacctgctggctcaggcatgtgactggcctaactgcatgcccagggcactgccagggttcaatgggccagccgtctcctactccaccttggatttttctctccatcacatcatttctgaccatttgctcccttccattcttgaaacacctcatgccccacaggagccccagtggtgactggatctgcaagggttatctcccgccctctggggtttgagtggaggtatggagccagagaggctatcctagctaccttcctcctagggggagctggtccccttcctatgtggtagagagactggtgtaagagtgtggggtgtggcaggcgccggaaatcctcaaagctttcagaagcatccagaatgcctaccatcagctcctgaatcagggattttcagcactacctctgagccatggggttggctgcccagccaggcttccaggccctgaggacatgtggtcaggttcagcaggctcctgggtaaagagggtgggagggggcttctccttttggaagcagatagccatgcaggtagaattgtcatctcccaagtggccacatacagcaacccactccaggccatggggaccaccactcagggttcggggctggcaggagggtagtttctccagtctccccagtctgttggtgtctttataggaaactataaagcagagcagtggtgtctttagaggaaactcattcaagtcagggcactgattttcctctcagtttattatttggggggatagggtcaggtgggtatagtagtactttaccagggtgcttttaagttactttaaaaaaagcctacaaaatattttttttcttttatttgctcgagttcacattaatgatggtcacaaggctgccttgttgggcaggcgtattgcccccagttcctcttctgctggcctgtatgacctccacagccaggccctgggcccaagccccttgtcccttctccactgcccctctttccagacagtaaaggccatggtcagtgtgtttttctcttgtaaacaaaccccagcttgtttaacagaaatgctaataacctactgggaaagatggaggtctaaattacctccagggtttttctgggggtttatcaccagtgtgggtcccttctgataccaccaggttcactccaggcagagtggggcggaaggctgctgaggatatgggtcagttacagcagccctcacctcaaagggctggcctgcttctcagcctacattcatttgcaagcttcaatctctggaccatctggtgttcacaggtgttagagggttaggggttaggggctagttttggatttgattcataggtaggagggcttagattttaaggcacttctgaaagtcaatccctggacaaggcagtcatcacataagaacagctaccttctccacttggtggcacaagaggtagggaggggagtatgggttcatttggcttcgcattatgcaaggtgaaaccgtttgttttccctctccattttccctaactaaatgaaaaggacacattctgaaatcccttttgttggagaataagtcagtctgaggggaaatgggaggccagagatgagaaccctttgaaaagattgtaaaatactgattttcattctttcaagcttatttgtaaatacctatttgaatgctgtgtatttgtacaggaatttgagcaaaaaatgtatagagtgtgatgtccaattggtattcagcactataaatgtgtttttaacctcccgcattctgtgcttatttaaaacaaggaaacttctaaccatttcttttgtgtattcatgtttaaagaaaaaaagtgatttaaaaatgatcttacctgtaccagaaaagcaaagttaaaggaaacaaaatttgtaccattgtcccaagaggtattttactgtatatattgtggtagcatgttcaaaatccaacaagtaatgtgaattttagatgtaaatatctgccacttgattttttttccccctttccccacttccttgactgctgtgatgtgaattaaagataaatacgtgatactga

SEQ ID NO: 53122 - DNA, 1421 bp, Homo sapiens
agcaagatggccacggtcatccccagccccctgagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgataagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacggtgccagctgggcgggtctcaccccccaggaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccatacgcctctgggcgggcatggggggtggtgggtgccagccaggggcatggacagagcctttttctaaagaaaaagacaaaaagttaaaaaaaaaa

SEQ ID NO: 53123 - DNA, 4464 bp, Homo sapiens
agttccaggctctcctgcttctccacggactctgcgggaagttagagcctctgcgtgcgctccggggcccggcgagaggatgcgcaaggtggagagccgcggggaagggggcagagaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgagctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacatagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgcaatgccactgagtgctattttgctcttttggtggagaaggcttttttcaaaactcttggtccttttacttctttctctcagtgcagaatcaattctcattttcatcgtaaaagcaaatagctggattatttcatttgccagtttctatttagtattccatgcctgcccaattcatctgttactgtttaatttcaattcttctggtgagaattagaaatgaaatattttttattcattggccaaaaagttcacagacagcagtgtttgctatttactttgaattgaaggcacaaaatgcatcaattcctgtgctgtgttgacttgcagtagtaagtaactgagagcataaaataaacctgactgtatgaagtcaatttaagtgatgagaacatttaactttggtgactaaagtcagaatatcttctcacttcacttaagggatcttccagaagatatctaaaagtctgtaataagcttagaagttcagataaatctaggcaggatactgcatttttgtggttttaaaaaagtccttaggacagactgaattatcataacttatggcatcaggaggaaactttaaaatatcaaggaatcactcagtcaccctcctgttttgttgaaggatcaaccccaaattctgggtatttgagtacatgtgaatcatggatttggtattcaactttttccctggatgctttggaatcgtgtcttccatgctccactgggttcaatttaaaataggagaggctttctcttctgaaagatccattttaggtctttttcaagaatagtgaacacattttttaacaaaataagttgtaattttaaaaggaaagttttgcctattttattaagatggaaatttctttttaggctaatttgaaatccaactgaagctttttaaccaatattttaaatttgaaccactagagttttttatgatgcaaatgattatgttgtctgaaaggtgtggttttattgaatgtctatttgagtatcatttaaaaagtatttgccttttactgtc

SEQ ID NO: 53124 - DNA, 4863 bp, Homo sapiens
ataatctggagagacagaggagttgagagtgcccctttaaactgcaggactgcaattgatctctgtatgttttctggttttcgtccctttgaaaggggaatgagagccaggatcattggctgtactgtggagctgtcacatctccatactgaaaaggtacactgcaagtgaatttaaaccgtttttggctttctattgcatattgccaagagctttgagactgatgaaccaagtaaatgctctatttagggctaagtgagatacagattcctccaatctgatagcgtttcagcctccggagtgaggaagcagcagaaacagaagcagcagaagcaacagcagtagcagcggcagcagcaacagcagcagcccctactgaagtccaatagaggagacttgatctctagttcattctggaactccgcctgggattgtgcactgtccagggtcctgaaacatgaaccaaactgccagcgtgtcccatcacatcaagtgtcaaccctcaaaaacaatcaaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgagctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacatagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgcaatgccactgagtgctattttgctcttttggtggagaaggcttttttcaaaactcttggtccttttacttctttctctcagtgcagaatcaattctcattttcatcgtaaaagcaaatagctggattatttcatttgccagtttctatttagtattccatgcctgcccaattcatctgttactgtttaatttcaattcttctggtgagaattagaaatgaaatattttttattcattggccaaaaagttcacagacagcagtgtttgctatttactttgaattgaaggcacaaaatgcatcaattcctgtgctgtgttgacttgcagtagtaagtaactgagagcataaaataaacctgactgtatgaagtcaatttaagtgatgagaacatttaactttggtgactaaagtcagaatatcttctcacttcacttaagggatcttccagaagatatctaaaagtctgtaataagcttagaagttcagataaatctaggcaggatactgcatttttgtggttttaaaaaagtccttaggacagactgaattatcataacttatggcatcaggaggaaactttaaaatatcaaggaatcactcagtcaccctcctgttttgttgaaggatcaaccccaaattctgggtatttgagtacatgtgaatcatggatttggtattcaactttttccctggatgctttggaatcgtgtcttccatgctccactgggttcaatttaaaataggagaggctttctcttctgaaagatccattttaggtctttttcaagaatagtgaacacattttttaacaaaataagttgtaattttaaaaggaaagttttgcctattttattaagatggaaatttctttttaggctaatttgaaatccaactgaagctttttaaccaatattttaaatttgaaccactagagttttttatgatgcaaatgattatgttgtctgaaaggtgtggttttattgaatgtctatttgagtatcatttaaaaagtatttgccttttactgtc

SEQ ID NO: 53125 - DNA, 915 bp, Homo sapiens
gcatcctccgcatccacatccgcatcgtcgtcctccccgaccgcgtcctgcagcagctgccagtggagccgcctgacaagggactgccatccaccatggtgaagctgggctgcagcttctctgggaagccaggtaaagaccctggggaccaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccacccagaggaagggcgcaggctgcccaccgcacggatgatcgccttcgccatggcgctactgggctgcgtgctgatcatgtacaaggccatctggtacgaccagttcacctgccccgacggcttcctgctgcggcacaagatctgcacgccgctgaccctggagatgtactacacggagatggaccccgagcgccaccgcagcatcctggcggccatcggggcctacccgctgagccgcaagcacggcacggagacgccggcggcctggggggacggctaccgcgcagccaaggaggagcgcaaggggcccacccaggctggggcggcggcggcggccaccgaaccccccgggaagccgtcggccaaggcggagaaggaggcggcgcggaaggcggccgggagcgcggcgcccccgcccgcgcagtgacgtctccagccccgcagcccggcccgggcgtcctccgccagctcctgtgaccagcgcgtctcccgatgctctccgccgtgttcgtgtccccaggcgccctcgctgcagccccgcccccgtgggtctctgactctgtcgcttttctctaagtaaagatttcacgtcc

SEQ ID NO: 53126 - DNA, 2643 bp, Homo sapiens
ggcagccgtccggggccgccactctcctcggccggtccctggctcccggaggcggccgcgcgtggatgcggcgggagctggaagcctcaagcagccggcgccgtctctgccccggggcgccctatggcttgaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtcaccttccaggacccctgggtaaaaaaaaaaaaaaa

SEQ ID NO: 53127 - DNA, 2556 bp, Homo sapiens
ggcagccgtccggggccgccactctcctcggccggtccctggctcccggaggcggccgcgcgtggatgcggcgggagctggaagcctcaagcagccggcgccgtctctgccccggggcgccctatggcttgaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaaggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtcaccttccaggacccctgggtaaaaaaaaaaaaaaa

SEQ ID NO: 53128 - DNA, 5229 bp, Homo sapiens
agcggaggctatctccagccgtggccgatggccgtgccgggggcagagcccgctcccctccgcgcgttgctacgtgcggggatgacatggatccagacgccgtcaactacgggaaggaggaggcgagagttggagcgcgtgggagcgcagaggccggaggagggaaacaccctcccggatccagagcccggcggcggcgaagcagcagctgcggccgcgcccttgccagagccggtgcgtccgcctagccccgctccgcctgaggccgtcagggctcccgaggatggaagattcccaggagacatcgccgtcctccaacaactcctcggaggagctcagctctgctctgcacctgtccaagggcatgtcgatcttcctcgacatactgaggagagcagacaaaaatgatgatggaaaattatcctttgaagaattcaaagcatattttgcagatggtgttctcagtggagaagaattacacgagcttttccataccattgatacacataatactaataatcttgacacagaagagctatgtgaatatttttctcagcacttgggcgagtatgagaatgtactagcagcacttgaagacctgaatctttccatcctgaaggcaatgggcaaaacaaagaaagactaccaagaagcctccaatttggaacaattcgtaactagatttttattgaaggaaaccctgaatcagctgcagtctctccagaattccctggaatgtgccatggaaactactgaggagcaaacccgtcaagaaaggcaagggccagccaagccagaagtcctgtcgattcaatggcctggaaaacgatcaagccgccgagtccagagacacaacagcttctccccaaacagccctcagtttaatgtcagcggtccaggcttattagaagaagacaaccagtggatgacccagataaatagactccagaaattaattgatagactggaaaagaaggatctcaaactcgaaccaccagaagaagaaattattgaagggaatactaaatctcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatatttttgtttggtatatttactaagtgcactctttcaaaacttattctataactttatcaattcatgtgaattttagctcaattttcaaagttcactaatattctcaatatttaatgctaaatgctttgctacattgtaactcacctaaaaccttttagtgacaaaatcctaatatgtggaaaaaagcatatgcataaaggaataatattgtgaaaatgaatctgttatgataaagaaaaaataaagtggaaacttttagagtattacttcatagggcagattttgtaaactgtcgtatactgtaaagggttaaatcagcgttttgtgatttttaagtaactgtgagtgaagtttattcttcaacaatgtctactccatccccaacccaactcacagccctatgactactatctttgcattagttaaaaagttagtatataggcatcaaacaaccttggctgtaacctatagaatctctatccacgtatcaggttatagactggtttttcaaaagtgaacaatcctgtgataagttggagtaccatttagtaatacagcaacattgtgtcatttattagcatcataattctttgttatgtaagttaaatatatcaagaaagaagagactgtttggaaaaatgtggttcaagttttatgctatatagttttggtatgcgatacagacagctaacttttcttatgaaaaatacatatttgcatgtaaacaatgatttcaaaatacttgaaaaataaaattttaacccaaatgaataactaagaaatataaaacaagcacaaaatcttagggaagtcataaaatagtagtgaaagtattagacagaagacatctgttttcgaatttcaacactagaatgactaaaactatctacctatagaactatctgtagatagtatactatctacactctgctcaacaagctcagaaattaaatatttttaataataaaaatctgttctggttataaaccttgctaatgaaaatacaatacatataaaaatgtatagccatgttattttctagtataaattcctttgaaactataagtctttgaggaaaattataaggtaaaattttcctgtttttccccctttgaaaaactcaggaaaaaaggaagattgaactaataaaattttatttcttaaatataaatttgacctaaaatattttctcaaactaattcatgaaacagcaacttttaccaatacctttgtatactctcagttctcattcagtataaataaaattttaaaatcctttcatagttctattagaaataagtagtaaattttgatatattgtacatacacacgtgtgtgtgtgtgtgtgtgtgtgtgtgtgtgtgtgtgtgtgtatttgtgtgcctctggtcaactctaaggatgacagacactgtgtaacaacacctgggtcaactcttttaatttatatacaaagcaaagaacaacattaatggagatgcacaatgattattcaaacaagctatatatatgtacaaaggcaaacagacacataacagtctctgcagactgattgtatatagtaagaaaagatcaaaagactttaaaacctaaatgacttttgacatacaaactcttcttgagaatgtttgttgtaaatggtttcaaaaatacaaattatagccaatcaaaacattgctttggttggtgcatttaagtatccaactcaaaaagcatatcaaatattttgggtactaggcagtttccaaagtagcatggtagtattacttgttaaaagggttctgttttcattaacagtactaagtggaagggatctgcagattccaaactggaataagctctatcatattctgaaacaagaattagaatgacttgagaacgggcaaataacaaagcaaaccaatataattatatggtcattctgaccccagctcttatacaaattatacatgtatttttgtgtatgtttgtgagagttgtatgtatgtgaatgtgtgtgagtgtgtattcacatacacatatatactggaacctatagtagaaaaggaaactagtagggccaaaaaaaaaaagaaaaagaaaaagaaaaaagaaaaaaaaagaaaaaactgggacctaagtataaatatctcatcctaaagtaaacaataagtttatagttaacgaagatttttttctatttaaaaccccattttcctaaagaacaaagtagtaaaataaaaaaaaatttaaaaaattaaaaaataaaaaaaagaggtcactaaaagaccaagatgggaaacgtaacatggaatacaagcttgaatctgggaaacaagctcaaaaaacagtgaaaaaaaaagtactggtttaggagttcaaaattcagtgaaacaaactttttgccaatagacctagggatctaagaaatagaattagggagagtttacacttacttacctatatatcagcagatttttctggaagaaaccctttttttttttttttttaaacagtaacatccagagtgacaaattgcaggagatttaatgtataaaatttctaggaattaaaagcttaaacccaaaaattgttcatccatatataagaaattatcgaattaaaacttaatgtatgtcaattattttcaaatgtctaaattcctttggaaataaaaatatcagttttactttgaaattgctcaacttctgctattcatatggtctgattagtgacataagtagcagccgtttttcaacttcagtttcattcactaccattgtttccaaattatcaatctctgctagtaattatgaatttaagaccatattattatcaaaaacctagagaccaatcatatatctgaaaagaaatacccattaaaaattctgcctcctgtttattgagaactatgcattgaacattctgaatcattctaagcctctggagagactgtaatgatccattcatgagctggtatgaaatcagtgggaagcagaacaacagaaggaactttaaaagcaacaagcaattatgtaccatatatacactgtagcaaatattttatatttgagagtctttacagcttacatttccattccattattacaagtgatgaaaaacaaaaaattgcaagtagtatgcaaattataaatatacagtcttcccacttcactaaccaaattcctactttccagtgttacttcccaatttatgcaggaaacctcctgcaaagctgaaactgattagaaaattctttatattttaaaatagctctttctcatttttagagaagtcaaatagccaaccatcaaaattaagaataaattgaattgtcacagtccattacagttattgttgctagatccacctcatttgcagatgtccaaacttaaattcatctgttcttaaaatgctacttaaaactttggttgttttcctgtaatataaaagaaaaagttaatttatcaattgattgaatacagtttttactaattagtttatcaaaccaaatactgtgaacgtaccaggtgtttacagatttaaatgcatgttaccatagaaactattaaagtaactagaactgtcaaataacaaaacggctcatgtttttaaaatatatgtaactcattttaaaatatattaaattgtattccaaacctgttcttctgtttctgtggcacctaggtttaaaatatgtattaatgtgtaaatcacaagtaaaatgaattctaatgtacaagtttgttttaaaaagtgtatgtcaagcttttatttacacaataaaatgttattaaagatggaaagtcta

SEQ ID NO: 53129 - DNA, 1636 bp, Homo sapiens
gcggcgggcgcggcgcgatgtgcgagcgggcggcgcgcctgtgcagggccggcgcgcacaggctgctccgggagccgccgcagcagggccgggcgctgggcgggctgctgcgctgggtgggcgccaggatgggcgagccccgggagtcgctggcccccgccgcccccgcggaccccggcccagcctcgccgcgcgggggcaccgccgtcatcctggacattttccgccgtgcggacaaaaatgatgatgggaagctgtccttggaggaattccagctcttctttgcagatggcgtccttaatgagaaagaactggaggatctctttcacacgattgactctgacaacaccaaccatgtggacaccaaggagctgtgtgattactttgtggaccacatgggtgactatgaggatgtcctggcctccctggagaccttgaatcactctgtcctgaaggccatgggttataccaagaaggtatatgagggtgggagcaacgtggaccagtttgtgacccgcttcctcctgaaggagacggccaatcagatccagtcgctgctgagctcagtggagagtgcggtggaggccatcgaggaacagaccagccagctccgacagaaccacatcaaacccagccacagcgcggcacagacctggtgtggaagccccactcccgcctctgcccccaaccacaagctcatggctatggaacaaggcaagacccttccatctgccacggaggatgcaaaggaagagggtctggaagcccagatcagccgcttggcagagctgattgggaggctggagagcaaagcactgtggttcgacctgcagcagcgcctgtcagatgaagatggcaccaacatgcacctgcagctggtccggcaggagatggccgtgtgccccgagcaactgagcgagtttctggactctctgcgccagtatctgcgggggaccactggcgtgaggaactgcttccacatcactgccgtgaggctctcagatggcttcacctttgtcatctatgagttctgggagacagaggaggcgtggaagaggcacctgcagagccccctgtgtaaggcgttccggcacgtcaaggtggacacactgagccagcctgaggccctctccaggatcttggtgccagctgcttggtgcacggtgggacgggactgacagcctcccagaggcccgtggaggagcccaccagccccttcttcttgtgaaggaaatcccgtttttttctagacagacactttggtgcagaagcttcttttcaatccatcctccacaagaaggtgtttccctgttgttaagtgaaggaggccgcccctgcccccacctgagaaggcagagcagtgtctgtgctgccaggtcctggtgaagcccaaggttgaagggggcggcttcctggagccagcacccctgcctcctggtcctggcctctcccctacccctcacatggccacgcatgacccacactgaccacaccctgccctcttcggtgacattcttctacctagtaggagtcatgcccctgtagtgcccaacctagccaggtagccaccactgtgcccaggcgccaaataaaccctggttgggaaaaaaaaaaaaaaaaaaaaaaaaaaaaaaaa

SEQ ID NO: 53130 - DNA, 4682 bp, Homo sapiens
ggacttgaacacacgggaccggacaggaccgaccgaggggcggcggcgaaaggcagagcgccgcgatctctgtcgggaagcgcaacctccccgggccccgcggggccgcgcagggggcgtcctcaaccccgcgcccgctccctctttccatcccctgccgcccgcaggccaccccggggcccggccatccgcgcgcgcatccccgggttcgggcccgtccctggccctcgagggagccgccgccttcatcgccacatctgcagcggccgcaccagaggccgcccgggcgggaccccagcgtgagcatcgggcgcccccctaggagtgcaccacccccggagcccccctcaacacggaccgcgcccgccgggcacacaagaatggtcactcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagggcagagccttggctacgggtttgtgaactattctgaccccaatgatgcagacaaagccatcaacaccctcaacggcctcaaattacagacgaagaccatcaaggtgtcctatgccagacccagttcagcatccatccgggatgctaacctgtacgtcagcgggctccccaagaccatgagccagaaagagatggagcagctcttctcccagtacggccgcatcatcacgtcccgcatcctggtggaccaggtcacaggtgtctctcggggtgtgggattcatccgctttgacaagaggattgaggccgaagaggctatcaaaggactgaatgggcagaagccgctgggcgcagctgagcccatcacagtcaagttcgcgaacaacccaagtcagaagacggggcaggcgctgctcacccacctctaccagtcatccgcccggcgctacgcaggccccctacaccatcagacccagcgtttccggctggacaatttgctcaacatggcctacggcgtcaagagtcccctgtcgctcatcgccaggttctcgccgatcgccatcgatggtatgagcggcctggcgggcgtgggcctgtcggggggcgcggcgggcgccggctggtgcatcttcgtgtacaacctgtcaccggaggcagacgagagcgtgctgtggcagctgttcgggccttttggggcagtcaccaacgtcaaggtcatccgtgatttcaccaccaacaagtgcaagggtttcggcttcgtgaccatgaccaactatgacgaggcggccatggccatcgccagcctgaacggctatcgcctgggcgagcgcgtgctgcaggtctccttcaagaccagcaaacagcacaaggcgtgagcccaccccgcctgccctcccaccccctccccgggcagcagagagagagagagagaaagagagagagagagagagaaggggcccaagagagacagcacaggcagccccacggacgacgcgagggccccacgtccctgcggaagccacagggtgagcactctggggtgggagggtctgcagggaattgggggggtgcccggggatcccccgccccatcctcctgcccccaccccaggctgggctgttcactctctcgtcttggtttggttcatggtgaaggtttttgtttcttttttcggctaaaaagaatgcagagatgtgcccccacccccaccctcgaccacccccgatgggatggcttggggggctccagggggtgccctcccagacccccttgcccaggcctccccagcacctaggtggggcctggggtaggaggaacaggtttaaaaatccccaaaaaagcgaaccgtgaggaggggtgtgggcacccccggcccagtgccccctggtggaatgcgggggagcaggcagtggggctggaagcagaaacaaaatgaaaaaaaaaggggggtgggaggggaagaaaaactctatttttgtaaaaagggaaaaagacctcgtggagaatttttactggggattcttgaacttgaaaaaaaaaaacacaaaaaaagacaaaaaaaaaaaaagaaaatattttggcaggttatgtttaccaactggggcgggggtggggggggcccagggagcagggcttaggggctagcagcccacggggccacacagagaaacaaccacgcagacagtcacaccacggggacacacggacagacgcagacggacacagcgacatgccccagacacgttaagggactggttggccaaactcagacacgtggacagggatagacagaaagagacagaagctggggctacgtccatgtggacacagaccacagatgtgggcacacgaatccatccacctgtccacgtgcacacgtgaatgtagcgatagatatttggacatcaaatttggacaccaggtcacggagaaacacaaacaccacccaggaacacgcagacatatgcccatagcatcccacaggcccaggcaggaggtcccaccccagaccctgccccagacgctccctcaccctctcggccccctcgccctggcccccaggttctctgcagagatctctcctggacccccagcggtctccttggcgcccacgaacacaggcgtgcacacgcagcgcacatgcattgagacacacgatacctcgttccaccttggcgtcacggtgggctggaggcagcccccccccccacaacacttgaggccaaaggacacccctgtccccggggctcagcctccccctgggccgaggccttggcccacacagctgagggagaggcccagccctgagcctcccccaccaggactgggcctccccggcagcaagaccccggcactccccgccaggcccagggtggggtggatgggcccaaaggcccagccccacactcctttcccgtccacttgtcacctacctatcccctttcggtttgttgggtttttcgtctttccagattgcagtggacacagcccccgatctcgagccccggcccccggcttctgtctggacattgcatcgccctagttttctttctttaaaaaaaaaaaattccaacagaagccacaggccggagcccctgggagccctcgcaccgctccccaccccactcagcggccccatcggaactgagaattgcaaaacccccgactttagctatagttaagttgccttcccccggtgtccccacgtttggtgtctggctatggcgcccccatctgactgtccagctctctctcccccacccctcccggtgttgttattaaacgtctgtggagcttctgctgcaaggaacaaaaaagaaaaaaatcaaaaaagcgacaaaaaaacacaaacagaagaggaaaaaaaagcaacaaaaaaagaaaacacacagaagagatttaaaaaaaaaaaaggaaaaaaaaaaaagacataaactggcaccagttaactttcttgtacttttttgctgaatttagcttcttgtagttttaacttattgctatgttaactatttattctcctcgttgccctgtaaggacatccgtgtatatttctgttacttcatccggtttgcaagttaaaggaacgacaatgttctctttgtttctttaagttttgccgagacatggttatgcctaatttatttataaaaggggaagtggaatcattaaagtaataataattattaataacagtaatggtagccgagtggcacgcgggggcgtgtgctctgcgggacagtccccacggccagcgacgtccaggtcaccaatgggattctttttgctcttgtcttgagaattttttcagtcctatttagctggtgaaatccctagcttgttcttgatacacgaacctatttattctcgtggttttaagtcctccctgccctctctcctctcccctgcagcagggcagggacccctctcccctgctgtctcttggggctctctcccctccgccctctgcattcgggaacacgcacgtccgcgtgggaagcttgcagcagggcgtccgagcaataagggctgggtttgtcccccaccctggggggggccaggctccagagagggggcacctccccacacaccccccccccaccgaggcctaggcccctgccacccccaagactgggaggggacttctttttctaaaacacaaaactcagcccagccaggccccctccctggaggccagcccctccccgcagggggccaggccggggctcccaggcgagggggacttggggcttccacgtccctggggggcaggggccaggccaggggggagggggctcagcccctccacccctcccttcatcctgttatttattcggaaggtttcaaatcacgacagagtccatgttggaggtgataaaaaactgtaaaaaaaaaaaaaaaaaaaaagacaaaacaaaagacaaaaaaaaaaaaaaaacccaacaagaacacttcgcgttgcgtttagactatttattaccgggatcacaggcctggccgcggtaacagacttttacatggaattgtttaattatttgtacttttcatgccagaaaataaaagttcagaatctt

SEQ ID NO: 53131 - DNA, 4661 bp, Homo sapiens
ggacttgaacacacgggaccggacaggaccgaccgaggggcggcggcgaaaggcagagcgccgcgatctctgtcgggaagcgcaacctccccgggccccgcggggccgcgcagggggcgtcctcaaccccgcgcccgctccctctttccatcccctgccgcccgcaggccaccccggggcccggccatccgcgcgcgcatccccgggttcgggcccgtccctggccctcgagggagccgccgccttcatcgccacatctgcagcggccgcaccagaggccgcccgggcgggaccccagcgtgagcatcgggcgcccccctaggagtgcaccacccccggagcccccctcaacacggaccgcgcccgccgggcacacaagaatggtcactcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagggcagagccttggctacgggtttgtgaactattctgaccccaatgatgcagacaaagccatcaacaccctcaacggcctcaaattacagacgaagaccatcaaggtgtcctatgccagacccagttcagcatccatccgggatgctaacctgtacgtcagcgggctccccaagaccatgagccagaaagagatggagcagctcttctcccagtacggccgcatcatcacgtcccgcatcctggtggaccaggtcacaggtgtctctcggggtgtgggattcatccgctttgacaagaggattgaggccgaagaggctatcaaaggactgaatgggcagaagccgctgggcgcagctgagcccatcacagtcaagttcgcgaacaacccaagtcagaagacggggcaggcgctgctcacccacctctaccagtcatccgcccggcgctacgcaggccccctacaccatcagacccagcgtttccggctggacaatttgctcaacatggcctacggcgtcaagaggttctcgccgatcgccatcgatggtatgagcggcctggcgggcgtgggcctgtcggggggcgcggcgggcgccggctggtgcatcttcgtgtacaacctgtcaccggaggcagacgagagcgtgctgtggcagctgttcgggccttttggggcagtcaccaacgtcaaggtcatccgtgatttcaccaccaacaagtgcaagggtttcggcttcgtgaccatgaccaactatgacgaggcggccatggccatcgccagcctgaacggctatcgcctgggcgagcgcgtgctgcaggtctccttcaagaccagcaaacagcacaaggcgtgagcccaccccgcctgccctcccaccccctccccgggcagcagagagagagagagagaaagagagagagagagagagaaggggcccaagagagacagcacaggcagccccacggacgacgcgagggccccacgtccctgcggaagccacagggtgagcactctggggtgggagggtctgcagggaattgggggggtgcccggggatcccccgccccatcctcctgcccccaccccaggctgggctgttcactctctcgtcttggtttggttcatggtgaaggtttttgtttcttttttcggctaaaaagaatgcagagatgtgcccccacccccaccctcgaccacccccgatgggatggcttggggggctccagggggtgccctcccagacccccttgcccaggcctccccagcacctaggtggggcctggggtaggaggaacaggtttaaaaatccccaaaaaagcgaaccgtgaggaggggtgtgggcacccccggcccagtgccccctggtggaatgcgggggagcaggcagtggggctggaagcagaaacaaaatgaaaaaaaaaggggggtgggaggggaagaaaaactctatttttgtaaaaagggaaaaagacctcgtggagaatttttactggggattcttgaacttgaaaaaaaaaaacacaaaaaaagacaaaaaaaaaaaaagaaaatattttggcaggttatgtttaccaactggggcgggggtggggggggcccagggagcagggcttaggggctagcagcccacggggccacacagagaaacaaccacgcagacagtcacaccacggggacacacggacagacgcagacggacacagcgacatgccccagacacgttaagggactggttggccaaactcagacacgtggacagggatagacagaaagagacagaagctggggctacgtccatgtggacacagaccacagatgtgggcacacgaatccatccacctgtccacgtgcacacgtgaatgtagcgatagatatttggacatcaaatttggacaccaggtcacggagaaacacaaacaccacccaggaacacgcagacatatgcccatagcatcccacaggcccaggcaggaggtcccaccccagaccctgccccagacgctccctcaccctctcggccccctcgccctggcccccaggttctctgcagagatctctcctggacccccagcggtctccttggcgcccacgaacacaggcgtgcacacgcagcgcacatgcattgagacacacgatacctcgttccaccttggcgtcacggtgggctggaggcagcccccccccccacaacacttgaggccaaaggacacccctgtccccggggctcagcctccccctgggccgaggccttggcccacacagctgagggagaggcccagccctgagcctcccccaccaggactgggcctccccggcagcaagaccccggcactccccgccaggcccagggtggggtggatgggcccaaaggcccagccccacactcctttcccgtccacttgtcacctacctatcccctttcggtttgttgggtttttcgtctttccagattgcagtggacacagcccccgatctcgagccccggcccccggcttctgtctggacattgcatcgccctagttttctttctttaaaaaaaaaaaattccaacagaagccacaggccggagcccctgggagccctcgcaccgctccccaccccactcagcggccccatcggaactgagaattgcaaaacccccgactttagctatagttaagttgccttcccccggtgtccccacgtttggtgtctggctatggcgcccccatctgactgtccagctctctctcccccacccctcccggtgttgttattaaacgtctgtggagcttctgctgcaaggaacaaaaaagaaaaaaatcaaaaaagcgacaaaaaaacacaaacagaagaggaaaaaaaagcaacaaaaaaagaaaacacacagaagagatttaaaaaaaaaaaaggaaaaaaaaaaaagacataaactggcaccagttaactttcttgtacttttttgctgaatttagcttcttgtagttttaacttattgctatgttaactatttattctcctcgttgccctgtaaggacatccgtgtatatttctgttacttcatccggtttgcaagttaaaggaacgacaatgttctctttgtttctttaagttttgccgagacatggttatgcctaatttatttataaaaggggaagtggaatcattaaagtaataataattattaataacagtaatggtagccgagtggcacgcgggggcgtgtgctctgcgggacagtccccacggccagcgacgtccaggtcaccaatgggattctttttgctcttgtcttgagaattttttcagtcctatttagctggtgaaatccctagcttgttcttgatacacgaacctatttattctcgtggttttaagtcctccctgccctctctcctctcccctgcagcagggcagggacccctctcccctgctgtctcttggggctctctcccctccgccctctgcattcgggaacacgcacgtccgcgtgggaagcttgcagcagggcgtccgagcaataagggctgggtttgtcccccaccctggggggggccaggctccagagagggggcacctccccacacaccccccccccaccgaggcctaggcccctgccacccccaagactgggaggggacttctttttctaaaacacaaaactcagcccagccaggccccctccctggaggccagcccctccccgcagggggccaggccggggctcccaggcgagggggacttggggcttccacgtccctggggggcaggggccaggccaggggggagggggctcagcccctccacccctcccttcatcctgttatttattcggaaggtttcaaatcacgacagagtccatgttggaggtgataaaaaactgtaaaaaaaaaaaaaaaaaaaaagacaaaacaaaagacaaaaaaaaaaaaaaaacccaacaagaacacttcgcgttgcgtttagactatttattaccgggatcacaggcctggccgcggtaacagacttttacatggaattgtttaattatttgtacttttcatgccagaaaataaaagttcagaatctt

SEQ ID NO: 53132 - DNA, 4827 bp, Homo sapiens
gcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgagtggaagcaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcgaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaagtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggctggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcatgtatcacagatgtaaattaactcaccagatttactgggcctgaactcattctcttcttgctatatgatttagcaagttctagaaggtctccaagacaataattacattggcacaatgtatacttcagtgctcacccgtagcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcaaataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacatataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttcaaaaaaaaaaaaaaaaaaaaaaaaaaaaaaaaaaaaaaaaaaa

SEQ ID NO: 53133 - DNA, 4703 bp, Homo sapiens
cgccgatggtacgcgccggctcgcctggcccggctgcagtggatgttgctagaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaacccagcctgtggccaggtcactgtctaccccagcccagcccagccctctgccgcttgtacatacgccatggggaccctgaggaactgaggccacgtcaatccctgtgccgccccattcgcccgttacatcttccaaactgggacggtcaaggctgaaggctcctctgggtttgagggtccaagggacaaggaggagaagcctagcaggatttcagatgcaggagagagacccaggaagcccggcagagccctgagccccactgcaattcctcctagggctgcacaatcatgtggccttagggcacactgtcctgcatccagtctgtgtcctcctgtctttctcatccaggtcaggcattgacactttgtaagaaagggggtaggggacacagctgggcaggtggagtgggtgggcaggatggctgtcccagtctgcccatcttctcttggctctgggaccagcggcttgttctagggatttggacctggaggccaagggcaataggagagggtctgaagcctgtgctgtctgctgcttgctgtgaatggccctcccgggtcatgacagagctcttttggggcaggaggtgagggcagggggccccgctccttggtaagggcctgccctggggctcccagggaagtgggagctggggagccaatccacccagacccgcgtccacctgggaggcatttggggttgcaggaccgagacccacatcctctcactcacttctccacccgccaggcagctgccacaggcctaaggctgagtgaggtgtgattgggccctccggctggatgttctgggggaggaggcaatcgctgtagctgccaggccagccccatctggaaggagtccctgctctgcctcagccctaacccgaggctgtgtgggagtcccttctgcacctcttatttcctaaacccttcctgtcagctgctgtttgctggctcgtccccagccaggcctcctgaggtcttcatagttggcacagtccacatctcttctagcttcactggccactcactcagcccagagtccctaagtgctcccccacttatctctgcatctctccaatttggaagccatccagctgatgctaacagccagggccagtccctccagctggtcccatgtaatgaggccagggctccttatcagcttccaggcggctgggatctcaggcagggtgtgcgtcagccctccaacccccagaggggcgcctgtggggagggaaccaggaggccacactgggggagcgtgcagccagcatgtgcagtggccaactccaggccagtggaaagttactgtgtggatacaggaaggctctgagtggctagcaggaccctcccttggcttcgccctcctcctcttctctctcccctgtgctgggagctccgtctgccttgggaagggagacgaggtgtgctgttccttcccagccccatccctccccacccttcctactcccagctttcaagaaacattgcagaagcatttgaagttttgttccatcttggatatttgaagagaaaaggagccaagaactggcgggtggtgtgtgtgcagcaaaggcattgggggcacgggtgagatgcccactgtgtgctggtctaaattaatccatcgcagtgatcctccagagacagcgctctgctcatgtccgtagcagagggaaaagccgaggtgctcagaaaggctcggtaatgagtcccaggtcatacggctagcgagtggcgggcctggggttcagacccacagctgcctcaagcaaacagggtatcacgcttgcccctgggcctgggtgggggccggaatgagaccacatgagagcgcagagaggtgggtggtcaggccctgatgtcctggggatttcttgtcctcagtgccacccggcctcccgtctttcctgaaacccctcgccagattttgcactctgaggtttctatcttccagacaagagctgggaggcaagatttctggtttctggttcctagcctcactgccagcgggctcctgctattaggtgagggtttcttgctgtctggaattcagtttttccatctgccacatggaagttcatagccaggatagggcgggagaggcaccagaacatttctctccactgactttctcacccggttcccaccctcctccacctcctctcctccgggcccctcagtttcctctcctcatctctggcctcagttccagagggttagccccagcaccccactctcctgccactgtcagatagccttggtcatgcttcctagaatctacttgtccaagttctcctctccctgggataagttactgcagaaactggggatttagaagcttattcagggctgagtgccaaaagcttgggggaggagggacaggtcctcggcaataaacagtgtcacacacgcatcacagccatttgagaaatggcttctttgcagagctggggaagccgggcagaagatgccgcagcctcctactctgggtcctgagggggggtggcaggtaccacagtgtaggcagcagggtcagggccaaagtctatgcgttccatctccaatccaggcagtgaggaatcctgaaacaccaggagaggcgtcagaagtaggaagggcaggggaacaggaatgcaagattaaggaaaccgcagctgagcaggtgtcacaagctgtaaaggaggaagggagtctgcaggcccttcacatttttggcctgggtggggctgggcccaggaaggggtgggctggattttgtaaagctggaggcagccaggaatctgactgtccggaatgtgagttgaggggtctcccactgaagtcctcttctggaagctgcagatgggggcccgggaggcacacacgagtctgggactcattcccgggcacacctatggctccttcggtatcacctggggaagccccggaatcttagttcttccattccctactcttccttccgagggagtcaggatgggacagacacccattttccaaaaggctccttgcctccttccctggcccacctgaagccaagtcccaggtgtcctggctgctctcctgggcggggtgggatttttgcataagcactttgctgccctccagtggctgcttgaggaaacgcagggcctggtttgggagagtcaccgagggcccatgtggctggaggttgggggcaggatctggcccgagctctcctcagacctccccagacctgtcttctcatcagccaccgctgttttcttttgccgaacgatggttgcatctctcggacacagtgtaccccctcccaagccctccctgagccgttctcctgagtccctgagggcagacacagctccagggacccaggccagctgccacacccccgacactcctgctgtccactggccttagctcctgcaagttccccagtgtccgcacctgttcccttccctgacctcaccttcctggggtctgtgactgactggagataaaaataaaagcaattgtgacacctg

SEQ ID NO: 53134 - DNA, 3575 bp, Homo sapiens
aggcatcgaactgcggtagtacgggttacggaatcactgtcgatgccctagctggatcaatgtttcgatctgatacgccagcttggcacgaggctgcctcaggaagcttggcttccctcccatgggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccagaggtttaagaaccgccctctagaggcagccctccttgctagtctgggacttcccggtggagtgaggaacccagcaacacgctcctgacttcccttcccaaggactcgacctgagaaggacacagcagtctctgaatttcatgctctcctctttgatgtgaagaaaatgaaaagctgaacagttgtggaactgtggatagagttagacaataaggccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcaacagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcaggtggccttgttgctggcatcccggccaggtgggcggggattaacaaagacagctgtttagggtcttctcccttaacccatgctttcataaaccccttcggacagcttccccgtccaggctttctaaccacacctacccagggtgccgcattcctgcactcagaagtctgcagggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaaaaaaaaaaaaaaaaaaaaa

SEQ ID NO: 53135 - DNA, 3073 bp, Homo sapiens
gtgcagacagcagcccaaggtagagcgagcgtgccgggcgagcccggagacttgccttgcaatgccatgtttgtgtatgtgctctaactcccggagagcaatcagggagacggctccccggccagacttggctgatgttttcttgtttctgtttcagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccgggtaactaagcaagacaagaacctcataaagccgctttatgaccgatacagaattatcaagcaaatcttgtcaacaccttcccttattccaacaattcaggaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaagtttattttcctctgccatccttgctaagtagttttgacacaatgaaaatggaagcactttagtggtagtattagctgtttttaagaaggaatagcaagtttaattatatacaaggagaagggatttaaacggggggaagaatacaacaggtagccatataattgggaaaaaattcagtgtcctccatgccaagcagaaaactcatagtcaatacaagtatttttaaaaatgtctaatattttatcaaatctaaataacatagctaggacacttgttagggaaagtttatttagtatccaaagactgtttatgttgatgtatggaaaagagcatgattttaaaaaatcaatcataggaggaaaagaaattcgcttttcaagtaggaaggaatacagctagcaagaaagcaatttatttgaaacttctaatggatttttgagtgataaaacatttactaccttgtcctttaagtctgctaggctctcagtaccctaaaataaactagattgtgttgctattttttttctttctctataaaaataacacattattttatccgttatttgaaattttacatttctggttaccaaagttcattctgatagcatgtactttgtgaattattatctttgtctataactgacagatgtttatattaaaataaaatattgtattaaaaatttaaaataggtattttggatagatatgtgtctgtagtatataatctaatgtgtccatagtattattgctaatcttttggtttactataagatgatataactattttttcattgggaatatacatttttcttaatgttccaacatctatactttgtaaagtcaaaacatttcccatgagctgtagttattcatccttctgtacaaaatgaaaagtttggaaattgtttgccctgataccttgaaaaagaagccagaatatttatttgcttcatcaacttcagtgtatatcattttgtgttattttatacgaaaacatgtttattattttcatttttgtaaaaggaagtaaaaggtcaacattttctctcatgtaccaaccttgtttgtatttctattttctgtaatgtttaagtatgatgttgaagaaattcacattctcttatagtttggatgggaagactattgactatttcagaaacagacttatttcagaggcttattgttttctctgtatttacctaatattttataacttttatgaatcagaataatgtccttcataaatttgtttaattgaagtcatctacttctaacaggacagatacacaactatttgaggtttacaaattacatctttgataagggaaatggtttcgtgacatgtacacagttgctattaaaatgtaactctatatattctaaaaaaaaaaaaaaaaaaaaaaaaaaaaaaaaaaaaaaaaaaaaaaa

SEQ ID NO: 53136 - DNA, 3379 bp, Homo sapiens
gtgcagacagcagcccaaggtagagcgagcgtgccgggcgagcccggagacttgccttgcaatgccatgtttgtgtatgtgctctaactcccggagagcaatcagggagacggctccccggccagacttggctgatgttttcttgtttctgtttcagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggacccggcgccagcatcaacccagagcgtgcttgccgatgggacagattctgcagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcggaaatttgaagaaaaatttgaacaagaaaagaaataccggccttcacatggtgacaagacttctaatcctgaagtcctgaaatggatgaatgatttggctaaaggtcgtaaacagctcaaagaactaaagctaaagctgtcagaagaacaagggagtgctcccaaaggtccacctagaaacctgttgtgtgagcaacccacagtccccagagaaaatgggaaaccggaagctgcgggcccggagccaagctcctctggagaagagactccagatgctgccttgacatgcctgaaggagagaagagagcaacttcctccccaggaggattctaaggtaactaagcaagacaagaacctcataaagccgctttatgaccgatacagaattatcaagcaaatcttgtcaacaccttcccttattccaacaattcaggaggaagaggactctgatgaagaccgtccacagggaagccaacaaccttctttggcagatccagcatctcaccttcctgttggtgaccacctcacctactctaatgagactgagcctgttagggcccttttaccagatgaaaagaaagaagtaaaaccaccagctctctccatgtctaatttacatgaggctaccatgcctgtacttcttgaccatctccgagaaactagggctgacaagaagagactgcggaaagccttaagagaatttgaagaacagttttttaaacaaacaggaagaagtccacaaaaggaagataggataccaatggcagatgagtattatgaatataagcacataaaagccaaactgagactattagaggtcctcatcagcaagcaagatgtggccaaaactatttgaggttcaggaaatgttatgatcactttcacccatgatataaagtaaagtttattttcctctgccatccttgctaagtagttttgacacaatgaaaatggaagcactttagtggtagtattagctgtttttaagaaggaatagcaagtttaattatatacaaggagaagggatttaaacggggggaagaatacaacaggtagccatataattgggaaaaaattcagtgtcctccatgccaagcagaaaactcatagtcaatacaagtatttttaaaaatgtctaatattttatcaaatctaaataacatagctaggacacttgttagggaaagtttatttagtatccaaagactgtttatgttgatgtatggaaaagagcatgattttaaaaaatcaatcataggaggaaaagaaattcgcttttcaagtaggaaggaatacagctagcaagaaagcaatttatttgaaacttctaatggatttttgagtgataaaacatttactaccttgtcctttaagtctgctaggctctcagtaccctaaaataaactagattgtgttgctattttttttctttctctataaaaataacacattattttatccgttatttgaaattttacatttctggttaccaaagttcattctgatagcatgtactttgtgaattattatctttgtctataactgacagatgtttatattaaaataaaatattgtattaaaaatttaaaataggtattttggatagatatgtgtctgtagtatataatctaatgtgtccatagtattattgctaatcttttggtttactataagatgatataactattttttcattgggaatatacatttttcttaatgttccaacatctatactttgtaaagtcaaaacatttcccatgagctgtagttattcatccttctgtacaaaatgaaaagtttggaaattgtttgccctgataccttgaaaaagaagccagaatatttatttgcttcatcaacttcagtgtatatcattttgtgttattttatacgaaaacatgtttattattttcatttttgtaaaaggaagtaaaaggtcaacattttctctcatgtaccaaccttgtttgtatttctattttctgtaatgtttaagtatgatgttgaagaaattcacattctcttatagtttggatgggaagactattgactatttcagaaacagacttatttcagaggcttattgttttctctgtatttacctaatattttataacttttatgaatcagaataatgtccttcataaatttgtttaattgaagtcatctacttctaacaggacagatacacaactatttgaggtttacaaattacatctttgataagggaaatggtttcgtgacatgtacacagttgctattaaaatgtaactctatatattctatatgattgtaaatattttatacaacaatacaaataaaatatttttctattataaaaaa

SEQ ID NO: 53137 - DNA, 3668 bp, Homo sapiens
gctaacggcatcgagtctggacgccccgtgacccgcctgggccggagcgagggcggacggcgccttcttggccctttctgcctctagcagcggcgccggggtagccggagccagcgactgggaaacggctgcattccactgcgtctccttggcctggctgggcggtcggaggctggtctgccaagattactgtttggagaccgctgcagcccacgtccacctgatagactatttactacacatagtagattcagagccgctaaatgtccaagaccatggcgatgaaccttctggaggattggtgcaggggaatggaagtggacatccacaggtccttgttggtcacaggcatcccagaggactgtgggcaggcagaaattgaggagaccttgaatggggtcctctccccactgggcccgtaccgcgtgctcaacaagatttttgtgagggaagagaatgttaaagctgccctcattgaggttggtgaaggtgtgaatctgagcaccatcccccgtgaattcccaggaaggggtggtgtctggagagtggtctgtagagaccctacccaggatgccgagtttttaaaaaatctgaatgaattcctggatgccgaggggcgcacctgggaggatgtggtccgcctgctccagctcaaccaccccaccctgtcccagaaccagcatcagcccccagagaactgggcagaagctctgggggtgcttctgggagcagtggtgcagatcatcttctgcatggatgccgagatccgcagccgggaggaagccagggcccaggaggccgctgaattcgaggagatggcagcctgggctttagcagcagggaggaaggtgaagaaagaaccggggcttgcagcagaggtgggttctgccttaaaggcagagacccccaacaactggaatgccacggaagaccagcatgagcctaccaaacctttggttcgcagggctggagctaagtctcgctccaggagaaagaagcagaagaagaactccaggcaggaagcagtgccctggaaaaaacccaaaggcatcaattccaacagcacagctaacttggaggatcctgaggtgggtgatgctgaaagcatggcgatctcagagccgatcaagggcagcagaaagccctgtgtgaataaggaggagttggctttgaagaagcccatggcgaaatgtgcctggaagggtcccagagagccacctcaggatgcccgggcagaagccgagagcccaggaggcgcctctgagtcagaccaagatggtggccatgaaagcccaccaaagaagaaggccgtggcctgggtgtctgccaagaaccccgctcccatgaggaagaagaagaaggtgagcttgggccctgtctcctacgtcttggttgactcagaagatggcaggaagaagccggtgatgccaaagaaagggccaggctcaagaagggaggcatcagatcagaaggcccctcggggccagcagcctgccgaggcaacagcctcaacctctaggggtccgaaggccaagccagaaggctctcctcggcgtgccaccaatgaatccagaaaggtttgatctgggggaccacccatactgaggagttgaaagaacaaggaagaagtaccaagtcaaccaagttctctcttgtcactgaataagactttggactctcttagggcccctgttgatagagatctggccctgaggtaaacgataggtgaggtcttgggtgggagggagttggggaagggaggtggatctctatgcccttttctctaccaggcctgccgtttcaccgccttctctactcaccttctcttcggaggcaggagagttggtaagaggattgggaaaattctagaacattcattcccctttatgcatgagcagggtcactgttacactcatccatgttcagcttttctcccccacgccttgctccctcctcggaatggtcagcgacctctgcaggccctggcatttggaagagctgggtggccctgccatattcttcctcccgccttcctctcgtgtaaccagcggggtaagttaagccaggaccttcgctgcaaacctggttttattgctccttcagtctccagcttccatcctccagttatctagccaggaggtcccaagagttagttttagggaaaaagaatgtctgcctagacctcaaagtctttgagttttagagtctgttagtaaaaatggcactttgattcccatttgggatgagccctctcaggaatcctgtggggaaggggggtgattatagggaaggacgcaggcattcctaggtccccagctctaattccatccatctacccaactgtcaccatctttgcaccaaactgtcaccatctttgcagcagaaggtcactactcacattatagtaagaggggaaaaaaatcttttaaaacttggctgttggccgggcacggtggctcacgcctgtaatcccagcactttgggaggctgaggcaggtcgatcacgaggtcaggcgtttaagaccagcttgaccaacatggtgaaaccccatctctacaaaaattagctgggcgtggtggcgcgcgcctgtaatcccagctactcaggaggctgaggcagatgaattgcttgaatccaggaggcagaggttgcaatgagccaagattgtgccacggcactccagcctgggcagcagagtgagactctctctcaaaaaaacaaaacttggctgttaatgtctgccctctgaattcagacacactatattagaccagaccaccatgtgtcattgtgtgtgtgtgtgtgtgtgtttgcgtgcgcatgtgtagaggagagagcagggtccctgagataatggtttccaaactgtatcgtagccgtccacaaagatgtaatccaaatctatttttctcacgtgtttaaaaaactgaaaagtgactactcagatatgttggaagtcacatcgaagactatcagaatattaccttgtgttcataggttaacttgtttttgtacacgtcttagttatttcaggcatctctttgcttaaaattgagtttcttgtaaatgtgactgatgagcgaggttagaagtggaagaaattcctgtgcatgttctataatctgacaccctgaaagcaagtttcctttcgtcattcacatgctcttgttctgccgtgactgttcaggtgtatggtagtaagtaaatgtattaacatggtgaacagtagtaatattctatcatagagtattagcccttgcaagttttcagggcgtcttttccgacttcagtttttgtgataaagaatgtgaacagttgttagatgttctcagtgattcaactttaaaacaaatttctcgtgatgattcatttcaaaatcctgagtgagtctgactgaaaaatacgagagaaaagagagtggtttccgtttgcagctacacagctgtgtgcatcgacgttctcctggggtgtgtgccaagcgaaacccaggggtgaattggattcttgaagagaccaaagcctgtaactgtccagcttctaatttcaaaacgggtccattagggcttcgttgtgttaacaagttgacaccatgactagtaaatgtaaacgtgtatgtataaaataaagtttagcaaattaagtgtcctgttaaaaaaaaaaaaaaaaa

SEQ ID NO: 53138 - DNA, 2119 bp, Homo sapiens
gccgaggggcgggaccggctcggctcccccggcgccgcagcccgcagccccctcccctcgcctcctcgccgctggcggccaccgcgtcgctccggcccgggccccaccccaggcgactctgtgaggagcggccggaggccggaggcggaggtgcaagatggacaacaagagagacaaggcgaaggcaggggccgccgcgcggacgccggctgctcgcgctcctggacttctgacccccaggcccccaggctctcctcgaccccctcccccagtaactcccgcagccctccgagttctgggagctgcgggagcagtggggcgaaagcctctggcagagcgagcggggggcatcggcggggccactattcccgagtctgctccccgagcgggaccaacgcggagtgctgggacaagttcccgaaaccctgcctccaggcccccagcctctgggagaggggagagagctcctcctgccaagaacaccagcccaggccctgtttctagcccagggcgtgccagcgggaccaccaggccaggccctcttggccagaagggactccggatctcagcggaggaaactgtggccagaggaaaagctacagaggctcccaaaaggagtgccctcagcgctggggcacggagagacacttccgggcctaccccaggaaccccgtccccggccatggcccgtcggtcccgggctgcgggcaccgaggtggggctcccccggccagctccgagtgcccggccacggcccccgacagagggcccccggaaatcagtgagcagcgcctcggagcacagtaccaccgagccaagcccggctgccaggaggcggcccagcgccggtgggggtctccagaggccggcctcgcgctccctgagctccagcgccacccctctctcctccccagcccgttctgggccctcagcccgcggaacacccagggctcctgcgcatccctcgcagcccaagccgaaaggactgcaggctctgcgaccccctcaggtcacacccccaaggaaggacgcagccccagcactaggaccgctttcttcctctcctttggccacaccctctccatcgggtaccaaggcaagaccccacgctgagcggcccagacctggccggccacagcagcagcgccacgagcacgccagaggagctgcgtggctacgacagcgggcccgagggcggtgccgcagcctccccgccccccgacgcagagctcgccgcttgccacccggctgcctggagtcgaggccccgctccgccgctggctttccgcggagccccaggtgcgcccctgccgtggcctcccgctaccggaccgggctctgctgacggtctgtgcaccatctacgagactgaagggcccgagtcggcgacccccgcccctggcgcactggatccggggcccagtcccggcacgagcggtgggaaggcggcggctggggccggggccggggcgtcctcgcggagcccgaagcaggcgcgcctgggcgagctgccactgggggcgctgcaggcgagcgtcgtgcagcacctgctgagccggacgctgctgctggcggctgccgagggtgccgcgggcggcagcggcgggggcccaggaggtgcggagggtggtggcgtcacagggggcgcccgggctgcactcagcgacgccgaactcggccgctgggccgaactactgtctcccctggacgagtcccgtgccagcatcacctcggtcaccagcttctctccggacgacgtggcctccccgcagggtgactggaccgtggtggaggtggagaccttccactgagccagaccacagccccgcctgctacaccccacccctgccttaggatccgcccctccgggtacgccgtttgttttagaccccgcctccactgccctggagccccgctgggtggattagtcttagctccctagagcctgagcctttggcctcggaggctcgggacctacccacagctttgacctaggcccgcccctcgagctccgcccctttggcctaggacacgccccgtttccccgagtcccgccccgtgtgcagtgtattgcccaccccgcacagcctgagtttgcaataaaactgggacactggga

SEQ ID NO: 53139 - DNA, 4406 bp, Homo sapiens
atgatgttacgccagcttctggcagttgctgccatgaccatggagaactcggacgctcctcaagttcaaagccaaaccaccagcagcagcggcagcaagcagcagcagcaccccgggggcgcgggcgacgccagcccgggacccggcaagggaaagggcaagcgcgcggcggagctggccccgcgcgacaaggcgccggcggctgcggcggcggcggcggcggctgcggcgggggccgggggcccccgcgagagggcagcgggcgccagggcggggccgggcccggcggtggcggcggcggcgggcggcagcctggtccccgcggcgcgccagcaacactgcacgcaggtgcgcagccggcggctcatgaaggagctgcaggacatcgcgcgccttagcgaccgcttcatctccgtggagctggtggacgagagcctgttcgactggaacgtgaagctgcaccaggtggacaaggactcggtgctgtggcaggacatgaaggagaccaacaccgagttcatcctgctcaacctcaccttccccgacaacttccccttctcgccgcccttcatgcgggtgctcagcccgcgcctggagaacggctacgtgctggacggcggcgccatctgcatggagctgctcacgccgcgcggctggtccagcgcctacaccgtggaggccgtcatgcgccagttcgcagccagcctggtcaagggccagggacggatctgtagaaaagctggcaaatcaaaaaagtccttcagtcgcaaggaagctgaagctacctttaagagtttggtgaagacgcatgaaaaatatggttgggtcaccccgcccgtgtccgacggctgatgtctgccacgtgcagtagacgctcgagcgcctgtccacacacacaccagtaccctgacatctcctcaatgctgtgcatcctccacccgtttttactccagccagaactgcatcctgaatgcccaggagacgtttaagttatttatgaaaagatgtgtgtacagagaggaagagggagcaaatgccgttcggattatgtttcgattataaatgaatgatcacctcgaagtcactttagaacacatgttgagatggtgacatttcccagcctgcctgcccctctgcccaccccggtcacattgccctgagcttctttccatgacagcagctccgacgagccggcaggaaactcaatgcccctgctggctccatttccatgtaaatggcgccgttcatatttcacagggacgccgtgcatctccgccgtgcgtccccggcacgtgtttgctgtgctctgtatctctgtttttcttcctggaaggtcaacataacttgaaaatgtgtctttctgtggcccatggtccgctgtgatgacatttagacctcatttgtgctatgacctttggctcatgaaaacacaaatttaacattgccaggttctagtgatttaaaaccacaactgcccacttggtgaaaacgtgctctcgatgctgatttgtggtgtgctgctgtccacagataaaccagtgccattagatggaaggcagaggatactgcgaccacccctggcagacggtggcgtagacaccaggtgcgccctctggggctcagagcaacggatggtcagctgcgaacagtctcgtccgatgttaggaaatggtcctacggccgcgcctttgtgttcctgtcttctctccaccaccaaaagcaaaagatgatttcccattcactgcagtcatctgactcattttaatatctgtgctagtgacaatgaatgtcagaactgccaaaggataccaagtgatcatacgatgatttgcatgatcgggtctatttcacccaatagtcacttgtgtgtcccccgaaattgggatgggtgagcacccttgctgtggtgtaaacttcctgttatttaatctcccccacggtttcatttttctcttctgttaatacttagaactttctaagaaactccatgaaatgaggaaatactgtttctaataatatgaggaaagaagtaaaaatgttcattccaagtggcaagtcttattggacacattttaaataaaatcatgcatacctgatacactgcctcaaggatccagtcattgtgggctatccttccatttaaaatatttcagatattcttaaattttttaaatattgcaaatactacaacatgtaattccagagcagcgttctaagtcaggtaccagaaatgagtcttaggaacccatagtctttgcaaaaattcagtagattgaaatagtccccagaagcagccaaggagctgaagggatgattcgatcaagttcagatgttgccaattgtatcttactgctgtgaaggaggaaaagtcttccgggataatgtattcaattcttcaggcagttttgtctacttggggacctgcccattggttcaaggttttcagagatccaagaggccttgcctcaaagaacaaggattggcgcctttcagcagggctgcccattcaccaaacttattgttacttttgtttttctttaccactttcttatttgcccccaagtgcacacaggcagctctgccagaccaaaatgacagtgtattaagaatgcagggcctgctcagcttccctgtgagtcataatagtcgtgaaacttgatgacagtgaacttacgatgttcattcatccaaccctctatggtggcattctccatcctggaaacctgacatttggctgacggtctttggaccctggagctagtggtcatcatggaattacactgtggagatgaaagacctaggacagaaacatcttgctagggaaagcacctgagtttattcctttctaaatattttcctcttctaatgaaaactaaaagcagctttactttagggggaaaaatatatccaaaggcaggtcatttcagtagtgtttattagctgattgaaaaacaggttcacggtgctctctgagaactgcaccaaggggtgcagccaagagactggtctgaccccgggttgggctgggtggcagccggcgacagagcagagagacactcagctcagtgtcgctccttccatacactcagagtttgatttttcttgcatggcatttccattaggtttgttagaaacttatagaagaaatcaattctttagtgaacgaaataccatttttcactcaattggtaagaatttttcattttaaaagcagtaggaagtgatgtaaaactctaccattgcttggactgttaggagtgcggactccctttctggtagactcccttcgtaggcaagcacggtggtgcccagccatggaggcacccttaggacactgagcacaggcctggctgcctgtgccttggccacagcctccttccaccccactgaagtggacacctgcctctggagcccagggtgagaaggagaggcctgaagcctggggccacgttcccacacaagccaaggaacctattcctctttggacagacagcgagggaataatcagacagtgggtgcaaatgttcatgtcccgatagctccacacacccatgtatctgtgggaactcaaaccaagccagagcccacagagccaaacaaacagaaaatcacaaacccatctgtcctcttctcaatgcagaactccttcccgtccaataattttcctgaaccaatcacccttgttattgggtatcttctccactgctgggtaaggcctgcacatggtctgtctgtaactttctagaagactgagaactgcttatgccttagggagttctatgtgagcagcaaggttattccccctagttacacacacacgcacatgtgccaatactcctgcaaagacttgctgtttctaaaatccactactcagaaaaaccagggtgtcggcttaaagttttcagctccatctatcaaaatttgacctttttttaagagaaaaatatgtagatgagtgaaaaagacctaggattgaaagacaaaaagccatgtgtccatgtaaccctggccagtcactccacctgcctgagccttggtttcctcagctgtgagctcctaccaggtcagtgtgggaattggccaaaatgacgcagcagaagtgctttggagactaaagattgtcaacgaaatgtaagtgtcattttcgtagtattaggacgtttacattacagcaggctttaattagaacccacttagatatcgactcagaatgatcaattacagtggttaaaatacacatacctggtaatcatatacttgctttctgtccccagttcttacattaagtcaaccaactgacccaaaaatcaaccaataactaactggccatctctccactcactcagcattctcctcttaaatgcagggcatgcagaagattaaggtacagccccttccctggatag

SEQ ID NO: 53140 - DNA, 4199 bp, Homo sapiens
atgatgttacgccagcttctggcagttgctgccatgaccatggagagggcttctggcgccagggcggggccgggcccggcggtggcggcggcggcgggcggcagcctggtccccgcggcgcgccagcaacactgcacgcaggtgcgcagccggcggctcatgaaggagctgcaggacatcgcgcgccttagcgaccgcttcatctccgtggagctggtggacgagagcctgttcgactggaacgtgaagctgcaccaggtggacaaggactcggtgctgtggcaggacatgaaggagaccaacaccgagttcatcctgctcaacctcaccttccccgacaacttccccttctcgccgcccttcatgcgggtgctcagcccgcgcctggagaacggctacgtgctggacggcggcgccatctgcatggagctgctcacgccgcgcggctggtccagcgcctacaccgtggaggccgtcatgcgccagttcgcagccagcctggtcaagggccagggacggatctgtagaaaagctggcaaatcaaaaaagtccttcagtcgcaaggaagctgaagctacctttaagagtttggtgaagacgcatgaaaaatatggttgggtcaccccgcccgtgtccgacggctgatgtctgccacgtgcagtagacgctcgagcgcctgtccacacacacaccagtaccctgacatctcctcaatgctgtgcatcctccacccgtttttactccagccagaactgcatcctgaatgcccaggagacgtttaagttatttatgaaaagatgtgtgtacagagaggaagagggagcaaatgccgttcggattatgtttcgattataaatgaatgatcacctcgaagtcactttagaacacatgttgagatggtgacatttcccagcctgcctgcccctctgcccaccccggtcacattgccctgagcttctttccatgacagcagctccgacgagccggcaggaaactcaatgcccctgctggctccatttccatgtaaatggcgccgttcatatttcacagggacgccgtgcatctccgccgtgcgtccccggcacgtgtttgctgtgctctgtatctctgtttttcttcctggaaggtcaacataacttgaaaatgtgtctttctgtggcccatggtccgctgtgatgacatttagacctcatttgtgctatgacctttggctcatgaaaacacaaatttaacattgccaggttctagtgatttaaaaccacaactgcccacttggtgaaaacgtgctctcgatgctgatttgtggtgtgctgctgtccacagataaaccagtgccattagatggaaggcagaggatactgcgaccacccctggcagacggtggcgtagacaccaggtgcgccctctggggctcagagcaacggatggtcagctgcgaacagtctcgtccgatgttaggaaatggtcctacggccgcgcctttgtgttcctgtcttctctccaccaccaaaagcaaaagatgatttcccattcactgcagtcatctgactcattttaatatctgtgctagtgacaatgaatgtcagaactgccaaaggataccaagtgatcatacgatgatttgcatgatcgggtctatttcacccaatagtcacttgtgtgtcccccgaaattgggatgggtgagcacccttgctgtggtgtaaacttcctgttatttaatctcccccacggtttcatttttctcttctgttaatacttagaactttctaagaaactccatgaaatgaggaaatactgtttctaataatatgaggaaagaagtaaaaatgttcattccaagtggcaagtcttattggacacattttaaataaaatcatgcatacctgatacactgcctcaaggatccagtcattgtgggctatccttccatttaaaatatttcagatattcttaaattttttaaatattgcaaatactacaacatgtaattccagagcagcgttctaagtcaggtaccagaaatgagtcttaggaacccatagtctttgcaaaaattcagtagattgaaatagtccccagaagcagccaaggagctgaagggatgattcgatcaagttcagatgttgccaattgtatcttactgctgtgaaggaggaaaagtcttccgggataatgtattcaattcttcaggcagttttgtctacttggggacctgcccattggttcaaggttttcagagatccaagaggccttgcctcaaagaacaaggattggcgcctttcagcagggctgcccattcaccaaacttattgttacttttgtttttctttaccactttcttatttgcccccaagtgcacacaggcagctctgccagaccaaaatgacagtgtattaagaatgcagggcctgctcagcttccctgtgagtcataatagtcgtgaaacttgatgacagtgaacttacgatgttcattcatccaaccctctatggtggcattctccatcctggaaacctgacatttggctgacggtctttggaccctggagctagtggtcatcatggaattacactgtggagatgaaagacctaggacagaaacatcttgctagggaaagcacctgagtttattcctttctaaatattttcctcttctaatgaaaactaaaagcagctttactttagggggaaaaatatatccaaaggcaggtcatttcagtagtgtttattagctgattgaaaaacaggttcacggtgctctctgagaactgcaccaaggggtgcagccaagagactggtctgaccccgggttgggctgggtggcagccggcgacagagcagagagacactcagctcagtgtcgctccttccatacactcagagtttgatttttcttgcatggcatttccattaggtttgttagaaacttatagaagaaatcaattctttagtgaacgaaataccatttttcactcaattggtaagaatttttcattttaaaagcagtaggaagtgatgtaaaactctaccattgcttggactgttaggagtgcggactccctttctggtagactcccttcgtaggcaagcacggtggtgcccagccatggaggcacccttaggacactgagcacaggcctggctgcctgtgccttggccacagcctccttccaccccactgaagtggacacctgcctctggagcccagggtgagaaggagaggcctgaagcctggggccacgttcccacacaagccaaggaacctattcctctttggacagacagcgagggaataatcagacagtgggtgcaaatgttcatgtcccgatagctccacacacccatgtatctgtgggaactcaaaccaagccagagcccacagagccaaacaaacagaaaatcacaaacccatctgtcctcttctcaatgcagaactccttcccgtccaataattttcctgaaccaatcacccttgttattgggtatcttctccactgctgggtaaggcctgcacatggtctgtctgtaactttctagaagactgagaactgcttatgccttagggagttctatgtgagcagcaaggttattccccctagttacacacacacgcacatgtgccaatactcctgcaaagacttgctgtttctaaaatccactactcagaaaaaccagggtgtcggcttaaagttttcagctccatctatcaaaatttgacctttttttaagagaaaaatatgtagatgagtgaaaaagacctaggattgaaagacaaaaagccatgtgtccatgtaaccctggccagtcactccacctgcctgagccttggtttcctcagctgtgagctcctaccaggtcagtgtgggaattggccaaaatgacgcagcagaagtgctttggagactaaagattgtcaacgaaatgtaagtgtcattttcgtagtattaggacgtttacattacagcaggctttaattagaacccacttagatatcgactcagaatgatcaattacagtggttaaaatacacatacctggtaatcatatacttgctttctgtccccagttcttacattaagtcaaccaactgacccaaaaatcaaccaataactaactggccatctctccactcactcagcattctcctcttaaatgcagggcatgcagaagattaaggtacagccccttccctggatag

SEQ ID NO: 53141 - DNA, 3258 bp, Homo sapiens
atcatgctaattgtctgcactagagctggagaacgccacccaaaatgaagagagaaaggggagccctgtccagagcctccagggccctgcgccttgctccttttgtctaccttcttctgatccagacagaccccctggagggggtgaacatcaccagccccgtgcgcctgatccatggcaccgtggggaagtcggctctgctttctgtgcagtacagcagtaccagcagcgacaggcctgtagtgaagtggcagctgaagcgggacaagccagtgaccgtggtgcagtccattggcacagaggtcatcggcaccctgcggcctgactatcgagaccgtatccgactctttgaaaatggctccctgcttctcagcgacctgcagctggccgatgagggcacctatgaggtcgagatctccatcaccgacgacaccttcactggggagaagaccatcaaccttactgtagatgtgcccatttcgaggccacaggtgttggtggcttcaaccactgtgctggagctcagcgaggccttcaccttgaactgctcacatgagaatggcaccaagcccagctacacctggctgaaggatggcaagcccctcctcaatgactcgagaatgctcctgtcccccgaccaaaaggtgctcaccatcacccgcgtgctcatggaggatgacgacctgtacagctgcgtggtggagaaccccatcagccagggccgcagcctgcctgtcaagatcaccgtatacagaagaagctccctttacatcatcttgtctacaggaggcatcttcctccttgtgaccttggtgacagtctgtgcctgctggaaaccctccaaaaggaaacagaagaagctagaaaagcaaaactccctggaatacatggatcagaatgatgaccgcctgaaaccagaagcagacaccctccctcgaagtggtgagcaggaacggaagaaccccatggcactctatatcctgaaggacaaggactccccggagaccgaggagaacccggccccggagcctcgaagcgcgacggagcccggcccgcccggctactccgtgtctcccgccgtgcccggccgctcgccggggctgcccatccgctctgcccgccgctacccgcgctccccagcgcgctccccagccaccggccggacacactcgtcgccgcccagggccccgagctcgcccggccgctcgcgcagcgcctcgcgcacactgcggactgcgggcgtgcacataatccgcgagcaagacgaggccggcccggtggagatcagcgcctgagccgcctcgggatcccctgagaggcgcccgcggtctgcggccagtggcccgggggaaagctggggctgggaagcccgggcgcggcgcgctggggacgaggggaggtcccgggggggcgctggtgtctcgggtgtgaacgtgtatgagcatgcgcagacggaggcgggtgcgcggaggcggcagtgttgatatggtgaaaccgggtcgcatttgcttccggtttactggctgtgtcctcacttggtataggttgtgccctcttaggaccacatagattattacatttctggcccaatacccaaaagggttttatggaaactaacatcagtaacctaacccccgtgactatcctgtgctcttcctagggagctgtgttgtttcccacccaccacccttccctctgaacaaatgcctgagtgctggggcactttttttttttttttttttttttttttttttgcaagttcagattagagaggccactttcccagaatccacagctgcactaagctaaggagaagccagatgccggttactgggtgtgcaggggctgttctgagctggggggatcattgtgaaggccttcttccctgggcacctggtacctggggacctacaaggtggtgagggaagggtacgagtacattccttttccctctgacctgggcgctagcaagggcaaagaacccgagcctgccagcttggcctcctcccacagcctccctcggaggcatgccatgccaagcactctttctgtctctgttcatgaataaaagagatggatgggcttattcttatagagaagtgaatttcacttactcccctggcccgaaaactagaccaaatgaggaactgttttagctcatcaaactcatatattcctcctggcttccttacaaaacaagcctttcaaacaatcattgtcctcaggaaagttgttgagcttcctccagctgtgagaataagtcctaatctccagagaaatggtggggggaggaggaggcttattgcttcccagcatttggggggaacatgatccaacccctggcctcctgccacccatctgccctgctcccacatgctcaggtcccagggcacagaaaaagggcagactccctaatcacactaacatcaaaataaagaggctgggccgctgtgtagccaggacatgcccatgccaccgcctattgaacagttcataggagtggcagtaatctactgtgtgaggagagagggcaattaaaaagctgaaagagaaggaggccctctgtgtattccattccctcctccttaatgcctccaagggtccttgcatccctagtctcctaaactccagctctgattcgccatcaacccatggagcaattccaaggccccagttacccatcacctccacaccaggtcaagttttgtctcagccccaaaggcactgacatttctagtttgccccctctgccctgaaccccacagcatgcctgtctcagctccctgtccctcggcacttccccaggctcatttgagcaggtgtgccttcgcagctcccctaaacttcccaggtgcctcatccataatgagataatgcatgtaggggaaaagtttctcaagaaggtggaagaggcagcaggacttggataaggagtacctgctggtcagccttgagatgcacaggtgaaggttagggtgagatgagaacatgccataccctggtgctgaatccctgaggggccagcttgccaggcttaagccaaatctgccttaaattgggggtggggaggggtaagtaaggaagtggggtttgtttttgtgttgttttcatcttcatctttgtattactagcatccagcagagtgcctagcacatactggatgctcaataaacttttgatgaaatgaaatgacaactttattccacataaacaagggtaacaaaacaagctgcttaaatacaaaaaaaaaaaaaaaaa

SEQ ID NO: 53142 - DNA, 1719 bp, Homo sapiens
ggccgggcgggggagagcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaagccttcctgtgcatcggtggatctgcagggagacagctccttacaggtggagatttctgacgcagtgagtgagcgggacaaggtgaaattcactgttcaaacaaagagctgcctccctcacttcgcccagaccgagttctcagtcgtgcggcagcacgaggagttcatctggctgcatgatgcctacgtggagaatgaggagtacgccggcctcatcatccccccagcccctccgaggccagactttgaggcttcgagggaaaagctacagaaattgggcgagggggacagctctgtcactcgggaagagtttgccaagatgaagcaggagctggaagcggagtacctggccatctttaagaagacagttgcgatgcacgaagtctttctgcagcgcctggcggcccaccccaccctgcgtcgagaccacaacttctttgtgtttttggaatatggacaggatctgagtgtccgggggaagaacaggaaggagctcctcggagggtttctgaggaatattgtgaagtccgcggatgaagccctcatcacgggcatgtcagggctcaaggaggtggatgacttctttgagcatgagaggaccttcctgttggagtatcacacccgtatccgagatgcctgcctgcgggccgaccgcgtcatgcgcgcccacaagtgcctggcagacgattatatccctatctcagctgcgctgagcagtctgggaacacaggaagtcaaccagctaaggacgagcttcctcaaattggcagagctctttgaacggctgaggaagctggagggccgggtggcttccgatgaggacctgaagctgtcagacatgctgaggtactacatgcgtgactcacaggcagccaaggacctgctgtaccggcggctgcgggcactggccgactacgagaatgccaacaaggcgctggacaaggcgcgcaccaggaaccgggaggtgcggcccgccgagagccaccagcagctgtgctgccaacgcttcgagcgcctctccgactccgccaagcaagagctcatggacttcaagtcccgccgggtctcctcttttcgaaagaatctcattgagctggcagagctggagctcaaacacgccaaggccagcaccctgattctccggaacacccttgttgccctaaagggggagccttagagtagccagagctcagccagaccctaatctgggatctccagtgaccagggtatcccagacccctctctccggcaagatgtctccttccctagcagtgccactagccacaccctcactctgccccacatcctctcagggaaagcccaaaccccctatcaccaccaccacaggtgccaggccctgcaagacacagggcagcatgggcatcataactggccacagtcagcagagccccagggaccctgacacctctccccaggaagctgaggaacagcctctaccctcacccatagccctgaaggaatcatagctcacttgatcccggcctgttctccttcgcaaataaaaaccctggttttgtagcaaaaaaaaaaaaaaaa

SEQ ID NO: 53143 - DNA, 2163 bp, Homo sapiens
agcccacactgcggagccaggcggcagcatggaccgggctggggcagacatgtgggccagcaccttcaccctggccatggccgagaggaagccccaggacgtctgggttctgctacctgagcacagcctggtcccgggatgcctggacggcggtggtgtccagtacctgctggtggggctctcgaggctccagtgcggtcactgtccggggacctgggactcggcccatgtgcacgtcctcttccacctgtggtgggacagggccagccaccgggggctggtgaagatgcgcatctggggccagcggtgcaggctgtgccccgcacccgaggactgccaggtgaggcccccgggcgagcagcccttcctcagcaggctggtcttgcacatcctgcaggactgctacggggatggccccggcccagcccggcaccccagggaggcctatgagggctgctgtgaggcctgtgagctgggggtctgcttcctccagaaggccccagaccccgcctggagcgccaacgccacaaaaggcaacttccccgccacggcctggggtggcactggcaccgtctccaggggcaaaccgctgtccacccctggcgacgaccttggcaagggtggcgttgtcatcgccatccccttctcccttgtgggtaccagcaatgaccaggtgcccatcgctgagggccctgccccccctgcgggggcctctctccctgtgactggcagctgtgaggccctggtcaccggccagggctccatcttcctgtctggggattcagtggccatgcctgggggcaaaggcttcccggtggccattggagaccccctcttccacggccccggcctcctcggcagcagcatccagaccttcgagctcaagggcttcctcttcaaaggccggggctccctctgcagcccggttggcgtggcccagggctggggccccatctccctcaacaatggcctcgtccctgtggggaaacacacgccaaccgtgttctactgtgtgggcctctcggccagcggggagggctccctcaccttcccctcctccctcaccagcatcttcaccaacaccctctcggagcccaccgatggccctgtggccactaaagaggcctccatcaccttccccttcatctttactgatgtcaaggatgccgttgctgaggtggctgaaggcaacgggaaggaaggaggcggccagggcctcgtcccagtgggtcacgacgccctgccagagaccaatgctggtggcctcccctcccaggtcaagggctcccttgccctccccttccctgctgatgtccaaggcaaagatgcctttactgacatcactgaaggcaaagagaaggaaggtggcctggtcaccgcgggtcacgacgcccctctggaggccaatgccgagggccccatcacggttagtgagggctgcatcaccatccccttcgcagtcttcgatgtcataaagcgcaagggcggtggccacgttgcctacggcccccagggcaatggctgcttctcccaaggctattaccagaagaggcagctgaggtccaggttccacaaggcccgctgtgggtgccgccgggaggaagacgagcgccctggccgtgcctgccgtaggccgcacgccgagccctacgaggacttctggatctgggtgtccatgaccgtgtgcgtcttctggctgatgtgcatgtgtcggctgaaccccgggatctacccgcagcaagtgtgacgccccgaagttcaggcaaccctcgcctctgggaccccgcctcgcctctgagacaccccccaaccccgcctttgagatgcccgccccgcctccgagaccccgcctccacctccgagacccctttctctgagacccccgcctctgaggccccgtcccccgcctccgagaccccgccctgcctctgagaccccgcctcacctctgagacaccccccaaccccacctttgagatgcccgccccgcctccgtggccctgcctccacctccgagaccccgcctcacctctgagaccccgcccccgccagcagctcagcccctcctgtctcttgcccctggttttgtgggtctgccctgagctgtgcctgtgtgctccagcctcttcctatgtgtgtaacttcaataaaaccaagcaaagcc

SEQ ID NO: 53144 - DNA, 4473 bp, Homo sapiens
attgctccttctccatccgggttcttgtgcgtgcgcttctctctgctgggaagatccattgacaccttgtctctttggagaaatcagacccccttgttctgaggcttccagagacaagagctgccgagactttggcttcgctggaggaagtcccataaagatgggaagagtggctgctgctctgggatggtgtgaaggccatcctgcagaggcagaggggtacattggtggtgtccccatgactaaatggatcctacctcttgtccctcccatcatcctgaggatgcctggggactggttcttcagggcatgctttctcgcctgccggccttccaccatgggatgaagcagcaagaaggctcttgccagaggcagacccctcgaccttggacttcccagcccccagaactgcccatgctgtgcagactgggatgtgggggtgcacctcagatgagaaggagagtggtacaggagctacccagctgctgtttgaggaatggatgttgtgtccacagtctgccctcaccccttgtcaacggctgggagcacgtaaactcttgcaaattatttaacctctctgtgcctcagtttcctcactataaatcgtggattgtaatcatgcacctgctcctctgagctgctgtgaggataaaatgcatctttatgaagcccttctgaactggggcggtgcctggcacgtagcaatcaccactcaggagggtcagctcttcctgccaaagggttagttcctggtcccccagggtggggaggccctagaaaggccctgagctttcacaagtttaggtgctttaagtctggggctcccagggtgctggggagcagaccagtgggagtttagtgggcagagtcctgcctggctcacccggccccatccgtctccggtgggctcttctgctgccggttgtacaggaagaagacagtgagcacagcacctaggatgaggaacacggccacggtgcccgccaggagcctggctgcacttcccagacccctctgggggcggggcttttctggaaacaaaagacagggaagaggattagagagagaaactcaagtgacccaaagagagtcagagatgtgagagagtcagaccctgaggcagtactctgcctttgacattgcacccccagctcccctccccatggtgctccagttctaggaggggctcccagccggtgtgggatggaggctcctcctctagttccctatgaccctgtaaccccagaccctgctctgatcctgggatctggggcatggaggtagaacaagggtgagggtatctcctggacaggcagcaggtgctgagatggggtccccaccccgtcattccatttctggccctgcagggaagattcctgttgaggagtttaacttctttcccctccctgtgcaattaaacaagcaaatgaactaatgggtgcttcaccctcccagcttgggacagagggtgaggatcaggagggaaaggcaggagctgggagggtcgatgaagaaggggcacctgggggtgcctcccgggaaaccaagcctcttcagtacagatgggtgaaaagcccagagggctgtggtctaaggtgagggggctgagcccaccttctggacccacctggtcatggacccagaagattgctgggcttgtcgaggtatttcacagtctgagctggagacactggtctgtccctgaagcccaggaggctgcagagactgaccctgtggccaggggcacatgctgcttctcagcgatccaggcttggctgtgaagccacagctggcccttccagttcctccttctgctgggctcgatttctcacctctgacctttacgaccccagcgtggagtggggggtagggactaaggagaaaatcacacacttatgtactccttcctctccactaccgtattacatataattaaacacggagagcacctgaatagagatgccaaattgcagtttgcagtaaacatcatggagccaattttcctaaagtggaattgacaagtcccttccactcactcactcacttactcactcactccctcctcattcactcactcactttctgtctctctccccttctctctgctccattccagtgcccggaaggagggggtatcttgctcccagtaaatttgcaacccctctctggcctgtctgcaaaggctctggccccagcatccatccatccacagctggtggctgtggccgcctttggaaggcagtttcccgtgttgtccaggctggtctcaaactcctgagctcaagtgatcctcccgcctcagcttcccaaagtgctaggattacaagcatgagccaccgtgcctagctccagagtgatcgttctaaactacaaatcagatcaggccacctccctacttaagttcctccaagagttcctccaacagtttgtggcctttatcaaagcgttaagggctgaggcctttcacgacctggttcctggaggaaacgccatgccgcccccagcctggaccacttgcagctcccagacagggagcccctgcttcctctcatcctcaggtagctagtaggagccactctgtctgccagggtctctctttcttccccttctttgccaggccaatccagcctgcaggtttaagctggacgtgcttcctccagagagccctccctgcctcctccactggaatggggttcctcctctggacttcccctgcactctctttcagtctcttttcttttctttttctttttttttttttagacggagtctcactctgtcgcccaggctggagtgcagtggcgcgatctcggctcactgcaagctctgcctcccgggttcatgccattctcctgcctcagcctcccgagtagctgggactacagggacccgccaccaggcccggctaatttttttttttttgtatttttagtagagatggggtttcaccatgttagccaggatgatctcgatctcctgacctcgtgatccgcctgccttggcctcccaaagtgctgggattacaggcgtgagtcaccgtgcctggcttctttcagtctcttttctacagactgtgattgcacgtctgacttgtctccccagccctgcacagtgcctggcatgcagaagtgctcagtaagtgtggtgaatgaatgaaggcttgcctgaatgtgtagtgggcagttctgggagagggtccaccgggcctctggaatctcaccttccactagggggagctctcaccttgagtccagccaccaccacgctggatgctacgaattcagtttccctggacacaactcaaacctatatccccttttcttctcagcacagctgaggcaggctggcatttccagagggctagggtgggagggggagcagtagggaaatgaacacataccctgtccggctcacagagttcaggtttctcttctaccacggttggccccacatggaatccgaacaggaggaagagacaggttcaggacaaaaggctgggatttcagcccttactccctgcctccaggaaacttctctcagaggctttcacccatcatcccctcatggactctgcagccactttgccaagagagggtggcagctgtctctatgagggccctttcatcatccttacagtgcaaacaaaaacacagccatccctcggcatctctgggggattggatccaggacccctagcgaatagcaaaatccaagcatgctcaaaagtcccttatataaaatggtgtagtatttgcctataacctatacacatcctcccatatactttaaatcagctctagattactcataatacctggtacaatgtaaatgctgtgtaaatggttgtaatactgcattatttaggaataacaagaaaaaggtgtacatgttcagtgctgacactactctccattttctttttttctgagtatttttgatctgcagttggttgactccacggatgcagaacccatggatggatacagagggttgactgtataagaagttttctataaatgtctgctgtggactgaactgatggaataagcatccaaaaggaatgccaccggctgaaatgctgaccctcatcaccaagataaaacattgcagggatgcatgaaaattacatttggggagtaaataggcagcccaagtacagagtgaagaagacctgcttagaggtggcacacatgaaaacaactcaaagatctctgtctggagaactcctgcacatccttcaaggcccaggtgaaatgtcgcttcagatcctcccaaacacaatgacccactcccgtcctgtgctaccccagcgctttacacacagctctgcgacagcctgtggccattttggaattggggatacccagcgttcggaattccttagagctgggatgctgggtgtggctgtcacagcattgcagtgccagagtggccaaaaatgtgttgtaagtgaataaatgaattcctcaattc

SEQ ID NO: 53145 - DNA, 1768 bp, Homo sapiens
agtgcgggagccggagcggagccggggccggagcgggcggaatggagcccctgcgcgcgcccgcgctgcgccgcctgctgccgccgctgctgctcctgctgctgtcactgcccccccgcgcccgggccaagtacgtgcggggcaacctcagttccaaggaggactgggtgttcctgacaagattttgtttcctctcggattacggccgactggacttccgtttccgctaccctgaggccaagtgctgtcagaacatcctcctctattttgatgacccatcccagtggccagccgtgtacaaggcaggggacaaggactgcctggccaaggagtcagtgatccggccggagaacaaccaggtcatcaacctcaccacccagtatgcctggtccggctgtcaggtggtatcagaggagggaacccgctacctgagctgctccagtggccgcagcttccgctcaggtgatggattgcagctggagtatgagatggtcctcaccaatggcaagtccttctggacacgacacttctccgctgatgagtttgggatcctggagacagatgtgaccttcctcctcatcttcatcctcatcttcttcctctcttgttactttggatatttgctgaaaggtcgtcagttgctccacacaacttataaaatgttcatggccgcagcaggagtagaggtcctgagcctcctatttttctgcatctactggggtcaatatgccaccgatggcattggcaacgagagtgtgaagatcttggccaagctgctcttctcctccagcttcctcatcttcctgctgatgcttatcctcctggggaagggattcacggtgacacggggccgcatcagccacgcgggctccgtgaagttgcctgtctacatgaccctgtacacgctcacccatgtggtgctgctcatctacgaggcggaattctttgacccaggccaggtactgtacacgtatgagtcgccggccggctacgggctcattggactgcaggtggcggcctacgtgtggttctgctatgctgtgcttgtctcactgcgacactttcctgagaagcagcctttttatgtgcccttctttgctgcctataccctctggttctttgcggttcctgtcatggccctgattgccaatttcggcatccccaagtgggcccgggagaagattgtcaatggcatccagctggggatccacttgtacgcccatggcgtgtttctgatcatgacccgcccgtcagcggccaacaagaacttcccgtaccacgtgcgcacgtcgcagatcgcttcagccggagtccctggacccggagggagccaatccgctgacaaggccttcccgcagcacgtctatgggaacgtgacgtttatcagcgactcggtgcccaacttcacggagctcttctccatccccccgcccgccaccttccccctgccccgagcggcgccggattctgggctcccgctgttccgtgacctccggccccctggcccccttcgagacctctgaccccgctggactccggaacacccgtggtgaccgccgggaccctgcctgtgactctccaggactctgcgaccccgggatggatattgcgatgctggtctcgaccctgaaaccctccctcggatctgtgacctcggacccgtactccatctgccgcatctccattccgggggccttccctcgggtccctggcagaaagacattttaccccttcttgccaaaataaaaaaggattcgtttttatctat

SEQ ID NO: 53146 - DNA, 3252 bp, Homo sapiens
caaggaggctgctgattgtggcccacagcctcatctgaacgccaggagaccaggataccgaggcaccggatcccctctctgtgccctggggagccccagtgctgcccagtcaccccagggctgaggtctgcgtccctagtggtgcaaggcctggtaggaccacggggcagggaatgtgagcgccatctgagctcacggtgtcctgagtcgcggcttcgtgactttggcaggggcctccggaccagtgaccccagtcaaacccagagggtcttgggcggcagcgacgaaggaggtattcaggctccaggccaggtggggccggacgcccccagccatccaccatggtggtggcacaccccaccgccactgccaccaccacgcccactgccactgtcacggccaccgttgtgatgaccacggccaccatggacctgcgggactggctgttcctctgctacgggctcatcgccttcctgacggaggtcatcgacagcaccacctgcccctcggtgtgccgctgcgacaacggcttcatctactgcaacgaccggggactcacatccatccccgcagatatccctgatgatgccaccaccctctacctgcagaacaaccagatcaacaacgccggcatcccccaggacctcaagaccaaggtcaacgtgcaggtcatctacctatacgagaatgacctggatgagttccccatcaacctgccccgctccctccgggagctgcacctgcaggacaacaatgtgcgcaccattgccagggactcgctggcccgcatcccgctgctggagaagctgcacctggatgacaactccgtgtccaccgtcagcattgaggaggacgccttcgccgacagcaaacagctcaagctgctcttcctgagccggaaccacctgagcagcatcccctcggggctgccgcacacgctggaggagctgcggctggatgacaaccgcatctccaccatcccgctgcatgccttcaagggcctcaacagcctgcggcgcctggtgctggacggtaacctgctggccaaccagcgcatcgccgacgacaccttcagccgcctacagaacctcacagagctctcgctggtgcgcaattcgctggccgcgccacccctcaacctgcccagcgcccacctgcagaagctctacctgcaggacaatgccatcagccacatcccctacaacacgctggccaagatgcgtgagctggagcggctggacctgtccaacaacaacctgaccacgctgccccgcggcctgttcgacgacctggggaacctggcccagctgctgctcaggaacaacccttggttttgtggctgcaacctcatgtggctgcgggactgggtgaaggcacgggcggccgtggtcaacgtgcggggcctcatgtgccagggccctgagaaggtccggggcatggccatcaaggacattaccagcgagatggacgagtgttttgagacggggccgcagggcggcgtggccaatgcggctgccaagaccacggccagcaaccacgcctctgccaccacgccccagggttccctgtttaccctcaaggccaaaaggccagggctgcgcctccccgactccaacattgactaccccatggccacgggtgatggcgccaagaccctggccatccacgtgaaggccctgacggcagactccatccgcatcacgtggaaggccacgctccccgcctcctctttccggctcagttggctgcgcctgggccacagcccagccgtgggctccatcacggagaccttggtgcagggggacaagacagagtacctgctgacagccctggagcccaagtccacctacatcatctgcatggtcaccatggagaccagcaatgcctacgtagctgatgagacacccgtgtgtgccaaggcagagacagccgacagctatggccctaccaccacactcaaccaggagcagaacgctggccccatggcgagcctgcccctggcgggcatcatcggcggggcagtggctctggtcttcctcttcctggtcctgggggccatctgctggtacgtgcaccaggctggcgagctgctgacccgggagagggcctacaaccggggcagcaggaaaaaggatgactatatggagtcagggaccaagaaggataactccatcctggaaatccgcggccctgggctgcagatgctgcccatcaacccgtaccgcgccaaagaggagtacgtggtccacactatcttcccctccaacggcagcagcctctgcaaggccacacacaccattggctacggcaccacgcggggctaccgggacggcggcatccccgacatagactactcctacacatgatgcccgcccacccgggctgccccgcctcagccccagctgccctggcgtggccatgtggctttgcccagcctgctgcaatccaagagagcaaggaagagaaattccatgggtgactttcctccgcagaaagcaaagtttggggagggctgacgattttgtagaacacaacagtgacaattttttttaaaagaatagaaggcaggagggggaattcgacattgttgaagacataatttataccaagttatgccagttggggagggaaggactaaaaataatattgcaggcagggctgggttgggttttttttttttcccccctgaactggaaggatactacctgtacaacatctgtggacacctcatgctctgttcaaggccatcacaaaggaaccgccagggagaagcagccggctctcaaagctcccacgcagctctcccgccactggccactcgctggcgacccgatggaaggttttcaggctcctcacaaaggagagagggaagaaaagatcttttgccctggagatatggtcctgaaatctctcccctggcttattccataccatttcccttgcagatttgcagaaacatggcatctttcactgcattctttgaacaatcatgtagtcgattaaaaaaaaaaaacaaacttttttttcctaggctgaagccctcttcagttccatgcaccacgctccgtagaagccccggcggaagccgtagctttccctgccacctggaggtgcatctgtctgcctgtctatccctgtcgcggtgtctctaagtacagatgggtagatagagccacatgcacggtccttaccgttcttcttgggtcagttcttaccatttcctgaacaatagaattgtgaaagtgttaaaaa

SEQ ID NO: 53147 - DNA, 6352 bp, Homo sapiens
gggaggcagctgcagtgctgcgaggggtgcgtgcgcgtgtgcccagctcgcctgccgtctcccggctccgtctgcgctcctcggtgcgtggggcacgagggtccgagggccgggaagccagagcagcgcctctcgcccaggcctcgctttctctggacgcccggcagtccccggggctagagcgcacggggcggggcgcgagacccgggccgcgctccccgcccccgcctcttgcgccctgcctggctccctctccattgagttttcctgcctcgggtgcctatcaatggtcctgctcggggatgcacacgcagctcgcggccggaggggggtagcagccgccgcctccaggtgcaggttctctccggccgccgccgccacccgctgtcgccgcgactcgagccccgggcgcactgaggtcttggccatggggctgcggaggctgctgttgctggcgtgagaaggggcgacggagttgtcgcgctcgggggtccccagctgcctgcatggatgtcttcagctttgtgaagattgcaaagctttcgagccacaggacgaagtcttcaggctggccgcctccctcgggaacctggggcttgagccaggtgccgccctatggatgggagatgacggcaaaccgagatgggcgagactacttcatcaatcacatgacacaggcaatcccttttgacgaccctcggttagagagctgccaaatcatccctccggctcctcggaaggtggagatgagaagggaccccgtgctgggatttggttttgtggcaggcagtgaaaagccagtggtcgttcgctcagtaacaccaggtggcccctctgaaggcaagctgatcccgggagatcagattgtaatgattaatgatgaaccggtcagcactgcacccagagagcgggtcatcgatctggtcagaagctgcaaagaatcgatactcctcactgtcattcagccttacccttctcccaaatcagcatttattagtgctgcaaaaaaggcaagattaaagtccaatcctgtcaaagtacgcttctctgaggaggtcatcatcaacggccaagtgtcggaaactgttaaggacaactcacttctttttatgccaaatgttttgaaagtctatctggaaaatgggcagaccaaatcatttcgttttgactgcagcacttccattaaggatgtcatcttaacccttcaagagaagctctccatcaaaggcattgaacacttctctctcatgctggagcagaggacagaaggggctggaacgaagctgctcttgcttcatgaacaggagactctaactcaggtgacacagaggcccagctcccataagatgagatgtcttttccgaattagcttcgtcccaaaagatccaattgaccttttaaggagagatccagttgctttcgagtatctctatgttcagagttgtaacgatgtggttcaggagcgatttgggccggagctgaaatatgacatagccctgcggctggccgcattacaaatgtacattgcaaccgttaccaccaagcaaacgcagaaaatctccctcaaatacatcgaaaaagaatggggattagagacttttcttccctctgctgtgctgcaaagcatgaaagagaagaacataaagaaagcactttcacaccttgtcaaagcaaatcaaaacttggtaccaccgggtaaaaagctctctgcactacaagccaaggtccattatctcaagttcctcagtgacctacgattgtatgggggccgtgtgttcaaggcaacattagtgcaggcagaaaagcgctcggaagtgactctcctggttgggccccggtatggcataagccatgtcatcaacaccaaaaccaatctggtggctcttttagccgactttagccacgtcaacaggatcgaaatgttttccgaggaggagagcttggtgcgggtagaactccacgtgctagatgtgaagcctatcacgcttctgatggaatcttcagatgccatgaacctggcctgcttgacggctggatactaccggctgcttgttgattccaggaggtcgatatttaacatggccaacaagaaaaacacagcgacccaggaaacaggacctgaaaacaaggggaagcataacctccttggcccagattggaactgtataccccaaatgaccacctttattggcgaaggggaacaagaagcccagataacatacatagattcaaagcagaagacggtggagatcacagacagcaccatgtgtccaaaagagcaccggcacttgtacatagacaatgcctatagttcagatggacttaaccagcagctgagccagcccggggaggccccctgtgaggcagactacagaagtctagctcagcggtccctattgaccctctcaggaccagaaactctgaagaaagcacaggaatctccgagaggagctaaagtgtcctttatttttggagacttcgccttggatgatggtattagtcccccaacccttggctatgaaacgctactagatgagggtcctgaaatgctggagaagcagagaaatctctacattggcagtgccaatgacatgaagggcctggatctcactccagaggcagagggcatccagtttgtggaaaattctgtttatgcaaacataggcgatgtgaagagcttccaggccgcggaggggatcgaggaacccctcttgcatgacatctgttatgcagaaaacactgatgacgcggaggacgaggacgaggtgagctgcgaggaggacctcgtggtgggggagatgaaccagccggccatcctcaacctgtctgggtcaagcgatgacatcattgacctcacatccctgccccctccagaaggtgatgacaatgaggatgacttcctgttgcgttccttgaacatggccattgccgcacccccacctggctttagagacagttcagatgaagaggactctcagagccaggcagcttccttccccgaggacaaggagaaaggcagcagcctgcaaaatgatgagatccccgtgtccctcattgacgctgtgcccaccagcgccgaaggcaagtgtgagaagggactggataatgccgtcgtctccacgctgggagctctagaggctctatccgtgtcagaagaacagcagaccagtgacaattcaggtgtagccatcttgcgggcttatagtcctgagtcttcgtcagactcgggcaatgaaactaactcttctgaaatgactgagagttctgaactggccacagcacaaaaacagtcagaaaacctctcccgcatgttcttggccactcacgaaggctaccacccccttgcagaagagcagaccgagttcccggcctccaagacccccgctgggggcttgcctccaaagtcctcgcacgccctggctgctaggccagcaaccgacctcccgcccaaagttgtgccttccaagcagttacttcactcagaccacatggagatggagcctgaaactatggagactaagtcggtcactgactattttagcaaactgcacatggggtcggtggcatactcctgcactagcaaaaggaaaagcaagctggccgatggtgaggggaaggcaccccctaatgggaacacaacaggaaaaaaacagcaggggaccaaaacggcagagatggaggaggaggccagtggtaaatttggtactgtgtcttcacgagacagtcaacacctgagcacttttaatctggagagaactgcctttcgcaaggacagtcaaagatggtatgtggccactgaaggtgggatggctgaaaaaagtggattagaagcagcaacagggaaaacctttccaagagcttctggtcttggggcaagggaggccgaagggaaggaagaaggagctcctgatggagaaaccagtgatggctcaggacttggtcaaggggaccgcttcttaactgacgtgacctgtgcatcttcagccaaagacttagataacccagaggacgctgactcgtccacctgcgaccatccttccaagcttcctgaggctgatgagagtgtggcccgcctttgtgactaccacttggccaagcggatgtcatcactgcaaagcgagggccatttttctctgcagagctcccaaggctcttcagtggatgcaggctgtggcacaggcagcagtggcagtgcctgtgccacacccgtggagtcgccgctctgcccctccctggggaagcacttgattcctgacgcttctgggaaaggcgtgaattacattccttcagaggagagagcccctgggcttcccaaccacggagccacctttaaggaactgcacccacagacagaagggatgtgtccacggatgacagtgcctgctctgcacacagccattaacaccgaacccctgtttggcacattgagagatggatgccatcggctccccaagattaaggaaaccacagtgtagctttgacagagcctgggaaggagagacgaggaggcatgccttcagcttggtctcaacatcctgaagctgatcccatcctgctaccatcaaacattcactcggaatcaaaggtgccaattccaaatcaagaccctaatgatttctcccaagcaaatcaggcatacggagaggctgtgagctggcggccaccggatctgagaggggggagcctcaggacacctcccagccagaaggctctgagacatagcagcagtatcctctccggatctgtcgatttggagaccttccgagagagaaccaagggtgcagtcagcttaaagtgtccaggcatcacagaagcacaggaggccagttctgaaaggcgagcagaactccccctggggaggaagctcaccaaaagtttttcccaaagctcaatgcacttgagctctgaggggaggtttcacaaaaggtccccagtggctcataaagactcaaagctgtataggacattacccttgcggaagctggagggcagcaattggagatgccggggacccttcagctattgcttcctgaaccgagggcaggatgaagatggtgaggaagaagaggagaggggagaggccaccgtccaggtctcttgcctctatagaccacaggtgactcaagccatgccagaaccaagcagcccatgcctggctgtggcgattcagaagcaacgaggggagctatccagagggtcagtgctgaaggtctgggcagaagacctgcgagacccagatgacttggacttcagcaacctggcctttgatgcccggattgcaagaataaatgccctaaaggagagcacatatgcaatgcctgatgggttccttgcagcccaaaatgatgccaatgagctgctctgtctcgtcagggcaaccaaggagaagagggaggagtcacgccctgaagcgtacgaccttacactttctcagtacaagcaactgttatccattgagtccagacagttgggaagtgcctgtaggaaaatggcgatggctgagaaaagcccggaggagatgctcctagctatgacttccagctttcaagtgctctgttgcctaacagaagcttgcatgcgattagttaaagtcgtgaactcagaaacacagcggcaggaaattgtagggaagatcgatgaagtggtcataaattacatttgtctactgaaagctgccgaagcagccactggaaagaaccctggggaccctaatgttggactctcggcgcgacactcaaccaccatggccgctctcgtaagcacactgacacgttctctcaagaggcttttaaacaaataaatatggaagtcacgtcataatctacctttgcaaagccatacatgaacttttatttactttgtgtgtatgatgaacagatgtctcctttcttctctctgtatattttgttattttatataaaataggagataaaagtcacactgatgaaatgttgaaatgtactaatcagatgtattctgtttatattatacatatatatacacgtaaaagaaatatccaagaaagtgatgacatttggctatttttcatatagttaaaactccaggtatatgatgtgaaattttaaattctaccatgttagagcaaaacaatgaatcctatcccctttctttccaagtagctacttggaaaccatatcattcatatttagaagtaaaacacaaaacaaaaaagagagagaaaagaaaagaaatcacaatgtatataaaacagtacttatgttttaaaattatgatttttaagcattggaaatagcaaaaagacatttaaaattcaagaagctattatgaattactagagaatatatctgtaataaattaattttttgctcat

SEQ ID NO: 53148 - DNA, 4868 bp, Homo sapiens
gcctagggaggaggagcgagaatcagcctggttcagtgactgagacaaactggaggtgaaaggagctggtactgtccactgtgctgtcggtgctgaacctgagacgcgagcggaccagttgctccagcacctgaaggcaacgccctcttgcaccctctgtgccctgtgggacccgcttcaccaacaggacccatatcaacttgacaaaggagtgtggtatcggacgtgggagagagtcctctgtttgccacctgggcgctcattcaggcgtgactttggagatttctatagttttagactaaactatttttttttccccagctaagacgatcttttgagagtttttttttttttattgtgatttatatttccacagcgtttaggaatctttctgggggacttttgtgactgttaaaataaggtgaaaagcaataaggatgtttaagtgctggtcagttgtcttggttctcggattcatttttctggagtcggaaggaaggccaaccaaagaaggaggatatggccttaaatcctatcagcctctaatgagattgcgacataagcaggaaaaaaatcaagaaagttcaagagtcaaaggatttatgattcaggatggcccttttggatcttgtgaaaataagtactgtggtttgggaagacactgtgttaccagcagagagacagggcaagcagaatgtgcctgtatggacctttgcaaacgtcactacaaacctgtgtgtggatctgacggagaattctatgaaaaccactgtgaagtgcacagagctgcttgcctgaaaaaacaaaagattaccattgttcacaatgaagactgcttctttaaaggagataagtgcaagactactgaatacagcaagatgaaaaatatgctattagatttacaaaatcaaaaatatattatgcaagaaaatgaaaatcctaatggcgacgacatatctcggaagaagctattggtggatcaaatgtttaaatattttgatgcagacagtaatggacttgtagatattaatgaactaactcaggtgataaaacaggaagaacttggcaaggatctctttgattgtactttgtatgttctattgaaatatgatgattttaatgctgacaagcacctggctcttgaagaattttatagagcattccaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatccgggtgtatccagagagtcaggctagagagcctggggtaactgccagtcttaggtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagaccctagctaacatattatggagagaagaaggtctgggaattgggaacatgttctatgttttttatgaagatggaatcaaagtgatacaacccatagaatgtgaatttcagaggcacattaagcctagtgaaaagctccttggatttcaggatgaagtctgtcccaaagctgagggagatgaagttcagaggtgtgtgtgggcatcagctgttaatgtcaaagacaagttcatttatgttgcacagccaactttggacagagtccttattgttgatgtgcagtcccaaaaagttgttcaggcagtgagcacagaccctgtcccagttaaattacactatgacaaatcacatgatcaggtctgggtgctaagctggggtaccttggagaagtcatcaccaacactacaggtaattaccctggccagtgggaatgtgcctcaccacacgatccacacccaaccagtgggaaagcaatttgacagagtggatgattttttcattcccaccacaacactcattatcacccatatgaggtttggatttattcttcataaagatgaagctgcactacaaaaaattgatattgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaaaaaccctacgatacaattattgaatgaagcgttttacaatacattgcacttaatccattgtttaaatttacaacttaactttccaagtttatatcctagtcaaacaaaatttacttggttggtccaaataaaataaattgtttttgactaagtgactaagacatacacaattaattatattggttaattagaaatactcagcacaatatttaatgagaaatcacatcagtcacaagaatcaaatatgtaaattatgctttaaacaataaagtaggatttaaatcatttaaaaaactaaactgcagggaatttcagatgacataaagcattatttcattttgagggtagtttattttttttctctgtccttttggtatgattaaacaagaaataaaaggtgttgtggaaacttaaaattcttaattcaaaatattcggtcctgtccactgtttataatattttgtgccttgaagggaatgtcacaggaggaaaaggaagactaaagcctgcatactaaatgctctcataactataaatctcttgttgttaaaaaacatctcttgcaccaaatcctgtcttcagtcttttgtttaaccctcaatgaactaccaattgaaggcataagttggtcttaggttgtatacaggtgtcaaactccacttgacatttactgtataatctgcagcatgctatagaaagtggggaggaagggaggaaaaataattacagtcaaaatatttgcaatctatctactcattttgctttcaatcactagagtgcattatgtttttaatgcaagtttgtctgggatgtcaactgcctacagatgtttattactagcagaatagattatttattaatagattgtttcttttcatatagtccaatgtttcatcatcaggaactttcggttttaaaaaagaaacattacttttgtctgctaaagtaaacaatatatagggaaattaacacctaggaaaagaaaactggcaagagaattgatgaggtattagtggcttagaagaattagtaatataagttgggaataaaggggtagcccgacagtggtaagtaaaaatgtagtactccattgtttttgctatttaaatataatgtatcaaaaacctttattctaaaatttccacaaatgattccttttatccatcttcttgtaatcctaaaagcatcttctcactatgtgctgtagtttgaaacctaacgaatcctcctacttgagacactgtagaaaagtaaaaattgttgcttctgttttcttttaagaggaaatgagaaggccagcagaagtagattaaaactagagagctggtttattaaaataagcagataattatccaggcttaaagtaatagcttacatgttttgaaaatccttgtacttatttttgtttttattgttgcaaaaaaatgttaatgggctgttgaaatgacctccatttacttaaggtaatccaataaggtcttttttaaatatacaaattttactcaagtttaaattgtataaaactgcttagaaacctgaaattttatagtgtgtaatatcttatgtgtatatagcatcctgagctgtgtgatacagtagatttcttcttagcagaaacatgcgaggtagatttaataaacaacaaaaatcagcttatgtttctacttattgaatctgctttactttttagcaattttcttccttgtgaacatgaaccatataaagtgtctgtgacttaatgatttcatgtaagtctgtcgcatacatccttcttttgtagcttacaccatgtggatgctctgtctgtagacactgcttgataaaaggagaataaacctcttacattttaaaaaaaaaaaaaaaaaaaaaaaagaaaaaaaaaaaaaa

SEQ ID NO: 53149 - DNA, 713 bp, Homo sapiens
ccccacatcggtccgtcctgcttccagctgctgcagcgcgccttcgccgccaaagcatccagcagccccctgctccggcccagcatggcgaccccgacccagacccccacaaaggctcctgaggaacctgacccattttactatgactacaacacggtgcagactgtgggcatgactctggcaaccatcttgttcctgctgggtatcctcatcgtcatcagcaagaaggtgaagtgcaggaaggcggactccaggtctgagagcccaacctgcaaatcctgtaagtctgagcttccctcttcagcccctggtggcggcggcgtgtaacaccttcccgaggaaactccgctgccgaccctgcctgagcgcgggagcctgaggaccgggtggaggcggtggggacccagccgcgcgccgggagcgctccccggaatgagccgccccacccaccccaaggctggagccgctgcaccctgctgtccctctccaggccttggcaatgacgatcccccaaagagcccgtctgcaccccagacccagggcctcaggcctccagctcctgggatccgggagtccatcccggcccagcacccccagcatccccgtgtatggcccccctgcacctccttgtctcatccccgaagatccgtccccctggcccctcagtgtccatgtcttgagcttaataaatgtgcatttggttttttcctctg

SEQ ID NO: 53150 - DNA, 5786 bp, Homo sapiens
gccgcccctgagcagcctcgccttcgcctcccgcgtttcctgccgtccgccctcccccggccgagctccaggggctgccgcctagcagctcccggcgggagagcggttcagagcgcgcacgggggcgggcggaggcggcccggtgcggggcggccgcgctggagagaggcgcgcgcggagacgccggcccccctctccgcgtttgctcgcttgctccccgcctcccgcactccgctcgctcccaccccttcccggcgtgattgatccgtcacgggcgccgccgctgccgccgccgccgcggccgttctgagccgagccggaaccctagcccgagacggagccggggcccgggccggcgccattgcgcgggcgccgcgggaagaccttggcgcggggcggcgggccgggccaggccatgcgggccgagtgagccggcgcccgcagcccgcggcgcggcatggcttccccgcggagctccgggcagcccgggccgccgccgccgccgccaccgccgcccgcgcgcctgctactgctactgctgctgccgctgctgctgcctctggcgcccggggcctggggctgggcgcggggcgccccccggccgccgcccagcagcccgccgctctccatcatgggcctcatgccgctcaccaaggaggtggccaagggcagcatcgggcgcggtgtgctccccgccgtggaactggccatcgagcagatccgcaacgagtcactcctgcgcccctacttcctcgacctgcggctctatgacacggagtgcgacaacgcaaaagggttgaaagccttctacgatgcaataaaatacgggccgaaccacttgatggtgtttggaggcgtctgtccatccgtcacatccatcattgcagagtccctccaaggctggaatctggtgcagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcctacctcccatccatcggaggcgtggacgccagctgtgtcagcccctgcgtcagccccaccgccagcccccgccacagacatgtgccaccctccttccgagtcatggtctcgggcctgtaagggtgggaggcctgggcccggggcctcccccgtgacagaaccacactgggcagaggggtctgctgcagaaacactgtcggctctggctgcggagaagctgggcaccatggctggcctctcaggaccactcggatggcactcaggtggacaggacggggcagggggagacttggcacctgacctcgagccttatttgtgaagtccttatttcttcacaaagaagaggaacggaaatgggacgtcttccttaacatctgcaaacaaggaggcgctgggatatcaaacttgcaaaaaaaaaaaaaaaacaaaacaaaaaaaaaaactagacaaggagagaggcactagaactccagctggaagtcacggagtggctcgagcagccttgggaagaggcaaggagcttctgaagaaactgcctctgcacacacatcactggctgtgacccctcaggctagcccttctccactctgggggaggaggtgggaagggccaccaggcccccagctgccaggccagctgaccccagccttcctggaacagggagtctgcaggagcgcagacaggcacagccctggagcaggcaggccgagggctgcggcactggagcaggctgacttacatgctccacatgggacctgtgtcacccaatgagatgtttgttactctggtaaatgccacacgttaacacaataacacccattcctgggaccgtggggatttagggcacgtcactgcagacacgctctgcagcattcaccgacagtctgtcatgcacccaccacgttggccacgtccttgtgttcctatcggatgctcccagtaaccagggggaccacccgagctaatcatggaatgtctgttcccagcaaacacgataaagaaagattgtgcactttaacctctctcatcagggcccaagggctggctgggattttttttttttttttttcccactaactttgtttctgaccaaagtgaattggaggcattctgctaaaagacatccccgtagacataggggagagagttgctggctgagggcttcccttggcttccagaaggcagccttccatccagacaagccagtgagctctccccttgggatcactggggtgatcagtcagcagattgattctcattcataagatcattcctccctttaaattgagcccctaagagcactggcctgggagtcagacagacctgggttcaagtcctcagtcccctgcccactccctacgtgactttgatcaggtcactagtgtctctctgagcctcagtttcccctctgtaacttggggttgaactaaaacacctgtcctgcctacctcacaaggtcactctgaggattgaaacttgatcttgtccaggaaagctttgtaccaaacagtgaagccgccctgatccgtgaggtatgagtatgactctgaccttcagccctccctacagccgggggtgtggcccagagaagcttccagcacagccctctacccagaacatccgggctggagggaggctcccagtgacttttctgacattcctagacaggttcattctttgctcaagaaaggcctgaatgacaatgtccaggatgtctgcacaactgagcagctcgctcactccctaaagaaacctattggcagcttcaacaggcaggcaataatctcttcccagaaccactgcagtcaggaataaactgttttctccaccaggctttgacaaaagggcccacaggaatcttaccaatgccaacatttcaaagcaccctatttcacgtagcatagctttctgctccccttccccaaagagaggttatggaggtactgtagcttttagggaaaaaaaaaatgttaacacatcacaggtcaagttgaagtcattctctgtttaggcactaaaaatcggtgttgtcactcactgtgtattaccagtatttacttgctttcttgatttcaccaaaaccaaatttaatttaaaggaccacattaatttttcaaagggaaagagacaattaattgtacataatgtatacacacacaaaaaaaaaaatacctgtagaaatattattccagcatagcaggaaaacaaacaaaagtattggactgtcggaggtgagcctgtgcgtctgtaaccctttgtgactcctgagcgtgcgctgtcttctaggttaactcacgaagtacattctctgtcttactgatactgtaggttcacccatttttttttaatttcctcgcaaataacaagacccacagaagtgactctagctacttaatggttctgttcttttatatgcagcaaacacaccgtccatttctgaagaggcttcggcctgaaggcattttccaatgatgttagtgcacaaaacgctttaaattagactggaactgccagaatcaaatgtaaatgaggaatttctcgtacccctactgcatggtatcgatttttaataaattgttgcaaatttgtttttatgaataaaaggaaaaaacctgtcgtcttt

SEQ ID NO: 53151 - DNA, 3678 bp, Homo sapiens
gcacaattcagaggtaacagcgcctgcgttttctccatgataacatagacaaacagttgcctccaaagctgcagattggatattgggaagcaaatttgggtgtgaaatcttcagcaaaggagcacgcagagtccatgatggctcagaccaagtgagtgagaggcagagcgaggacgcccctctgctctggcgcgcccggactcggactcgcagactcgcgctggctccagtctctccacgattctctctcccagacttttccccggtcttaagagatcctgtgtccagagggggccttagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttggaagttatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaagccaaagaaagtaaaggatcctcttattaagaaaaacaacacttacgctccaacagcaaccagctacacccctaatttggccaggggcgacccgggcttagccaccattgctaaaagtgcaaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacagaatgagagagaaaagagggggaagatggttcaaagatacaagaaaaagtagaaaaaaaaataacacttaactaaaacccctaggtcatttgtagatatatatttccaaatattctaaaaaagatactgtatatgtcaaaaatatttttatgtgaaggtgtttcaaagggtaaattataaatgtttcatgaagaaaaaattttaaaaatctacgtctttattacacaaactatggtgtgcttatgtttttgttttgctttttaaactgatgtatagctttaacattttgtttccaaagctgaagatccccattctttctctttgaaaaaaaaaaaggcctaatgcattattttgtcataaaatgctattttaaaattcatggaactttcatacgtaaaggtgcagttgctcattgtagagcacatttagtccaatgaagataaatgctttaaatagtttacttcactttcatctgagcttttaccactagactcaaggaagaataattttaacagacatgtatactccatagaaactaaactaaaatagtttaaaaatattccctttttcaccctattttcagatagcacatgagcccaacactcacttaattctcattatgaagatgtttttagaggggcaaaaatattttgcaagctctggaattgttgaatgtattcttttatataactacattaaaagctttagattgaaatttatgactagcaaacaaaaatagaatatataaacgatatatgtaaatatacagcatgagattgtacattttttacttttttaaaattgtgttcttaaaatattgtgtaagaatcactgcacttagctgttggaatgttgttaaatgctatggaaatacatttagaacctgcatttaagaacagaacagcaagtatgaaccacatggaacttaaaacatatgggtgtgaagtccacttatgtagacaaaacttataatttccaaactgttgtctagtatacagtgatcagttgctctctgttcaagtcattccacacatttccctattttaggctattataatatagaaagaaaatgggaagcattagttggagctagaaaatgaactgtatattattgctatatttgctaataccaactatttcaataagtgttgtaccatatgtagcattaaatataaaatacataaaagaatgtacagaaaatagcttttattgagtaatattacatttcatttatactgtagcaatatatttgtaggtatactatgtaagggctttaaataaaagaggtccattaatacttccttataaaaattctagtctgtttcattactgcccagatgttttagagataaatatttatgcagaaggtatttttgaagtctccttttgtctgatagagtttaacagatatttaaatttagtgctcagaatccacaagtcacggtctaaacacacttagaatactacagcataaatctgttagcattattgccaaataagacagttgggatccaaacccaagtcttgagcaatgtttttctcaaaaagctgctatccaatgatataggaaaatacattgtgttttcctaaacacacttttctttttaaatgtgcttcattgtttgatttggtcctgcctaaatttcacaagctaggccaatgaaggctgaatcaaagacatttcatccaccaatatcatgtgtagatattatgtatagaaaataaaataaattatggctctaaaaaaaa

SEQ ID NO: 53152 - DNA, 11143 bp, Homo sapiens
gggctggctgagcgcgggcgagtgtgagcgcgagtgtgcgcacgccgcgggagcctctctgccctctcctcgcaccctgctcagggcatctgaagagcctggaaacgtgaacaggcttgaagtatggcatgttgcaaagatggtttctgccaagaaggtacccgcgatcgctctgtccgccggggtcagtttcgccctcctgcgcttcctgtgcctggcggtttgtttaaacgaatccccaggacagaaccaaaaggaggagaaattgtgcacagaaaatttcacccgcatcctggacagtttgctcgatggttatgacaacaggctgcgtcctggatttgggggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggtgaatatattgttatgacggtttacttccacctcagacggaagatgggttattttatgattcagacctatattccgtgcattatgacagtgattctttctcaagtttcattttggataaataaagaatcagttcccgctaggactgtatttggaataacaactgtcctcaccatgaccacactaagcatcagtgcacgacattctttgcccaaagtgtcctatgctaccgccatggactggttcatagctgtctgctttgcttttgtattttcggcccttatcgagtttgctgctgtcaactatttcaccaatattcaaatggaaaaagccaaaaggaagacatcaaagccccctcaggaagttcccgctgctccagtgcagagagagaagcatcctgaagcccctctgcagaatacaaatgccaatttgaacatgagaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggtttattgggttgtttatttatctaaggacactatggagaaatcagaaagtctaatgtaatttcgttgctatagtagtttgctaaaagatgatgaaaatgcagaatgtctttttaaatgtttttaaatataaacaaatattctttactaaaataaaaactctgtgtaatttttccatttaaagatataagccagttattgggagagttaattaattcctgagtgaaaaagtgaactatgttttttttcagaaaaattattttaaaagaactcagcattcagttagatagaatacacaccatcctggaaagttgggataagagaaatagagctattagagacaagtggcgcatattttttcattgatatttgaaaacagactatgacattttaaaaatctgccctatgagtatcaacctgccaccctaaatttcccagtggcactacccttaaccagaattgtttattagatgtcatatgcagtgacctttggtgatcttcttaggaacttcaagaaaaggaattttcctgttaaattaaacattggcaaaaggaaatggaatagtataaacactgatcaatagagtaaaatatctgctgcataaaaaactaagacaaagaccagaggaaatatcttccctttcttatgttggctaaacagtacttaacagttgacttgaaattttgttctctgagccaaagtttaactcattgtatgaattctttttcatggtagttcattcagttatgtgtttatttactacatagttattcagagcctactgtgttccaggaactatgctagaaactgtctctctaggaaagctcttgcacctttatctacaatattacttaaaaagtagaacagtcaatgcatgccaaagaaccataaactagcagaggacattgcattctttagtgaaggacatttatttagagtctgacaacatattcaaaatatttttcagcctctactgatagtggataacaaatatatttgttcacataaccactttgatgtcagtacaacttcagcaattggttttcaaaatagatgagaatatggtacagattgttctataagtgaaaagcattatgtacttgaaagtaaaaatcagggcaatataagacttaatagattaactgtcgcaaatttgatcagagtcacagagtagaatttgatcagaatcacagaatcatcagacataggaactgagcacaggctttttcaggtgctttccccaagatagatctagatattagctagtgaaatgctaaattttgaagagttttgtgtccgtagttctgtaattctgggcagtcatcatgttggtttttttgggagtttttttaaggtttaataactaaggggaatattttaaaattaagagagcagcaaatgaaaggagtaaagaaaaaaatagctgtcgggtaggatgccactgactctgctatgtgatttatcagggttttcatctactgacttctttctcattaggtaggcttaacaacttacttgagaattttgcaactgtctatgcagctgaatctaagtatggttttttgtcatattgcctctagattttcttctgtgcttctctctatctgctctggaatggatgagtgaatgtgttctgggtgttttagggaacatattgatagaaatgaccaccttgcagacaaaatctctctctctctttttgtttttatagaaaagaagtgatagtagttaattggcatcgatttttcagatattgcactaccttataatggttgtttttgatacctgaaaattgtgcaaatgccaaatattaattgtaagtcatatctgagaaatcattcttggctgtctttctaggtattccatagaatcaacacattttaaggctgaaagatactgtcgaaatcacccagtcccaaccccccaatttaaaattgattctagtaaaattaggtccagtaacacctgtatatatgtatatatttaataaagagtacttgtacaaaaaagcttatcataaattatttcatgaatgtgaatagatttctggccttgaggacgatgtttggaaatatggttggaagcacaattcattcgctactagttattcagagcgtactttgttccaggaactatgctggaaactgatagttcactattctgatgaaaaggctggttttgttgttgttgttgttgttgttgttgttgtttttggtgaggaactcttactctttgctaatctattggcctatcttaagaaataattatttggttattcattggcttcctttaaaaaaaagtgttcttctacaaatcttacagagtgtaaagagataaaaagaaatgattttttttcttacctttacatatgaaggtttaaaaatacatcatgtggccaaagaatgagaaaggacagaattaaccaaggattcttaattgttaatttgaagaacacattaaccagaaagcttaaacattattattaaaataaattatttcatttgcacacaatgataataatgatgataataataataataataataataataataataataataataatatgttgtttgctttccttaactgaatttcatcaaattcattcagtgatttttattttggtcattatttctatcttcccaataacccagaggtacatcaagtaaaaacacttttgcaaagagccagtcacttttccctcttagaaaatctcagaagaatgattaggggcacccaaagttctggttatctatgaataataatgaataattttggctgagaatggtacctttatataactcttttaaagatgaaattcagaataattttattcaggacctagtatctgcagtccatgttggccactaactgctacataattactttcaatttcctccaggcatgactaggtataaacatatatttacatgattaatccacattttaaaatgacttgcacttgtgcatatacatagtactttgaataatgtatattttaaattggacctcacaaatcttgtattaaagtaggtagagagtagagtcacactttttttgatgaaatgagtcacagagaagttacatgacaaagataaaatcacagggttggaaagaactttgaaaggtcatttttcaataatctcaccttaaaagtgaccccttttcaaacaaagcataaacaatttatttgtggcttattttacccatgagctggccaatacttcctggcctagaaaaatatctccactctccccattcctgttcttaatggtcttctcttctcaatttgtaaatattctccagtaaaagacaccaggtgtggagatgggtcacttaatttcaagttctgagtgtcttgtggttttaaacaagtctcttaacctctctaagactgattcctcatttataacagggaggaggtggattatgtaatatctaagagcttttcagttttaatactctctgattctcatagtaaatacaagcatactcttgtaagaaaaacactgaatactttgaaccacaaataagtgtttatggacaaaaatttagttctactgcttgattactttaagttcattgcttgcttcaaactaaggtttccctaccttcaaaaatatatataacatctctccatttagataaagtatattcttccccagggaagactgtattctttaaagacagtagaatattggctatttctcttttctgggatttcctgggcttttattcactaaatgggctcctgcccagtttgggtactgtgctgatttttagatatacagagataaaaatagcccctttccttgcaggtagtcacagtccggaagagatgatagatgcatagacaaaaaattatgggatgtaactaatgcttcagtagaatacagcagggccaaaactagagtgatactcatctcaggcacaaatatatatggggacatcaaaacttcaataatcaagatacctaatatttaagtgaatatttttaaaactcaaaattaatgcaaaagatttatgatgaacagaatatacaaattttaaataaattaatagaatcagtagtaataatattttcttctgcctcaggctccaaaattgctcagcatagcactgatctagatagaggtggataaaagatccacataacttaattacattgttgaaggagaggaacaagagtgatagcagagaaggtttcacagatataatcttaagctaaattttatagaatgatttggagttcttatagcctccattcccacttccacaaacaaacaaaaaaatgaaagcgcaattttatcagcacctgaggcaggagaagagatgaggatgtggaaagtcaaggggaactcttactacaaattcttagttctgtgtttggaggtaagggtgaatgcagggaagtgagagttgttgatgttggaaagacctaaagagcctggattaggaagagttttgtgtaaattactgaaggaatggaatttgatcaggattagtggcaatttattaaaaatcttgaagaataatacgatgaaaactaacatccttatttttctgttttagagaaagcacctgattattgtgtgaactatggtttggagggccacaaatctagaggtagtggaacagttgagatctcttattttttctttcctgtcttaaactttgccttctattccttttttctttttttgaccgcaatgacttcattgtcatttgtaaaagtgatacatgactgttaaagatagacattgtagaaacttaaaaacaatctcaaaattctaccacccagaaatcagaaatattttgtatttggatatgtttgtctagaagagtagattgcttgattaaaagacagagttttataaatgtagaagccaatatgacatacatgctgccattaaataataaaaaattaaattgacttttatctcaagataagattaaaattggagggtaaaactgaagaaattgttgaaatttggatggtgcttctttaaagcaagagatttagagagtcagagctttttatcccaggtttcaatctttatttcaggaaaattttctgcaattttgtctaagttaattttttttttttaagaaatgccaattatgtcaaatcccttttgtctctatacaatagtccccaactgttttggcaacaggcacgggtgagggtgggggaatggttttcagatgaaattgttccatctcagatcatcaggcattagtcgattctcataaggagcggacaaccttgcatgccctcctatgagaatctaatgccgccgctaatctgacaggaggcagagctcaggcgataatgctcaatgggtgccactcacctcctgttgtgctgcccaattcctaacaggtcatggataagtactggtcagtggcccaggggttggggaccactgctctgtaactatttacagtattctttgtaactactttggtatctttaaaattttctttaacttttgtcaaccataaccctagtgagttttcagttgtgattattctattttgtaacttccaatgtacttttcaacttcataatggttaattttgttttccattgctttcttggtcactgtcatttcatttttcttctctttctctatttttaccattgctttattgaaatatcttctttgagcttctcatgtttctctattaatgagatcatgtctataatattttttgagactacagagacctatttatataaactcttcctctatttcttgaaaaagtttttatctggcgtgagcttcatctgctttttcattgaggttttatctcccttgcctatttttggggctggtttctttctattaatcactgagcagagccagctatttactgaactacagtgtgggaagtggtgggagggtgagtcagatcagcccacagaagctatttaaatttcaggtttcaagcccacctccccaaaaccgttttatgtgttttttcttctgcccaggcaccatatttttatatctatttttgacatttgggcggcctatgtagttcacagtgtaaaactctctgttttactttctttatgttattgctagtgattattgcttgtagtcccacccccttccccacattagccttagtattctatattattcagcaagcttgttcacaactctcaaatatagtctatcagaatttttatctttacctctacattccactattcggaagtatatagtaaaatcgtatgaagacagattttgtctttttcttgcctgtttacactctatcttacagaggtttcaaacaaaccatctttgtttgaaacatcgcaggataatgatacttattgaaatctacatcctgcccaagatatatgccagtcaatttcctttctcctattagtgcaaatggctacctacttaaaagctgctgactatagtttgtcatcaattacttgttaattacagatatggttttcatttttttttctcaatttttcattatgttatttttggagactgtcttaggtggggagtgaattataaatatttttatttcaccacctttaactgagtcaccatatgttatttgcacttccaatagaccagggattgaccagagtatcttttactgatatgaccaccagagctacatggcttttaccttctgtatatcagatgtcactggaatcaagcattaaacctagattaaatctggattaaaccagctgtatggcaccttagaaaattgagaaggactaggaagctgatagaaagaactcctgtataaaaaataaattctttttacattttccttggtagtatttctgcaagcttctttagtttctataggggaatcccagagttttcctctgagattgcttccctttcctttgtattttcatttttccctcttgggctttacttttcagtcgtgtatttctatcccaatgttaatttattacactgtttatattttcctgtccttcaattcatcagtagattagtgaagtacttattcctttaattataagtataaacgtttttaatttctttttggataacgatacatttaatggaaaatttttaaatgctatggtttcttaatagcttttctctaccactaattacttccgttaaaaaaaaaaagaaatacccatgcgtaatataaaagaaattttgaataaaatgttatcctttccttttactagagacaaacatctccacttcaaaatggaaaaatggaactatgcaaaggaaatttacgatattcaagagtatgatattatcactgaaccgattaatttaattgaaaatactaacctgcaaaaaagaattacacaaatgtatttgaaatgtcatcagatacctcaagctatgacagagttgattatgttacacaagtagtaaaggataaattaaatatattctatattaacactaagatttaaaactaattatagtcttctttaatttttctactgtatacatttcatctagttttcagtaaaacaaacttttcattacttttacttatcccatgcaaatctagttgctataagatataacctaatttggaaatacctccctgtaatacattggaattttggtgtgagtgtgtgtgatcagagaggataaacaaatggtgtcagcaaaatagaatgtaaaatatggagataatgtggatttacacaatttgataaaaattctcccttgaattttgcagatcatatatgaatatcatcatgtgaagtgcaattaggattttttcatatattaatacatatacatcatctctttaataaaatattttgctgaactcgtttaatatttctcatgtctcatatttcatattttctcatatgtctcatattttatattttctcatatgtgtctcatttttattattactatagtatccattaaaggagactggcaaatacctgaacaaagttatgttgttggcaatataagatattaccaattgcataatattatttccaaaggcaaattaatatgcaaactatagatttccatgggtatctatacaaattattacttgaagtccatagaaaacagcttccttagagggaagtaaaagaagctctgataacagacaatgtatagcatttcagttaaagtttgattgacatatttttttctcagtcttttatacttgtgaattatagtctacattttgtctttacagatgttgctaacacagtgcagcatgttggcttgtcattttactgattatgtatattgtctcctagttcaagtatacagtaaatcagagctttcatttttcaaggggcagaaaaataattgttggttgataaggtaaggttatatgattttgagggagcttcattgtaaattgaatgagaatccggttttcatgcaaaggtgtatctatgcgataatactttgaatgtctgtagtttgaaatagaaggttaattttttccactggcttatccttaatgaaggaaatcccctgataattactttgattctgaaaatgttgaaaactccagaagaaataaagcttttctttgatttctcagctgaagtgttgtacaaactgaggaatatgaagtccattcccttctttcttctcttgaataattttaaaattgtttgtttagttgtacaattgaaaatattccttattatagaagtaaaaaaacaataatgcatatttcctcatatcataaaaactaaatttgttatcatctgagcttcaatattcttgctcaattagaatagtaaatataaagtgtgatatttataacagttcaaggtttgataggagatagaggtgttttgattttatgggaaaattacttcctcaagaacacatttcttgaggttttagtaatcacatttgactccctgaaattggcaattttattcaatgtaggaatattatcatggtatattatagtgaggagcacatagtcattattattttgtttttgcaaatttattttgaaaaaaaggagcattatcaaatattggtttactattttaaagtaattcatcaggaaatgattttttaaacactgtccctttaagtaaatgtcccttgcttttcaaagctcaacttattacttatggtaatagagttactttgcttcttaaaacaaagtttatactagagcatagcattgtagaattattcaggtctcaatttctcactggaaaatgagtctttaaaatagtaaggatttaaatttctataaaatttaatcacagatacttatattttaagataaatgtgttggagctaaactctggaattattaaaatataaaacattatatccctctaatgtattttttctatttaaatttaaaacaataaacataaatatctttggaaaaaaaaaaaaaaaa

SEQ ID NO: 53153 - DNA, 1925 bp, Homo sapiens
ggtccattcgggaattactgcccagcagccgactaagttgcattccttgaatcttcgcagaaaagacaattcttttaatcagagttagtaatgtggacagtacaaaatcgagagagtctggggcttctctctttccctgtgatgattaccatggtctgttgtgcacacagcaccaatgaacccagcaacatgccatacgtgaaagagacagtggacagattgctcaaaggatatgacattcgcttgcggccggacttcggagggccccccgtcgacgttgggatgcggatcgatgtcgccagcatagacatggtctccgaagtgaatatggattatacactcaccatgtatttccagcagtcttggaaagacaaaaggctttcttattctggaatcccactgaacctcaccctagacaatagggtagctgaccaactctgggtaccagacacctactttctgaatgacaagaaatcatttgtgcatggggtcacagtgaaaaatcgaatgattcgactgcatcctgatggaacagttctctatggactccgaatcacaaccacagctgcatgtatgatggatcttcgaagatatccactggatgagcagaactgcaccctggagatcgaaagttatggctataccactgatgacattgaattttactggaatggaggagaaggggcagtcactggtgttaataaaatcgaacttcctcaattttcaattgttgactacaagatggtgtctaagaaggtggagttcacaacaggagcgtatccacgactgtcactaagttttcgtctaaagagaaacattggttacttcattttgcaaacctacatgccttctacactgattacaattctgtcctgggtgtctttttggatcaactatgatgcatctgcagccagagtcgcactaggaatcacgacggtgcttacaatgacaaccatcagcacccacctcagggagaccctgccaaagatcccttatgtcaaagcgattgatatttatctgatgggttgctttgtgtttgtgttcctggctctgctggagtatgcctttgtaaattacatcttctttgggaaaggccctcagaaaaagggagctagcaaacaagaccagagtgccaatgagaagaataaactggagatgaataaagtccaggtcgacgcccacggtaacattctcctcagcaccctggaaatccggaatgagacgagtggctcggaagtgctcacgagcgtgagcgaccccaaggccaccatgtactcctatgacagcgccagcatccagtaccgcaagcccctgagcagccgcgaggcctacgggcgcgccctggaccggcacggggtacccagcaaggggcgcatccgcaggcgtgcctcccagctcaaagtcaagatccccgacttgactgatgtgaattccatagacaagtggtcccgaatgtttttccccatcaccttttctctttttaatgtcgtctattggctttactatgtacactgaggtctgttctaatggttccatttagactactttcctcttctattgttttttaaccttacaggtccccaacagcgatactgctgtttctcgaggtaagagattcagccatccaattggttttaggtcttgcatatcagttttattactgcaccatgtttacttcaaaaagacaaaacaaaaaaaaaattatttttccagtctaccgtggtccaggttatcagctctttaagagctctattaattgccatgtttacaaacaaacacaaagagagaagttagacaggtagatctttagcagtcttttctagtttccctggatttcactgatttattttttagggaaaatgaaaagaggaccttgctgtccgcctgcactgcttcctggtaaactataacaaacttatgctgcc

SEQ ID NO: 53154 - DNA, 1882 bp, Homo sapiens
gtcccgagcccgccgcggcatggacgcgcccgcccggctgctggccccgctcctgctcctctgcgcgcagcagctccgcggcaccagagcgatgaatgacatcggcgactacgtgggctccaacctggagatctcctggctccccaacctggacgggctgatagccggctacgcccgcaacttccggcctggcatcggaggcccccccgtgaatgtggcccttgccctggaggtggccagcatcgaccacatctcagaggccaacatggagtacaccatgacggtgttcctgcaccagagctggcgggacagcaggctctcctacaaccacaccaacgagaccctgggtctggacagccgcttcgtggacaagctgtggctgcccgacaccttcatcgtgaacgccaagtcggcctggttccacgacgtgacggtggagaacaagctcatccggctgcagcccgacggcgtgatcctgtacagcatccgaatcacctccactgtggcctgcgacatggacctggccaaataccccatggacgagcaggagtgcatgctggacctggagagctacggttactcatcggaggacatcgtctactactggtcggagagccaggagcacatccacgggctggacaagctgcagctggcgcagttcaccatcaccagctaccgcttcaccacggagctgatgaacttcaagtccgctggccagttcccacggctcagcctgcacttccacctgcggaggaaccgcggcgtgtacatcatccaatcctacatgccctccgtcctgctggtcgccatgtcctgggtctccttctggatcagccaggcggcggtgcccgccagggtgtctctaggcatcaccacggtgctgacgatgaccacgctcatggtcagtgcccgctcctccctgccacgggcatcagccatcaaggcactggacgtctacttctggatctgctatgtcttcgtgtttgccgccctggtggagtacgcctttgctcatttcaacgccgactacaggaagaagcagaaggccaaggtcaaggtctccaggccgagggcagagatggacgtgaggaacgccattgtcctcttctccctctctgctgccggcgtcacgcaggagctggccatctcccgccggcagcgccgcgtcccggggaacctgatgggctcctacaggtcggtgggggtggagacaggggagacgaagaaggagggggcagcccgctcaggaggccaggggggcatccgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcgcccggcggcagctgcccagaaacttcctgggagaaagagccctcgggctgccttcccctctgcgtgtttcgaagtgggatgacagtcggccacggaaaacaagaggaagcctcggcctccctgagctctgaccccagcctcacccgaaaggccagcctggggctctccggcaggcagcccgagacctgcacagatgaaggagcagaggttctgaccgagaggctgagccaggccggggtctgggcccttcagggagccgcggatttttatgttcagaaagtgatcctggtttctaggtctttgctctgcaggatcgggatcagagcgtgggaggaggtgggggtggacgtccatccggtgaacagtgaaggcgtttgtgaggtctttctggtcccagcatgaaataaagccttggcctgggggccgcttcattcaaaaaaaaaaaaaaaaaaaaaaaaaaaaaaaaaaa

SEQ ID NO: 53155 - DNA, 6769 bp, Homo sapiens
aattctgctgggagtcgcatcctacctgtttgggaggtgcactgcctttccacactctcccttctgtactcagccagctgctgctgaggtgggaggaaaagtcctggctgggagaattgagctagtgcagcacacgtaaaaaagcgattccgatgggtcctttgaaagcttttctcttctccccttttcttctgcggagtcaaagtagaggggtgaggttggtcttcttgttactgaccctgcatttgggaaactgtgttgataaggcagatgatgaagatgatgaggatttaacggtgaacaaaacctgggtcttggccccaaaaattcatgaaggagatatcacacaaattctgaattcattgcttcaaggctatgacaataaacttcgtccagatataggagtgaggcccacagtaattgaaactgatgtttatgtaaacagcattggaccagttgatccaattaatatggaatatacaatagatataatttttgcccaaacctggtttgacagtcgtttaaaattcaatagtaccatgaaagtgcttatgcttaacagtaatatggttggaaaaatttggattcctgacactttcttcagaaactcaagaaaatctgatgctcactggataacaactcctaatcgtctgcttcgaatttggaatgatggacgagttctgtatactctaagattgacaattaatgcagaatgttatcttcagcttcataactttcccatggatgaacattcctgtccactggaattttcaagctatggataccctaaaaatgaaattgagtataagtggaaaaagccctccgtagaagtggctgatcctaaatactggagattatatcagtttgcatttgtagggttacggaactcaactgaaatcactcacacgatctctggggattatgttatcatgacaattttttttgacctgagcagaagaatgggatatttcactattcagacctacattccatgcattctgacagttgttctttcttgggtgtctttttggatcaataaagatgcagtgcctgcaagaacatcgttgggtatcactacagttctgactatgacaaccctgagtacaattgccaggaagtctttacctaaggtttcttatgtgactgcgatggatctctttgtttctgtttgtttcatttttgtttttgcagccttgatggaatatggaaccttgcattattttaccagcaaccaaaaaggaaagactgctactaaagacagaaagctaaaaaataaagcctcgatgactcctggtctccatcctggatccactctgattccaatgaataatatttctgtgccgcaagaagatgattatgggtatcagtgtttggagggcaaagattgtgccagcttcttctgttgctttgaagactgcagaacaggatcttggagggaaggaaggatacacatacgcattgccaaaattgactcttattctagaatatttttcccaaccgcttttgccctgttcaacttggtttattgggttggctatctttacttataaaatctacttcataagcaaaaatcaaaagaagtctgactaaattcagtagaatcttttgtgcttcagtaacttgaagtttaaatttaaaatgcagagagaccaatggttaaaatgtgaatagtattgtaactattttaaggccttcagaagtaaataaagtagcagctttcaggctaatttacgtgaaactgattagttgcaaaatccagtaggttaaaatactcacatatttttacttaaattttctttaatttacttatatgttattataattttgaatttttaagttctatgattcatgttttaaagatggaataattttaatacatattttgtttaaatataatctataattgttttgtaatgtaagactaattactaatatttatgtagcaacttttgtgccagaaaaaagactgttaatttgttttttcttgcttttcatttgattaccctgcttgaaatacagttagttgataacataaagccatagttttcttggattttcttccaagatattgtattcccaagaagaaattgatttatttttaaactatcagttactgaagacttatgaaaaggtcaatttttacctgtcttttaatccagtccattttctgacacaatattaaacagaacgccagttgcatttactttggtgatttgcaaacttggaatgaagccaccagtcattttttaagaatgcaagatgaaaaaatcaggtaaaatctaaccattttattctctgcttcatagcatttataatgtatgatgaggttaacactgaaatattaaaatctgcaaatgcacattaatgcaaattaaatgcagagagaaatgattatttttttctttatgttttatgaaagtgttgcagtccctaaaataaaaatattgaggaacattgcttgtatttactcacgtggttaaaaaattattacctggcaaactgagttgccggtcatattgaggacaaaatcttaaatatgtgctattagcattgtttttagactagtaatatgcagaaaacagttttaggcctgcgttacatattgcctcttccagctccaaagttttggaccctgtcagttttgcaactacattatacattattataatattcttttttttttctagaaactgggggcagcctcaaaatcatgttaaagagggagttttgttagaggcatctttaatgaacatgaatgtgagtgctctctaaattcttagcatctcactggatgtaaaatctatcagttaatagttttaaaaatgtctcttttgttaagaataaatttaggcttcaatcattataatcctgtaagtagcttgacataccaattgtttataagattcatcacataaatttctggagaaccaccaggtttagcttggaaataacctttaaagattgtttctgttgccaagaccaatgaccatgatgaagagttttatgatcacagcctatcttacttaaggtttgagaggaaacctgtcacctctgcaattgttactctagtttttaatgttataattccgctgcgtggttagtgaatgtctggcatgattatacacgtgtattggaaatatctagttttttaaatttttaattaatttatttataatttactgtgtgttcccagctaactctattttttttttcacttgctcataaacttctggaaaaaaataagcatgaatcaaatggtaatgcccaatatccaccgacactgcttttcttgaatgaacagccaaactaaactttggccatctatatattcatttacagattattcatacattcattttaataacattgagtactgatggatgttttgaaagtgagcattcatttaaggataaataaaaaataaagtagtaataaagaataaaatactttactaaaatattgtatggctattttcatgtttgaagctatagcttactatcatgagacagttttgattttgggactctttcaagtgtatctgagcatgactgtattttaaaatacttaaaagtgcttgatataaatagcttttccttctgaaccacgttctatgtaaaagaaaaaaaatagctttgattttctcactggtgtttcattaacttggttttaaatgttgacaatatttacaagtggaaataaaatttgtaaatatatgaaagatgcctttccttgtatataccatcaagcaagcactttgttttcaaagcaagtggtattttgatcagttttatttaaatgtgtgatcagaaagaatggcgtacaaatcttattatttctaaaaataagaataaaaaggtaaaactacatttagacttctttctcaagaaatcaaatacagctttttttcaaagctgattcagttcatttcctgttcctctattccaagtataagtttcaccaccttgagaaataatttttttaaaaaatcttcctctttctctggggagttatataataatttattgaatttattggaacttgattttcctggatgctttcaatgtttttaatgctaacatagaccccaaaattagatataaagaattgggaaggatacctggagcacaaggaataagatcatttgtaaaaatgtttgtttatatagacctatcctctaaatatgtgacaaggatctagaaattctgagaggggaaaatgtgattttggatttacaatgacagggtaatattttatttatcttcgaattccatggacaaaattaggctcacttaaattaatttttgtaaacccaagtaagttctaaaaaaaagtaaaaaatacatagaatacttgagaatttagcagggacagggaaaaatttcccagtaagtctgaagtcttgatgtaagtgggaattagataactaattggaggcattttattttaagttaaagacagatttctttaataagtttttaaaattgatcaactttaaattaagcacagtaaatgtgtataaatatgaaggcaatcataaggattttttcacttgtgtttccatattctggcattagtatatcatcataaaatagacaatgtttttgtctcaagaacaagaataaaattgaaatctgcattcatgccaattcagcataaaaaagaataggctacagttctctcacaccaagggccccatagttataaatgtgaaattatattccaggtcaaaatttgtgaaaaatacacaaaacactttgattttacaagagaggagctttaaataagatgattttagtagattgaaataaataaccagtatttaagtaaatgtataacgaatgaataaatacatgcataatattttcaaagttctataccagtacctatttttactcttacaaaatttcctgtaaaaaaatactacatttgaaattatttcattggttttagaactggcattgaaggtacccagtagactcttaagcctttactgcttgtctcactagaaacatttatttctgacctaccaagttttcttcacatcatcaaatttattcagcttctcagtgctgtaccgtatgatggcaagacatacttggtatttccatttttgttggtcattctttattgctttttactgctaggaaggtcttgccaggcttctatacagttacaaaaaccattaccaaactttatcaaggactttccaaatggagttttcaaatactattgaccacattgctctagttaatgtaaggtcagctctgactttttgtgtttgcatttcggaagtgaggtaacctcattcaaatatatatgcagcactttctgtgtacaaagtactgttctaaatacaaaagggaatataaagatgactttcaaggaacatataatgtagtcagaaagatgagaggattagttatacaatttaaggaagggaggataactttgggaaggttttgtggaggatatgtgtttagagatgcgagctggggattcaacaggtaagagggagagagatcacaatttccaactgggtaaacagcttgaaaaaagaaacagaagcctgggcacaaatgaaaattccatattaattggaagttaagattcatatagagacaatgaaaggttaggttagaacaataaactgagaagtacgaatgtggacttcaggaggctaggggaaattacgaagtcataaaaagttcacagagatacttgagtacaaaagatacattattaaaatttctgcagaagtttcatcttatttgtgtgtgatggtttggaatataacaagccagttaggcgtataagcttatagtggctaatatgaggatgaaatccgtactcttgtgacacaagtcttcagcggagatgggggatgataggcccaaatagaaagaaaagtggcagacattaagctttgactaacagacaacataactgagagacatggtgtgttgggtggaagggatcctgtagtagatacttgcttgcatgtagatgggtacaaagacaccataaggaaattctgaatgtaatacaaaggcttatttttcctgttgatttatctttttcacacataaaagatgaagaaaaaaataatctgaaatgtaaatcctaaagtgatctgtctagattcttattttttgaaaaatgttcctcactaaaagagttttctattcaaataaccatttccagttttctaactgagacatacatacatatatatatgtataaaattatatatatatttggacaaagagaataagagaattgcaggtagaaatagtctactgtgtgtagacaaatccagaaagttgatttctgttcctcaaacaatttctgaaatatttatgtcagaataaataaaagaattgttattgttggacaatgaaacatacctggaccctttgagtgtgtgaatagtaaaggctgtgataactgaaatgcagctaagcaaaaagggctaattagaagacttttgagacatgatttacctaaatggaaatagtttggttttcaatccttcactgtaataacaattatttgcatctattaagtgtttgtagtcactttgtataataaagttttatggcttgtgattataatggcttctgttattctgctactgcctcattgttttgaggaacatttgtaattttgtggcaaaggtgtctcaatttttcagtgttctttactctcatgatccttagaacaaaaaaaataccagtaacttgttataaataaagagtcacattctcttaaa

SEQ ID NO: 53156 - DNA, 1741 bp, Homo sapiens
ggcgcttctgaagacgggtgggcagacgatggaggacgaggctctgtcccgcccctgcagcttccttcgttccggccccttccagcgaagggcaggctccgagcagagacaacagacagaaacccagaaaccacctgccacgatgtgaacctgatgcagaaacgcggttcgctccctcgggatgcaaaggccaacttcagcctggcacggcggcgccgcggactccaccatcccggggaaggagccggacccctgtgtggcagtgtggcggcagcatggaggtgctgccctgctcccgcgtggcccacatcgagcgcaccaggaagccctacaacaacgacattgactactatgccaagcgcaacgccctgcgcgccgccgaggtgtggatggatgacttcaagtcccacgtgtacatggcctggaacatccccatgtcgaacccaggggtggacttcggggacgtgtctgagaggctggccctgcgtcagaggctgaagtgtcgcagcttcaagtggtacctggagaacgtgtacccggagatgagggtctacaacaacaccctcacgtacggagaggtgagaaacagcaaagccagtgcctactgtctggaccagggagcggaggacggcgaccgggcgatcctctacccctgccacgggatgtcctcccagctggtgcggtacagcgctgatggactgctgcagctggggcctctgggctccacagccttcttgcctgactccaagtgtctggtggatgacggcacgggccgcatgcccaccctgaagaagtgtgaggatgtggcgcggccaacacagcggctgtgggacttcacccagagtggccccattgtgagccgggccacgggccgctgcctggaggtggagatgtccaaagatgccaactttgggctccggctggtggtacagaggtgctcggggcagaagtggatgatcagaaactggatcaaacacgcacggcactgaccccacctccgcccggacccccacagacctcgggaaggcgctgggccgagccagtgtggctgagtgaccggggtgtgcccggcagacacagcaggacagggctctatgtgcggccaggacagcagaggctgaggggccggggtgtggctgagtgaccagggtgtcacccactgcatctggagtacagcttctcctaggacaggcggctctacccgagggagggcgtctggggacagtgatgccaactcaaacacgtgccttctccacggtatctcctggccaggctgctgggacagccgccgcctctgcatgtaccacagccccccacgccccatagggaggccaagccccggaccatgcaccaggctgcaccctggtgtcttccacccgcaggcctcccatgctccaagcagcctcccccagcacttgcggccgctcagccctccaaccaagacctaagtcacacatcataatgcagctccttgtggtctggtaagaggggtgctggaggacatggacagcgacaaacctgaggccgtgtctaggaggctggcacgactgcttcagcagagaccaaataaagagaggattaggcagcagcactgtgtgtgtcttcctgggagccgagctgggggttggggcccggtcccacctctttcccaggcacctgggccctgccgcagcccagccccttgcctgttttaataaatacagttttattggcgcccagccacaaaaaaaaaaaaaaaaaa

SEQ ID NO: 53157 - DNA, 1225 bp, Homo sapiens
cagaaaagaggtggagagggggggaataagaaagagagagaaggaaaggagagaaggcaggaagaaggcaagggacgagacaaccatgctgtgctgtatgagaagaaccaaacaggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacatagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattc

SEQ ID NO: 53158 - DNA, 912 bp, Homo sapiens
ccagggatctgagcagctccttctagcatccttcatccttcaggtaccagccatccagacagtgcttgagctgcagaaactgagaccagacctctggcctggccctccccaggggcctcctttcctatagtcactgcttctgcatcagatactttcagctgcaactccctactgggtggggcacccatttcaggcagaaggttttggtaccctccactgaccctacacccagggctgctactgccgcttgtggcttcaggatgaaaggtgagaccccggtgaacagcactatgagtattgggcaagcacgcaagatggtggaacagcttaagattgaagccagcttgtgtcggataaaggtgtccaaggcagcagcagacctgatgacttactgtgatgcccacgcctgtgaggatcccctcatcacccctgtgcccacttcggagaaccccttccgggagaagaagttcttctgtgctctcctctgagctcccctgtcccttctcacaactcctcccttttccctctcctgggcccttccttaggtcagtaattgttgtgagccccttaggctccttgcatcccatccctaacccttgcctgaccatgtgaggttatctgaagcacaaggcccaccctcacctatctgtcgaccccatttcctaccacctttgtggccgaccccaagcaccccagagatatgaggcaccctttgctccacccacagcagggccccgtcagactctgccagcgcgtcctgcccgcttccctcggtgacctgctcagacaatggagagggatgggccaggttcttgctctcagtctcacctggagctactgggagggtaaagccatttgaagaataaagtcatccagagccccaaaaaaaaaaaaaaaaaaaaaaaaaaaaaa

SEQ ID NO: 53159 - DNA, 4175 bp, Homo sapiens
gccgcggggcccgagcgcagggagtggagcttggtttcgggatctcggtgctgcagacggcgagacctcctgcacagggtgtacagcaagctgtgattcctgggaaaactaaaaaagctctctgaacaacggggcccagagctgatggcagacaatgtcagccactaacaacatagcccaggcccggaagctggtggaacagctacgcatagaagccgggattgagcgcatcaaggtctccaaagcggcgtctgacctcatgagctactgtgagcaacatgcccggaacgaccccctgctggtcggagtccctgcctcggagaacccctttaaggacaagaaaccttgtattattttataactgtgttctcatatgttctctctctctctctctttctctctctctctctctgtctctgtctctgtctcaggcagggcatcattcagtaattagctcaaacaaaacatctcaagtccccaaaacctttaattccaaaagaaatcccccctctccccgccaaaaaaggcgttcccaccgcccggatggggtagaatggaccttgtaggtggagatgaattttcaggtccgaccccatggccctctcagtttgggccaaaagggatgaaggctttacggccacttcccgttcggaataactgaaatcccccagcgatggggtaacaattttttaaaactctcgattgccgtttcaattgtggaccggcgccgagggggaaagggaggtgacttcgcccggtggcaatagttccgggagaattggccattggtaaaaagacttcatagggtcactggaatgctttgtgttgtttttaagtagaggtaaaattgagatggggggcgggaggtgacatcatgaagttttttggaaatatctctttatttaaaaaattgttactccatacggctaaactcggattgtgatggttgaacccgtcgctaaactgcacgatcctgcaatgaatgcacgatggagtgtgggggtctggagggggcttcgtctatgaaaagttgccaagtgtgactcccctgcatgatgttagccatgggtcctttctgcagggtcccctctgtgccagaaatgggttttcgggacttgccccagggaagccgtcaccggcccggcccatcatgtttttggatttttttttttctttttttgagatggagtttcattcttgttacccaggctggagtgcagctgcatgatttcagctcaccgcaacctctgcctccccggttcaagcgattctcctgcctcagcctcccgagtagctgagactacaggcgtgtgccactacgcccggctaattgttgtatttttagtagagacggggtttcaccgtattggccaggccgctctcaaactcctgacctcgggatccgcccacctcggcctcccaaagtgctgggattacaggcatgagccaccgcgcccagtgtgttttaagcatgaggcatccgcgtggctgggagaggctttgaccatccttggctcttccaggttgtcctaccctctggcatccaccatagacgtttttcaaacagaaaatgcaggctggggagccgcggcagggcgggtggggctaccctgtgctgctgtgtgtacaaaattgttccatgatcttggagtgactctgaaggactctgggaggtgagacgttgtcccggagatcaaaacgtccgctcaaaacgttaccctgtcgctcgaacccgatctttttgcttttccacccccgtgcaacccaggacggctgtctgaggccgggagatgccttagacgcaggatgggccactcctcccagcggcaagtggaaatcgaagatgtcatggggtcggggggaggcttctgaaagatgactgcgtcctcctctgcggcacggacgggagcaggtgcagccacatcttccagggcctgccggcatcacctgcggccacacctgagatggaccccacgcagccctgatcgcaggaggcctggccgccccgaccccctccacggggctggcctagaagcaagtagtagaataaaactagcctagtcctgtccctccggccccagtggagacaggcgtctaagaacccgtgccgagagggttcctggacggccgcccaggtcctccgtgcaggcccgtgaggcggggatccctgcttggctcacttcctgagctggtgactgccagggttcccacctcgccaaggctagagggctccgggtgtgtgtgcaggtgtcgggggagtgacctccactcctcaacctcgggcagctcccacaggccacagccgggctccccacccccggcacccagctctctacggcaggtccgggagggctggggcttcggggagccctacccgccaaacctgctgttggcccgggagagccccagaggctcccggagactgcagcctcctgtggttgggctgggagccggcagggtttggggtgtgggcgtccccaccacgcatagcaggaatggcaggaagggacaaaagcctgttccagagaccctgggaggaccccaggcagggagagcccgcctgcctccaccctttccaacgagccatcttggtaactgggaacaaacacaccccaccccgtttttccttaaaagaggccttaatccccgagcccccgctgccagggcagagggaggagggggcacagctgtgccaagcccggccccactggtgtgtcctcacaatgtgaccccagaaatgccagcagggaacggaggctgctgcagagatgcagccccaggcagccggggctcctaggctggtgcagatggtggggttaaacgggctgagcgttccaggtaaactgaggctcggggaggggaaggacaggctggcctctccttcactgtccacagggccttgggttccctgagctgtccagaccccaccatctcccggaccccagggaggtggccattgccagaagcctgtgggtttctttctagcttgggggattaaaaaaaaattctccacttttttttttcttgagtagacttcagtgaccacactgtggaaaatacctttgcagacgtggcacccgagtgcacacaccgaccgccacatgtgcttttctgccgggaatccctggggtgaacgcatgttttatgggcgtttccaggagcgcgcgtgcacctccagacggggagctggcgggcgggggtggcagcagcagctctagccttggggggacaagcctctctcagctacgccaggggaaaagagagttaaggacactcacccccacccacgcacacacacaaggcagcgtcgggtgggagagagaaggccgtttctccttctgtagcctgggtctcccacgggccttccccgctgctgagcgagacaccagtagccaggtgaagggccacagcgggccaggccccgaccctgttgtgacccacctgggcaccttcccggaccagctccgcctcccctgccctcctctctccaggaaggagccagaaccctcacccctctcccaccctccccaggggtaaccccaggccaagcacagatagctcagctgcgacctctggcctctggggacataaacggggcggctgggccagggcggaaggtgctcctgtttccctccttctgcgtggtccctttgacgggccggccaccgtgtccgaggcgcaacgctaggcctccaggccacgcatccatctccaagttaacagcccgtcctgcccaagttctggggcaggtaggagagggccgtcacacacctgtccgcccgtgagtgacccgggggggcttccgggtggaggtggagccaccacgcccttcctcaaggggtcacttattaaaaagtccacggcctgaggccaggccctctgcacagaagccatatgccggccagccgcgcctcctcctctgtccacggaaccgctgcccatctaaccttcgtaaagacctgtctcctgtttccagccgccgcctgtggttctagcaggttctatgccatctgcattgggatgtctggttgtttttatttctgacttttttaaaattccaggtgtgccgcacccactttctcgcagtgttttaatattgtgtggagttgtcgataccacgtgaattcatacacaataaaaagcctcactctccctttaaaaaaaaaaaaaaaaaa

SEQ ID NO: 53160 - DNA, 2934 bp, Homo sapiens
ctgctgcgagccgagccgggcggcggcggcagtggcggcagtggcggcagcggcagcagttgcagcagtggtggccagagcggatgcttgcgggctccctgcggctccactagttttcttcgccccgcccagccgcccactcttctcggctagggaagaagaccagagggtgctcagctggaaaactctggtgtctcagcttagggcctcctccgggaagagctaactgctcccaggtgaagccggtgcccgcgggcggtccgtacaccccgcagccggctcgcaccgctcgagagcctcggccgctgtgtcttccacgtctgcagctcagccagggcgcgcagggcgagtggggtccactggcgggtaaaggggaccaggacggcgaggatggacgcacagacctggcccgtgggctttcgctgcctcctccttctggccctggttgggtccgcccgcagcgagggcgtgcagacctgcgaagaagttcggaaacttttccagtggcggctgctgggagctgtcagggggctgccggattcgccgcgggcaggacctgatcttcaggtttgcatatccaaaaagcctacatgttgcaccaggaagatggaggagagatatcagattgcggctcgccaggatatgcagcagtttcttcaaacgtccagctctacattaaagtttctaatatctcgaaatgcggctgcttttcaagaaacccttgaaactctcatcaaacaagcagaaaattacaccagtatacttttttgcagtacctacaggaacatggccttggaggctgctgcttcggttcaggagttcttcactgatgtggggctgtatttatttggtgcggatgttaatcctgaagaatttgtaaacagattttttgacagtctttttcctctggtctacaaccacctcattaaccctggtgtgactgacagttccctggaatactcagaatgcatccggatggctcgccgggatgtgagtccatttggtaatattccccaaagagtaatgggacagatggggaggtccctgctgcccagccgcacttttctgcaggcactcaatctgggcattgaagtcatcaacaccacagactatctgcacttctccaaagagtgcagcagagccctcctgaagatgcaatactgcccgcactgccaaggcctggcgctcactaagccttgtatgggatactgcctcaatgtcatgcgaggctgcctggcgcacatggcggagcttaatccacactggcatgcatatatccggtcgttggaagaactctcggatgcaatgcatggaacatacgacattggacacgtgctgctgaactttcacttgcttgttaatgatgctgtgttacaggctcacctcaatggacaaaaattattggaacaggtaaataggatttgtggccgccctgtaagaacacccacacaaagcccccgttgttcttttgatcagagcaaagagaagcatggaatgaagaccaccacaaggaacagtgaagagacgcttgccaacagaagaaaagaatttatcaacagccttcgactgtacaggtcattctatggaggtctagctgatcagctttgtgctaatgaattagctgctgcagatggacttccctgctggaatggagaagatatagtaaaaagttatactcagcgtgtggttggaaatggaatcaaagcccagtctggaaatcctgaagtcaaagtcaaaggaattgatcctgtgataaatcagattattgataaactgaagcatgttgttcagttgttacagggtagatcacccaaacctgacaagtgggaacttcttcagctgggcagtggtggaggcatggttgaacaagtcagtggggactgtgatgatgaagatggttgcgggggatcaggaagtggagaagtcaagaggacactgaagatcacagactggatgccagatgatatgaacttcagtgatgtaaagcaaatccatcaaacagacactggcagtactttagacacaacaggagcaggatgtgcagtggcgactgaatctatgacattcactctgataagtgtggtgatgttacttcccgggatttggtaactgaactcttctgtcctgacataccttactgaagtctcgatttcttctctctctgcatatgcctggaataagagatcctttttcaatgtaacaattatatttatgaaaagatatgttacactaacttctcagaagccaagctgaaatattcataaagtccctaaaactcaacgtttaaatgacacactttaaaaatatgtcttttttcaatctaactgaaaaccttcttaacttctaatatattaaatctgaagatgtgaagggcacagaagtgactttgaataagaagaatttagtgtatctgtaattttattatcaattccaagccccttcctttctaaattaaaaatgttttcatttgaaagtgtatttgccagacaatgaaaacagtatgcagtatttcttaaagtattgaaattagaatatcatgaaataaatcaaaacatacaatggcaagtagtatgcatgcatattcaagagactcttccatttttgcaagctgtagaaggaaatgtctgaatgtctataagttatggggtagattcttgagaagcatttcatataatttcactgaagaaccttgataattttgacccactgtaacttagccactgatgaaccttaaagctgagtattttattaacacctgatttgtattccattatattcaaaatgcatctttggtattgtgcctctgctcccatctctctctttgcctcatagatttagctatgttgggaagcacatgcttgctctaggaatatctccaataaagctgttaactatttggtggaaaaaaaaaaaaaaaaaaaaaaaaaaaaaaaa

SEQ ID NO: 53161 - DNA, 3021 bp, Homo sapiens
aagagggaggggtctgtgcgcccgcagagtcgccaggcgccctgcgagttgtctccgctgggaggggcgaggctgtcacttgccagggcgcgaggagcctcagcgcggcttggagaacttggccccgcgcagcgtctggtcactcgctctcctctggggactgcagagaagcaggacctcgggccatggattctactgaagaaaggtagccatggaagagaatatggaagagggacagacacaaaaagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcagcagtcattgctatggttcactaccttatggttctgtctgccaactgggcctatgtgaaagacgcctgccggatgcagaagtatgaagacatcaagtcgaaggaagagcaagagcttcatgacatccactctactcgctccaaagagcggctcaatgcatacacataaatgcatcttcctgttctttctaccatttgaatgcattggtgtttaactaagggccatccaaccatccaacctttaaaaaacaaaacgaaagtgcttctcatcaatgatatgtaaggtgacttatgaatcacctgagtacaattctttgttgtttagcacttaaatttcccaatttattaaattgatgtaaatcagatcttttctacaagctcctatccagccttttttttgaaatttctcaaactcatttactagttctgtaaaatcaaagatactaacattgtcaaatgcaaagatttgtttgatttttaaccacttcccatgtgttatacataacaccttttgcattatttcttatgttttgaaaagaaaatagctttttatactttttagttttgatttcggtaactagtttaactacaggtaaccttcaaagggaccattgtacattatgaacaatagatagagattacatcttgatgactcttgaaatatggaaattttgtctgaagatcagtggccatattactgtaggccctggttcatgttttcatcaatctaaggtgcaatttctaaatttgtaagagtaggtttaaaaaaaaaagtgcttcttatctttgttaacattgtacttttccttgatgttcttaaaaggtatttccctcagattactcatgtttatgttgtgagcatgtagaaacagtaatgctaatgcatggctagttgcctttttaagattgtgacaccaggcttaccttttaaagtttagtatatagagacaattttaatggaaataactactgtagactattgaagaatgatctctttgtgatttaagaagtggctggattggaacttttaatatgctaatgtggaaaattaattacctttatgaaggtggtttattacaaataagcacactaacccctcggaagttgttttacctactttaaaagttttaatggattgcacctctgtaaactattcctaaaatgtgtatgatatatttgaaaaggcttccattaatataatagctttgcttgcagccttccaatctatgttggtttacctgtagtgttttataaagtgtggtcagaggcccctatagaatgtattgtttgaaagtgtagtgatatatttgtgtttttatttcaagtaagtcattttaaccgaatgttcattcatattcatttataaaaagtacctgtatcaaaggaattttaacaaagagcaatcagtattattggaccaaatttggtgtttgttttcaccttgacgctcttcttttcattatttctaatgctacaagaatgctgtaaagtgtcttctaaaatgatgtagcctgacaagacatttttttcagtgtataaaactaggtagtattgtgcactgatttgaccattgtgaaatcctttctcagtgtaactgcatttctaataaaaatttattgagtgaaacaatctttgtacaatgactagtcatgcatcatcagtaattttacaagttcttgtagtaggtagggggtactactagggatatctgtggcatgattatgcattccgtagtattatttaattaatttggggttcattttgcttccttttctttatgcttagattatcttactggttcaacatttttctgatatatgcagtattacagatattcagcaaaagtattaatgggcttctttaaattctatattatagtatttcagttccgtgtcttaacagtttgtgataatttctaaaactgtcttttcaacttatgtaatgatgttgacacttttggcttttatttctggtattagagtttgtattttcacagagtgctttgtagcaggcattacaattaatctgttttgtacataaatgtgccaacagcttgatggtggcgtttttgaaatgtagaacagagtgcttgcaaaatgtaataaatacacttgtgtactttgtgtacttattattaaaaaa

SEQ ID NO: 53162 - DNA, 3614 bp, Homo sapiens
atctctcaggcttagagctttatactcactcctttgacagccacgcttctatttctttttaaatctcaaaggtgtgggattacaagtcctgtcttagtaataaacttttgcagataaaccctgagatggtataactgcatcctttcttggcaccttaaatcaaattaactaaatacttagtgaggagagaaaaggaaaacacagtttttttgcaacgtatctgactgggtgagaagccactgctgcagcataaagaaccgacgggaatctgggctttcccactctggaatgaaggggggaattacgggttggtggtcggcttcatgttaggaggacacccctccatctgttcacagctcagcctgtttccaatttaaagcccagatttcaatacaaacctcaatttcttttccccattttaaatgcaaagcaagacttgtgaatcatagtgtctctgctcctgggattcagaccaaatttccccccaaaattctcaggctatttgtttgaatacctgcttacagtggtacacaatgggcagctttgagaagaaaaattgataatcttcacggaagagtaatttgaatgaaattacacttgacagcctgtctccaagcaaacaagaggaacgagggagcctgagctaagctctgaggacttgcccaagccactgctgttggagcttcccaggaaaaaaaaaaaaaaaaaaaaaaaaaaaaaaaaaaaaaaaacaccagtttttccaacatctaattgagcttttgattaattccgtgtaccagattctactgaagaaaggtagccatggaagagaatatggaagagggacagacacaaaaagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcagcagtcattgctatggttcactaccttatggttctgtctgccaactgggcctatgtgaaagacgcctgccggatgcagaagtatgaagacatcaagtcgaaggaagagcaagagcttcatgacatccactctactcgctccaaagagcggctcaatgcatacacataaatgcatcttcctgttctttctaccatttgaatgcattggtgtttaactaagggccatccaaccatccaacctttaaaaaacaaaacgaaagtgcttctcatcaatgatatgtaaggtgacttatgaatcacctgagtacaattctttgttgtttagcacttaaatttcccaatttattaaattgatgtaaatcagatcttttctacaagctcctatccagccttttttttgaaatttctcaaactcatttactagttctgtaaaatcaaagatactaacattgtcaaatgcaaagatttgtttgatttttaaccacttcccatgtgttatacataacaccttttgcattatttcttatgttttgaaaagaaaatagctttttatactttttagttttgatttcggtaactagtttaactacaggtaaccttcaaagggaccattgtacattatgaacaatagatagagattacatcttgatgactcttgaaatatggaaattttgtctgaagatcagtggccatattactgtaggccctggttcatgttttcatcaatctaaggtgcaatttctaaatttgtaagagtaggtttaaaaaaaaaagtgcttcttatctttgttaacattgtacttttccttgatgttcttaaaaggtatttccctcagattactcatgtttatgttgtgagcatgtagaaacagtaatgctaatgcatggctagttgcctttttaagattgtgacaccaggcttaccttttaaagtttagtatatagagacaattttaatggaaataactactgtagactattgaagaatgatctctttgtgatttaagaagtggctggattggaacttttaatatgctaatgtggaaaattaattacctttatgaaggtggtttattacaaataagcacactaacccctcggaagttgttttacctactttaaaagttttaatggattgcacctctgtaaactattcctaaaatgtgtatgatatatttgaaaaggcttccattaatataatagctttgcttgcagccttccaatctatgttggtttacctgtagtgttttataaagtgtggtcagaggcccctatagaatgtattgtttgaaagtgtagtgatatatttgtgtttttatttcaagtaagtcattttaaccgaatgttcattcatattcatttataaaaagtacctgtatcaaaggaattttaacaaagagcaatcagtattattggaccaaatttggtgtttgttttcaccttgacgctcttcttttcattatttctaatgctacaagaatgctgtaaagtgtcttctaaaatgatgtagcctgacaagacatttttttcagtgtataaaactaggtagtattgtgcactgatttgaccattgtgaaatcctttctcagtgtaactgcatttctaataaaaatttattgagtgaaacaatctttgtacaatgactagtcatgcatcatcagtaattttacaagttcttgtagtaggtagggggtactactagggatatctgtggcatgattatgcattccgtagtattatttaattaatttggggttcattttgcttccttttctttatgcttagattatcttactggttcaacatttttctgatatatgcagtattacagatattcagcaaaagtattaatgggcttctttaaattctatattatagtatttcagttccgtgtcttaacagtttgtgataatttctaaaactgtcttttcaacttatgtaatgatgttgacacttttggcttttatttctggtattagagtttgtattttcacagagtgctttgtagcaggcattacaattaatctgttttgtacataaatgtgccaacagcttgatggtggcgtttttgaaatgtagaacagagtgcttgcaaaatgtaataaatacacttgtgtactttgtgtacttattattaaaaaa

SEQ ID NO: 53163 - DNA, 2962 bp, Homo sapiens
aagagggaggggtctgtgcgcccgcagagtcgccaggcgccctgcgagttgtctccgctgggaggggcgaggctgtcacttgccagggcgcgaggagcctcagcgcggcttggagaacttggccccgcgcagcgtctggtcactcgctctcctctggggactgcagagaagcaggacctcgggccatggggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcagcagtcattgctatggttcactaccttatggttctgtctgccaactgggcctatgtgaaagacgcctgccggatgcagaagtatgaagacatcaagtcgaaggaagagcaagagcttcatgacatccactctactcgctccaaagagcggctcaatgcatacacataaatgcatcttcctgttctttctaccatttgaatgcattggtgtttaactaagggccatccaaccatccaacctttaaaaaacaaaacgaaagtgcttctcatcaatgatatgtaaggtgacttatgaatcacctgagtacaattctttgttgtttagcacttaaatttcccaatttattaaattgatgtaaatcagatcttttctacaagctcctatccagccttttttttgaaatttctcaaactcatttactagttctgtaaaatcaaagatactaacattgtcaaatgcaaagatttgtttgatttttaaccacttcccatgtgttatacataacaccttttgcattatttcttatgttttgaaaagaaaatagctttttatactttttagttttgatttcggtaactagtttaactacaggtaaccttcaaagggaccattgtacattatgaacaatagatagagattacatcttgatgactcttgaaatatggaaattttgtctgaagatcagtggccatattactgtaggccctggttcatgttttcatcaatctaaggtgcaatttctaaatttgtaagagtaggtttaaaaaaaaaagtgcttcttatctttgttaacattgtacttttccttgatgttcttaaaaggtatttccctcagattactcatgtttatgttgtgagcatgtagaaacagtaatgctaatgcatggctagttgcctttttaagattgtgacaccaggcttaccttttaaagtttagtatatagagacaattttaatggaaataactactgtagactattgaagaatgatctctttgtgatttaagaagtggctggattggaacttttaatatgctaatgtggaaaattaattacctttatgaaggtggtttattacaaataagcacactaacccctcggaagttgttttacctactttaaaagttttaatggattgcacctctgtaaactattcctaaaatgtgtatgatatatttgaaaaggcttccattaatataatagctttgcttgcagccttccaatctatgttggtttacctgtagtgttttataaagtgtggtcagaggcccctatagaatgtattgtttgaaagtgtagtgatatatttgtgtttttatttcaagtaagtcattttaaccgaatgttcattcatattcatttataaaaagtacctgtatcaaaggaattttaacaaagagcaatcagtattattggaccaaatttggtgtttgttttcaccttgacgctcttcttttcattatttctaatgctacaagaatgctgtaaagtgtcttctaaaatgatgtagcctgacaagacatttttttcagtgtataaaactaggtagtattgtgcactgatttgaccattgtgaaatcctttctcagtgtaactgcatttctaataaaaatttattgagtgaaacaatctttgtacaatgactagtcatgcatcatcagtaattttacaagttcttgtagtaggtagggggtactactagggatatctgtggcatgattatgcattccgtagtattatttaattaatttggggttcattttgcttccttttctttatgcttagattatcttactggttcaacatttttctgatatatgcagtattacagatattcagcaaaagtattaatgggcttctttaaattctatattatagtatttcagttccgtgtcttaacagtttgtgataatttctaaaactgtcttttcaacttatgtaatgatgttgacacttttggcttttatttctggtattagagtttgtattttcacagagtgctttgtagcaggcattacaattaatctgttttgtacataaatgtgccaacagcttgatggtggcgtttttgaaatgtagaacagagtgcttgcaaaatgtaataaatacacttgtgtactttgtgtacttattattaaaaaa

SEQ ID NO: 53164 - DNA, 2070 bp, Homo sapiens
ccgacacccacgggcggagatcacctgctgccccgcagacccctgtcccttcctcccggaccagcagctagaggatgtccaaacggagttggtgggctggatccagaaagcccccaagagagatgctgaaactctcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagcgcaaggtactctgagtcccctctgtagtgcctctgccagacacacactgcctgagttgaagagacacaggccacacatttcaggctggttgccagcggacgtcagcactcacggcctgcggggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagactaaaaaaaaa

SEQ ID NO: 53165 - DNA, 3517 bp, Homo sapiens
gggttccacatcagccaccactcctgcttctgagcacagggtgctctcctcttgagctcagcttctgattttgcagccaagcattcttgctgctgctgcctgcctgcccacccgcctgggcttgcagcccgccactttactttctccagccctgataccagctgagaagtctccctgcagctgctagttcctgcccaggaccatgtgtgtggatgctgcttgggagaagcgggcacttgctcctggcactgatcccagctgagtttctcctgttgatttctggaccactgatgctgttgctgaggaggtatttcctggcatccctccccctgagacaccggctaaggaccagcctaaacgcaaggcaggacagtgtcaggatggaccgcgctgccagaagccgacgctagcgagggaggtgtgaagagttggccagaatgaccaactcctcctccacatccacctcctccaccaccggtggctcgctgctgctgctctgcgaggaagaggagtcgtgggcgggccggcgcatcccggtgtcactcctgtattcgggcctggccatcgggggcacgctggccaacggcatggtcatctatctcgtgtcgtccttccgaaagctgcagaccaccagcaacgccttcattgtgaacggctgcgccgccgacctcagcgtctgcgccctctggatgccgcaggaggcggtgctcgggctcctgcccaccggctctgcggagccccccgcagactgggacggcgctgggggcagctaccgcctgctacggggtgggctgctgggcctcggactcacggtgtccctcctctcccactgcctcgtggccctgaaccgctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggcccggcgccgcgccaccgcgaatccactacccggcgctgctggccgccgcggcgctgctggcgcagacagctctgctgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggcgtctcagcggcctgtcggtgctgctgctctgctgcgtcttcctgctggccacgcagccactggtgtgggtgagcctggccagcggcttctcgctgccggtgccctggggagtgcacgcggccagctggctcctgtgctgcgccctgtccgcgctcaacccgctgctctacacgtggaggaacgaggagttccgccgctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtccttgggcaccgtcgcctccttccctcctagggcatcccctgcctgaacgaagacttccgccgcgaagcccgatagatcgggggaaaatggggccttcgaccccagcgggctacctgaaccaaggcgtctctctaagtggggcgcccgaagtcattttggacggccacctgatttttaccctttgtttctgtgttttagaggaatcctaaagtcaaaacaccagagacttgaagaacttgcaaactggcgttttaaaataaccggttaatttatttccacacagtttgtttttgaaaaagagctttcataatgtataaccctttccactttcatcgtcttatatatgaagcgccttgagtgtgcatgaaccaaaggaaataacattgaagaaggaaaacaatatgtagaaagtattttagaaagtaacctgtctttgatgatgcttctcttaccatttagtttttgtatattaccctggggcagtgaagccctaggtgtgcccaccagtatgagttgccattaagacctcaagccctttattcttaaaagggtttttaataaagtctttctcaaatgaggtagaatcttagccagtgagaaaaaaaattattttatgctccttttttttcgcactcttaagactgaaaattggcgttgagtgttatagtgaaaattttccagtttgataattgatggtcagagccagcactggaattttgaaaacaaataaggtgattatctattttaggtaccgtttcacattttctatagcatgcacacttgttgctaccctcattttgtaaccaatttatttgccttatgaatgtgattgcagctttgaacattctgtactgtaatggttgctaagaagaataagtccttctgttttctctttaacatttaaaatatctcaatgcacatgatataattaaacactaataataccatgactgcatagctaatattagctgctattgcatgctcctagatgctagaacttattgggcatgtggtatactgaagcgatacccgttagacaaggatattttacttcttccagacaccagaagaaatggccttcaattatttgaaaagagacacagagacacctctggctacctagagttcttcctgtcttgaccaatttatgagaaagctcccagttgggactttatctcacaagtggaatcacagtcaagacggatcaataatatggttggctcagcaaagccagctgtgctcttttagggtttaaacaagccacacgttagaaagcaacactgtttttatgtagttcatatatattaccacgacatttaacatcaatattgtatatgttgaaggaggtataataaactcagtcatatatagtgaacagttcaaatgggaaagtgttctaaaacatattatttgaggtttgtcatattcatctttggtttactaaatttacttagaaatatttgaaatgcaaaattgtgtgaaatcaccttatcaaattaaaatgggaagaaagtaattttaataatttttaataatcatatgtcagcattctgactacttaccacatcaaatctgggcccaaacagcctcagttaactgcataattcaggaacaaaaccagcttgctttgttgcacgcctgggcaatttcagccaggacattaggaccacttgttgtacatctgaataattatggaagttgggacatgttaaggaaaacaaatatgttcatcaccaacaatcagctgtcattttattaatctatcccttttgtgcatgcaccatttctctcttactaacagtttcatctgttcacattttccttgattcaaatattaaagttcagaaaaaaaaaaaaaaaaaaaaaaaaaaaaaaaaaa

SEQ ID NO: 53166 - DNA, 6293 bp, Homo sapiens
atcatgggaccgggtgagcgctgagaatcgcggccgcagccatcagccctggagatgaccaggagcggccactgctgagaactatgtggagagaggctgcgagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatacacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgcatctgcactgtagtcggatttgaacatgtgcaagagattaggaagtttggctcgtaacagtttcagctttcttgttatgccttccatcacagcccaggctcaccccaagaactccaggctcccctaaagaatagcaaatcagtgtgttcgtgatgactgtgctaccttcattatagttcatttccaagacacatctggagccaaaggcccgagggaccctcaggtggggagagctacaggaatctctttggatgttgatgtgtgtttctctctaccctcggcttcgatggtcttgttcagagctgcataaactaacacatttatgtctccgagatctaagtgtggatcttctgtctgtgacacagtggccattgtagtttatcccgaagacgcctatgtacgtaagtttgcatttcctcccttctggtgatgactcagggttgtatagtatctgttaccccttccctcccagagtaaccataactcgttccgtttccaaacagccatggtggtgtccaattagctgtgtatcgctcttcccagagttgttaatgtggtgacatgcaccaacagccgtatgtgtactgtgatctgtaagaagtacaatgccatctgtctgccgaaggctagcatggttttaggtttatcttccttcacatccagaaattctgttggacactcacttccaccccaaactcctcaaatcaaaagccttcaaaacacgaggcactcttggatctaccctgagtatcctccaaactgtggatacagtttagtgagacaagcaatttctcccttctgagttattctctctgttggtggcaaaccacttcatagcaccaacagagatgtaggaaaaattcctcaaagtatttgtcatttctgagtcgcctgcattatcccattcttattctcctcaaacctgtgcatatatgacatgaaatgatatccattttttttttaagttagaaacagagaggggaatacttatgcatggggagcctgttagcacagtgcctgccacaaaaacaagtgcccccgacaagatagttgctatgttatgacactttctcagatcaggattttctagtttaaaaattaaatatcataaaacg

SEQ ID NO: 53167 - DNA, 4298 bp, Homo sapiens
catcgcgagtgtccttgagccgcgggtgacggtggctctcgctgctcgcgccccctcctcccgcggggggagcctgatgccacgttccctatgaattatttatcgccggcctaaaaataccccgaacttcacagcccgagtgaccctccggtggacatgggtggggccctggggccggccctgttgctcacctcgctcttcggtgcctgggcagggctgggtccggggcagggcgagcagggcatgacggtggccgtggtgtttagcagctcagggccgccccaggcccagttccgtgcccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggagctgggcccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagctacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatggcaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagatgctgcaggcagcccgcgacatggtgaccacggcgggcgtaagcagctccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagctggaggacctgccgctgctcggtccggagcagctggcccggcgggaggccctgctgcacgcggcctgggcccggggctcgcgcccgcgtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattttgctggggggctgtctgtcctcaccttccaccctgtgccagccacggctcctggctctccggggcctgggggcctctggggcacaggggcaggactctggggctgggcacaggctacagagacagtgggggactggacgagatcagcagggtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattgggcttttctggcttctaccatgaaatcctggccatgggaccccagtgacagatgatgtcttccatggtcatcagtgacctcagtagcctcaaatcatggtgagggctgggcttttgctgtcctcttctcacgcagagttctgccaggagggtgtgctgtgggggtcagactcctgaggctctcccttccctggggctagccagttactggtcatggctgctgtgggcatggaggctggaacttgtggttgaggcagggccatcccgatccttgctctacctggctagagtttcttctcatcagagcactgggacattaaacccaccttttcccagaaaaaaaaaaaaaaaaaaaaaaaaaaaaa

SEQ ID NO: 53168 - DNA, 7770 bp, Homo sapiens
cagagaggaagtagcgagagaagagagaaaatgaagtcggcgctgggggagcctgcaggagggtggccaacagtggaggaaggtggatttggcttcttttccgcaccccgggcgtgaaagccctctccaacgcgaccccaggaaataagtgggtctcgcctgggcagaaaaggaaaagaatccaggcgagagcgcgtcgctcctctgtcactgctgcccccgaggaactccggctgcttctcatcccggccgcctcgcggggccggacgcagtgcccgaggcgccctgcagatggggcgggcagggaacgggcgctccagctgcgggtgacaggcgccggcccgcccgcctgcctgctcagcgcagtgaccgggcgggcagaggatgccaggcggagggacctgggagcgggatctgagactgccggaggcgcgctacgctccaacttgcatggcctagagaccgctccagctcctgggaccgcttcaccgagtggagtgaagctgcgcgcgggacctggaggcggagacctcaggcagcggctgcagaggggcgagccgggcgcaggagggggcgcgctttctccctgcgggtctcagtaatgaggagactgagtttgtggtggctgctgagcagggtctgtctgctgttgccgccgccctgcgcactggtgctggccggggtgcccagctcctcctcgcacccgcagccctgccagatcctcaagcgcatcgggcacgcggtgagggtgggcgcggtgcacttgcagccctggaccaccgccccccgcgcggccagccgcgctccggacgacagccgagcaggagcccagagggatgagccggagccagggactaggcggtccccggcgccctcgccgggcgcacgctggttggggagcaccctgcatggccgggggccgccgggctcccgtaagcccggggagggcgccagggcggaggccctgtggccacgggacgccctcctatttgccgtggacaacctgaaccgcgtggaagggctgctaccctacaacctgtctttggaagtagtgatggccatcgaggcaggcctgggcgatctgccacttttgcccttctcctcccctagttcgccatggagcagtgaccctttctccttcctgcaaagtgtgtgccataccgtggtggtgcaaggggtgtcggcgctgctcgccttcccccagagccagggcgaaatgatggagctcgacttggtcagcttagtcctgcacattccagtgatcagcatcgtgcgccacgagtttccacgggagagtcagaatccccttcacctacaactgagtttagaaaattcattaagttctgatgctgatgtcactgtctcaatcctgaccatgaacaactggtacaattttagcttgttgctgtgccaggaagactggaacatcaccgacttcctcctccttacccagaataattccaagttccaccttggttctatcatcaacatcaccgctaacctcccctccacccaggacctcttgagcttcctacagatccagcttgagagtattaagaacagcacacccacagtggtgatgtttggctgcgacatggaaagtatccggcggattttcgaaattacaacccagtttggggtcatgccccctgaacttcgttgggtgctgggagattcccagaatgtggaggaactgaggacagagggtctgcccttagggctcattgctcatggaaaaacaacacagtctgtctttgagcactacgtacaagatgctatggagctggtcgcaagagctgtagccacagccaccatgatccaaccagaacttgctctcattcccagcacgatgaactgcatggaggtggaaactacaaatctcacttcaggacaatatttatcaaggtttctagccaataccactttcagaggcctcagtggttccatcagagtaaaaggttccaccatcgtcagctcagaaaacaactttttcatctggaatcttcaacatgaccccatgggaaagccaatgtggacccgcttgggcagctggcaggggggaaagattgtcatggactatggaatatggccagagcaggcccagagacacaaaacccacttccaacatccaagtaagctacacttgagagtggttaccctgattgagcatccttttgtcttcacaagggaggtagatgatgaaggcttgtgccctgctggccaactctgtctagaccccatgactaatgactcttccacattggacagcctttttagcagcctccatagcagtaatgatacagtgcccattaaattcaagaagtgctgctatggatattgcattgatctgctggaaaagatagcagaagacatgaactttgacttcgacctctatattgtaggggatggaaagtatggagcatggaaaaatgggcactggactgggctagtgggtgatctcctgagagggactgcccacatggcagtcacttcctttagcatcaatactgcacggagccaggtgatagatttcaccagccctttcttctccaccagcttgggcatcttagtgaggacccgagatacagcagctcccattggagccttcatgtggccactccactggacaatgtggctggggatttttgtggctctgcacatcactgccgtcttcctcactctgtatgaatggaagagtccatttggtttgactcccaaggggcgaaatagaagtaaagtcttctccttttcttcagccttgaacatctgttatgccctcttgtttggcagaacagtggccatcaaacctccaaaatgttggactggaaggtttctaatgaacctttgggccattttctgtatgttttgcctttccacatacacggcaaacttggctgctgtcatggtaggtgagaagatctatgaagagctttctggaatacatgaccccaagttacatcatccttcccaaggattccgctttggaactgtccgagaaagcagtgctgaagattatgtgagacaaagtttcccagagatgcatgaatatatgagaaggtacaatgttccagccacccctgatggagtggagtatctgaagaacgatccagagaaactagacgccttcatcatggacaaagcccttctggattatgaagtgtcaatagatgctgactgcaaacttctcactgtggggaagccatttgccatagaaggatacggcattggcctcccacccaactctccattgaccgccaacatatccgagctaatcagtcaatacaagtcacatgggtttatggatatgctccatgacaagtggtacagggtggttccctgtggcaagagaagttttgctgtcacggagactttgcaaatgggcatcaaacacttctctgggctctttgtgctgctgtgcattggatttggtctgtccattttgaccaccattggtgagcacatagtatacaggctgctgctaccacgaatcaaaaacaaatccaagctgcaatactggctccacaccagccagagattacacagagcaataaatacatcatttatagaggaaaagcagcagcatttcaagaccaaacgtgtggaaaagaggtctaatgtgggaccccgtcagcttaccgtatggaatacttccaatctgagtcatgacaaccgacggaaatacatctttagtgatgaggaaggacaaaaccagctgggcatccagatccaccaggacatccccctccctccaaggagaagagagctccctgccttgcggaccaccaatgggaaagcagactccctaaatgtatctcggaactcagtgatgcaggaactctcagagctcgagaagcagattcaggtgatccgtcaggagctgcagctggctgtgagcaggaaaacggagctggaggagtatcaaaggacaagtcggacttgtgagtcctaggtgaccacactgcttccctttctcagttcctgaccttcctctgagcccttgagacactttgtaatgctcttttgtaactatcgacaaaggtgtggggaagctgaggtctaggtcttcttaaaggtcaagtctgctctccctcgcctaaagtgcagcagcagctcctctcaagctcactctctaggtctccagggtaggagtgtttttctagcaagaatcttagtcaggagtaagctctgtgcgagagatctgtgaataaccagataaccccagctgccgttaaccttttcaccaggtgccacagtaatatttctggtttttagccctttctctgcactaccaacaagagataaaattgttactcacacttatgtcttactgggttgctggttttcatcgtaacacagaacgaggttatctagggttgtagcttttgatacaactccccgatctagatttattcctacattctgaatggggagcaggtaagagcagagcacctcccactgggggtggggtatttaaaaattaactcattagtatcataaacgtcaaggattgattggaccaggcaagagccatgtttttgagaaggttctggatctctgactccatcctgactgtttagtaagagcatgcttacaccctactgtgaaaaggggaggggatgtggtaagcagaaacagaagacaggcagcagaggcattaaaaatgcataccatgctttcagaacaaaagctctgggccagaaaggcaatttggctaaaaaatgaataagactacttctaatgtaactaagcatctccactatggtgtgtgccttttataaaggaaaagagagaaaaaggcaaagcaaggttgtggccttaggttggacctggaatatcccttattgcctataatggaatatgtgacactgtgggtgaaatgttctacacaccacacactaggccattttcagatcagcagtcacccatcgcttagcatagaaatcccaaaacctccagcccgggaacactataagcttcgaccattcaggaatctgccctgcactttgcatatctgtatagaaaatcaagtcaatcccccatcctcacacccactcatctctgaggagctatgaactggttttggtccctctaatgatcctccagcctcatctaatgccccccaaagactgatacaagtaacctcccctctgcttaggtgtcactttctcagcatatcaagtttaggcagcaagggaaaggaatatgggtcagttctcaaatgtcaatgtagataagagtcatctagtagagaactcatcagagtgcggattgccaagacccttctccagagattatggggttgggggtggaggtctagaggtgagctcagaaacctactgttaaccaacacccccaagtgactgacacaggtggtctaaaaattacttttctagaaacaccattctggaagtttggctgcccacaggcaggaggagaagcatgaagagaaaacctgtttgagaagttttgttttgttttgttttgctttttaataattttagcacacatctgctgactctccttcaacatcctcacccccatccctgggcaccatttaggacaagacttccttatttatcaattacttgatttatcttctcaggactcattgttccacccccaaccaatttgaatgcctacaataagttcaggagctgtgccaagcactttcctcttttacagctggagatcactggaaaggtgtctcagtcacaaaacttctccctctactactggatgaaatgtctgcatttccaccaaaatctacccagtcacccagggaataacaacttaagctgtagttagataacacctagtgattaattggctgagaaaaccctggagtggagggaggctcagagatactgatatggatgtgggagggctctaaagttagaggtcaccaactccacagatgaaacagttcaataatgaggaaacaggtgagccctgaaaacacaaaaggacagttctgtgttgaaacaccccatcccctcacgttctcaccccaggcccagaagtaggttgcaactgcctttggaagattttgccccttagccatccccacccacttgtaccagctaagaatgctggagactctgccaccatgctctgcgtgcccctgaacctctgtgcagcccggaaggctgatgtacaggtgtacctcaatccacattacagccatgctcctaatgtacatggacatttttgtaactcagctcatattctgactgtatttgagaagctggctgtttaagggaacccagaagtgaattcttttgtaaagtaaagcacccttttgtaatgcaattaattatcccttaatgtatctgttttgtaagtctgcatttttgtatatcgggtttaccttaagcttctctagtgaggcattctgagcagtggtgatcacatgccagatcgccctgcctatccacaaagtagatgaccaatgcacgctcctcaaacatctttggaggaactacctggccaaaacactggccaggatgcagcaagcagcagcaggggctgacagcaggcttactgccatcaacattgcttgaaatgcctctatgttctgaataaagaaaaaccataattgcttgtggtgaaacgaagcagtcttcatgttaagtagcaatggttatttttattggtagtaactgaacagtgttttgcaatttgtgaaacagtgtattgtgttttgtaaaatgatgtcatgaaatggtgggtccttggaaacctcctttccgttcagctctgcctctgttctttcaactcctttgaggctcaaaaaaaacacaaagatcagaagccttcagatagagggtggtattctggtaaagaagaaagagataagggacgctaccttgcttttctggcacaggaagcacatgataaagcatgctcagaggagctggaacagatatagctacctggttcgtgtaaataagaataatcaaggccccagagtgtgtatgcttccaggtggaggagaaaggggaatctcccaaaatttaaaaacaaattggaagaataaccaggacagccaagtgaagcagccacagggacccaagcagtcgaggtctttaatgtgcctggagatgactctctgctattcatgaatcttgctattgcacaaaccctatcaagagctgctgcttcccttccagccagaaaagtggtaagcggagcaagtgccaagcagaacagaccttatcatctgggtaacagacttctcagtgttggtgctgtgtctgttagagccttagagcaagttaagcacttccttggtgtgggtaaagaataaaggggaaagaaactactttagagcctctttttctcccaactcatatttttgataggaaaaacagaaaacccatccagttcttcagaaattgctttctaggcattaatactactttactatctatactgtttagttattcctttctttacccacctaaactatccatctaatccaggattccctcactctttttttttagttactaatcattttatgaaaataatgtatttataagtattttcttaaggtttgtgaagagtatttgcattgtgtcttcattttaatgtgtttgcaatcgctccgctccaggaagaacggaaatgctgtcttgtgagcatgaagtgaacgggctgttttgctccagccacttttcttgtacaaccacatggatggattagatgtcctcaggtcttttccatcttcagtttctatgactgtggaataaatgttcagatagaaacttc

SEQ ID NO: 53169 - DNA, 4260 bp, Homo sapiens
gtgcagttgagtcgcgagtacggctgagctgcgtaccggcctccctggctctcacactccctctctgctcccgctctcctaatctcctctggcatgcggtcagccccctgcccagggaccacaggagagttcttgtaaggactgttagtccctgcttacctgaaagccaagcgctctagcagagctttaaagttggagccgccaccctccctaccgccccatgccccttcaccccactccgaaattcaccgacctttgcatgcactgcctaaggatttcagagtgaggcaaagcagtcggcaaatctaccctggcttttcgtataaaaatcctctcgtctaggtaccctggctcactgaagactctgcagatatacccttataagagggagggtgggggagggaaaagaacgagagagggaggaaagaatgaaaaggagaggatgccaggaggtccgtgcttctgccaagagtcccaattagatgcgacggcttcagcctggtcaaggtgaaggaaagttgcttccgcgcctaggaagtgggtttgcctgataagagaaggaggaggggactcggctgggaagagctcccctcccctccgcggaagaccactgggtcccctctttccccaacctcctccctctcttctactccacccctccgttttcccactccccactgactcggatgcctggatgttctgccaccgggcagtggtccagcgtgcagccgggagggggcaggggcagggggcactgtgacaggaagctgcgcgcacaagttggccatttcgagggcaaaataagttctcccttggatttggaaaggacaaagccagtaagctacctcttttgtgtcggatgaggaggaccaaccatgagccagagcccgggtgcaggctcaccgccgccgctgccaccgcggtcagctccagttcctgccaggagttgtcggtgcgaggaattttgtgacaggctctgttagtctgttcctcccttatttgaaggacaggccaaagatccagtttggaaatgagagaggactagcatgacacattggctccaccattgatatctcccagaggtacagaaacaggattcatgaagatgttgacaagactgcaagttcttaccttagctttgttttcaaagggatttttactctctttaggggaccataactttctaaggagagagattaaaatagaaggtgaccttgttttagggggcctgtttcctattaacgaaaaaggcactggaactgaagaatgtgggcgaatcaatgaagaccgagggattcaacgcctggaagccatgttgtttgctattgatgaaatcaacaaagatgattacttgctaccaggagtgaagttgggtgttcacattttggatacatgttcaagggatacctatgcattggagcaatcactggagtttgtcagggcatctttgacaaaagtggatgaagctgagtatatgtgtcctgatggatcctatgccattcaagaaaacatcccacttctcattgcaggggtcattggtggctcttatagcagtgtttccatacaggtggcaaacctgctgcggctcttccagatccctcagatcagctacgcatccaccagcgccaaactcagtgataagtcgcgctatgattactttgccaggaccgtgccccccgacttctaccaggccaaagccatggctgagatcttgcgcttcttcaactggacctacgtgtccacagtagcctccgagggtgattacggggagacagggatcgaggccttcgagcaggaagcccgcctgcgcaacatctgcatcgctacggcggagaaggtgggccgctccaacatccgcaagtcctacgacagcgtgatccgagaactgttgcagaagcccaacgcgcgcgtcgtggtcctcttcatgcgcagcgacgactcgcgggagctcattgcagccgccagccgcgccaatgcctccttcacctgggtggccagcgacggctggggcgcgcaggagagcatcatcaagggcagcgagcatgtggcctacggcgccatcaccctggagctggcctcccagcctgtccgccagttcgaccgctacttccagagcctcaacccctacaacaaccaccgcaacccctggttccgggacttctgggagcaaaagtttcagtgcagcctccagaacaaacgcaaccacaggcgcgtctgcgacaagcacctggccatcgacagcagcaactacgagcaagagtccaagatcatgtttgtggtgaacgcggtgtatgccatggcccacgctttgcacaaaatgcagcgcaccctctgtcccaacactaccaagctttgtgatgctatgaagatcctggatgggaagaagttgtacaaggattacttgctgaaaatcaacttcacggctccattcaacccaaataaagatgcagatagcatagtcaagtttgacacttttggagatggaatggggcgatacaacgtgttcaatttccaaaatgtaggtggaaagtattcctacttgaaagttggtcactgggcagaaaccttatcgctagatgtcaactctatccactggtcccggaactcagtccccacttcccagtgcagcgacccctgtgcccccaatgaaatgaagaatatgcaaccaggggatgtctgctgctggatttgcatcccctgtgaaccctacgaatacctggctgatgagtttacctgtatggattgtgggtctggacagtggcccactgcagacctaactggatgctatgaccttcctgaggactacatcaggtgggaagacgcctgggccattggcccagtcaccattgcctgtctgggttttatgtgtacatgcatggttgtaactgtttttatcaagcacaacaacacacccttggtcaaagcatcgggccgagaactctgctacatcttattgtttggggttggcctgtcatactgcatgacattcttcttcattgccaagccatcaccagtcatctgtgcattgcgccgactcgggctggggagttccttcgctatctgttactcagccctgctgaccaagacaaactgcattgcccgcatcttcgatggggtcaagaatggcgctcagaggccaaaattcatcagccccagttctcaggttttcatctgcctgggtctgatcctggtgcaaattgtgatggtgtctgtgtggctcatcctggaggccccaggcaccaggaggtatacccttgcagagaagcgggaaacagtcatcctaaaatgcaatgtcaaagattccagcatgttgatctctcttacctacgatgtgatcctggtgatcttatgcactgtgtacgccttcaaaacgcggaagtgcccagaaaatttcaacgaagctaagttcataggttttaccatgtacaccacgtgcatcatctggttggccttcctccctatattttatgtgacatcaagtgactacagagtgcagacgacaaccatgtgcatctctgtcagcctgagtggctttgtggtcttgggctgtttgtttgcacccaaggttcacatcatcctgtttcaaccccagaagaatgttgtcacacacagactgcacctcaacaggttcagtgtcagtggaactgggaccacatactctcagtcctctgcaagcacgtatgtgccaacggtgtgcaatgggcgggaagtcctcgactccaccacctcatctctgtgattgtgaattgcagttcagttcttgtgtttttagactgttagacaaaagtgctcacgtgcagctccagaatatggaaacagagcaaaagaacaaccctagtacctttttttagaaacagtacgataaattatttttgaggactgtatatagtgatgtgctagaactttctaggctgagtctagtgcccctattattaacaattcccccagaacatggaaataaccattgtttacagagctgagcattggtgacagggtctgacatggtcagtctactaaaaaacaaaaaaaaaaaacaaaaaaaaaaaaacaaaagaaaaaaataaaaatacggtggcaatattatgtaaccttttttcctatgaagttttttgtaggtccttgttgtaactaatttaggatgagtttctatgttgtatattaaagttacattatgtgtaacagattgattttctcagcacaaaataaaaagcatctgtattaatgtaaagatactgagaataaaaccttcaaggttttcca

SEQ ID NO: 53170 - DNA, 3884 bp, Homo sapiens
ccgagtgacaaggaggtgggagagggtagcagcatgggctacgcggttggctgccctcagtccccctgctgctgaagctgccctgcccatgcccacccaggccgtggggccaggggcctgccagggctaggagtgggcctgccgttcatgggtctctagggatttccgagatgcctgggaagagaggcttgggctggtggtgggcccggctgcccctttgcctgctcctcagcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgcaaaaaa

SEQ ID NO: 53171 - DNA, 1795 bp, Homo sapiens
ttgccattacccacagaataaagaaaggggccctgttattcaacaataggggaaaagacagagacaatgggaaattgtgcttccgatggggtggggactgagaaggaaaggacagacagacagacagacagggggttgtacagaagaggtccggtttcttgaagcagctggaagtcctggatagttcccacctgaaagtctgtttgcaaaggcaatgcgcactcaggcaccagagggcagaggggctcaagttccagggttttaaggtgcttggaactcccaggagcctggcaaaccttcatccagaacctcttcctcaagcaagacaaaaagctgctaagcactgctccctccgtctctgtgaagagaccagcttctaacagacggtgccgggctgaccccccatcatgccaggctggctcaccctccccacactctgccgcttccttctttgggccttcaccatcttccacaaagcccaaggagacccagcatcccacccgggcccccactacctcctgccccccatccacgaggtcattcactctcatcgtggggccacggccacgctgccctgcgtcctgggcaccacgcctcccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggagggtgtggtgtttccgtaccaacccagccggggccggtaccagttcaattactacgaggcgaagcaggcgtgcgaggagcaggacggacgcctggccacctactcccagctctaccaggcttggaccgagggtctggactggtgtaacgcgggctggctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggacctactgctacgccgagaattaggcgcccaccgtgtcccctccagcgcgcgcgaagaagcttgggagtcgtggcgggggtctctcgccacccctttccggagagcctcccctccctccagacccggagcggcctctccagacctgccttcccagccgggggctgcgggcctcggaccccggctggcccggcggcggggaggggaggcgggggcgcctccggcggcgagatgcagaggtgaccctcggacccgctgccgttcgcgaaccctagcagaggactcagccaccgccggggggagggtgaggcggccgggggcattaactgacctctgagtacagcaataaaataacctggggatctttaaaaaaaaaaaaaaaaaaaaaaaa

SEQ ID NO: 53172 - DNA, 3459 bp, Homo sapiens
ggccggcggcggcggcggcggctccgctccgcactgcccggcgccgcctcgccatggacgcgcgcgggggcggcgggcggcccggggagagcccgggcgcgacccccgcgccggggccgccgccgccgccgccgcccgcgcccccccaacagcagccgccgccgccgccgccgcccgcgccccccccgggccccgggcccgcgcccccccagcacccgccccgggccgaggcgttgcccccggaggcggcggatgagggcggcccgcggggccggctccgcagccgcgacagctcgtgcggccgccccggcaccccgggcgcggcgagcacggccaagggcagcccgaacggcgagtgcgggcgcggcgagccgcagtgcagccccgcggggcccgagggcccggcgcgggggcccaaggtgtcgttctcgtgccgcggggcggcctcggggcccgcgccggggccggggccggcggaggaggcgggcagcgaggaggcgggcccggcgggggagccgcgcggcagccaggccagcttcatgcagcgccagttcggcgcgctcctgcagccgggcgtcaacaagttctcgctgcggatgttcggcagccagaaggccgtggagcgcgagcaggagcgcgtcaagtcggcgggggcctggatcatccacccgtacagcgacttcaggttctactgggacttcaccatgctgctgttcatggtgggaaacctcatcatcatcccagtgggcatcaccttcttcaaggatgagaccactgccccgtggatcgtgttcaacgtggtctcggacaccttcttcctcatggacctggtgttgaacttccgcaccggcattgtgatcgaggacaacacggagatcatcctggaccccgagaagatcaagaagaagtatctgcgcacgtggttcgtggtggacttcgtgtcctccatccccgtggactacatcttccttattgtggagaagggcattgactccgaggtctacaagacggcacgcgccctgcgcatcgtgcgcttcaccaagatcctcagcctcctgcggctgctgcgcctctcacgcctgatccgctacatccatcagtgggaggagatcttccacatgacctatgacctggccagcgcggtgatgaggatctgcaatctcatcagcatgatgctgctgctctgccactgggacggctgcctgcagttcctggtgcctatgctgcaggacttcccgcgcaactgctgggtgtccatcaatggcatggtgaaccactcgtggagtgaactgtactccttcgcactcttcaaggccatgagccacatgctgtgcatcgggtacggccggcaggcgcccgagagcatgacggacatctggctgaccatgctcagcatgattgtgggtgccacctgctacgccatgttcatcggccacgccactgccctcatccagtcgctggactcctcgcggcgccagtaccaggagaagtacaagcaggtggagcagtacatgtccttccacaagctgccagctgacttccgccagaagatccacgactactatgagcaccgttaccagggcaagatgtttgacgaggacagcatcctgggcgagctcaacgggcccctgcgggaggagatcgtcaacttcaactgccggaagctggtggcctccatgccgctgttcgccaacgccgaccccaacttcgtcacggccatgctgaccaagctcaagttcgaggtcttccagccgggtgactacatcatccgcgaaggcaccatcgggaagaagatgtacttcatccagcacggcgtggtcagcgtgctcactaagggcaacaaggagatgaagctgtccgatggctcctacttcggggagatctgcctgctcacccggggccgccgcacggcgagcgtgcgggccgacacctactgccgcctctattcgctgagcgtggacaacttcaacgaggtgctggaggagtaccccatgatgcggcgcgccttcgagacggtggccatcgaccgcctggaccgcatcggcaagaagaattccatcctcctgcacaaggtgcagcatgacctcaactcgggcgtattcaacaaccaggagaacgccatcatccaggagatcgtcaagtacgaccgcgagatggtgcagcaggccgagctgggtcagcgcgtgggcctcttcccgccgccgccgccgccgccgcaggtcacctcggccatcgccacgctgcagcaggcggcggccatgagcttctgcccgcaggtggcgcggccgctcgtggggccgctggcgctcggctcgccgcgcctcgtgcgccgcccgcccccggggcccgcacctgccgccgcctcacccgggcccccgccccccgccagccccccgggcgcgcccgccagcccccgggcaccgcggacctcgccctacggcggcctgcccgccgccccccttgctgggcccgccctgcccgcgcgccgcctgagccgcgcgtcgcgcccactgtccgcctcgcagccctcgctgcctcacggcgcccccggccccgcggcctccacacgcccggccagcagctccacaccgcgcttgaggcccacgcccgctgcccgggccgccgcgcccagcccggaccgcagggactcggcctcacccggcgccgccggcggcctggacccccaggactccgcgcgctcgcgcctctcgtccaacttgtgaccctcgccgaccgccccgcgggcccaggcgggccaggggcggggccgtcatccagaccaaagccatgccattgcgctgccccggccgccagtccgcccagaagccatagacgagacgtaggtagccgtagttggacggacgggcagggccggcggggcagccccctccgcgcccccggccgtcccccctcatcgccccgcgcccacccccatcgcccctgcccccggcggcggcctcgcgtgcgagggggctcccttcacctcggtgcctcagttcccccagctgtaagacagggacggggcggcccagtggctgagaggagccggctgtggagccccgcccgccccccaccctctaggtggcccccgtccgaggaggatcgttttctaagtgcaatacttggcccgccggcttcccgctgcccccatcgcgctcacgcaataaccggcccggcccccgtccgcgcgcgtcccccggtgacctcggggagcagcaccccgcctccctccagcactggcaccgaggggcaggcctggctgcgcagggcgcgggggggaggctggggtcccgccgccgtgatgaatgtactgacgagccgaggcagcagtgcccccaccgtggccccccacgccccattaacccccacacccccattccgcgcaataaacgacagcattggcgccaaaaaaaaaaaaaaaaaaaaaaaaaaaaaaaaaaaaaaaaaaaaaaaaaaaaa

SEQ ID NO: 53173 - DNA, 1424 bp, Homo sapiens
ttcatcaaaagtttattgagcatccagtatgtgctaggcactctgctggatgctagtaatacaaagatgaagatgaaaacaacacaaaaacaaaccccacttccttacttacccctccccacccccaatttaaggcagatttggcctaagcctggcaagctggcccctcagggattcagcaccagggtatggcatgttctcatctcaccctaaccttcacctgtgcatctcaaggctgaccagcaggtactccttatccaagtcctgctgcctcttccaccttcttgagaaacttttcccctacatgcattatctcattatggatgaggcacctgggaagtttaggggagctgcgaaggcacacctgctcaaatgagcctggggaagtgccgagggacagggagctgagacaggcatgctgtggggttcagggcagagggggcaaactagaaatgtcagtgcctttggggctgagacaaaacttgacctggtgtggaggtgatgggtaactggggccttggaattgctccatgggttgatggcgaatcagagctggagtttaggagactagggatgcaaggacccttggaggcattaaggaggagggaacggaatacacagagggcctccttctctttcagctttttaattgccctctctcctcacacagtagattactgccactcctatgaactgttcaataggcggtggcatgggcatgtcctggctacacagcggcccagcctctttattttgatgttagtgtgattagggagtctgcctttttctgtgccctgggacctgagcatgtgggagcagggcagatgggtggcagaggccaggggttggatcatgttccccccaaatgctgggaagcaataagcctcctcctccccccaccatttctctggagattaggacttattctcacagctggagaagctcaacaactttcctgaggacaatgattgtttgaaaggcttgttttgtaagaagccaggaggaatatatgagtttgatgagctaaaacagttcctcatttggtctagttttcgggccaggggagtaagtgaaattcacttctctataagaataagcccatccatctcttttattcatgaacagagacagaaagagtgcttggcatggcatgcctccgagggaggctgtgggaggaggccaagctggcaggctcgggttctttgcccttgctagcgcccaggtcagagggaaaaggaatgtactcgtacccttccctcaccaccttgtaggtccccaggtaccaggtgcccagggaagaaggccttcacaatgatccccccagctcagaacagcccctgcacacccagtaaccggcatctggcttctccttagcttagtgcagctgtggattctgggaaagtggcctctctaatctgaacttg

SEQ ID NO: 53174 - DNA, 2356 bp, Homo sapiens
gacacacgcgaggcgctgtcctttcagcaccacaagctcgggctgaggagggaggactcctggccgtcctcctcctcttcaaattggcttgaatcttctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccaagctggagagaagagctgattttggcattactaagcccagaatgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcccctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgagaaaaaaaaaaaaaaaaaaaaaa

SEQ ID NO: 53175 - DNA, 1440 bp, Homo sapiens
ggtgtctccgcgtcgctgggtgggacttggctcggcggccatgggcaagcagaacagcaagctgcggcccgagatgttgcaggacctgcgagagaacacagagttctcagagctggagctgcaggagtggtacaagggcttcctcaaggactgccccacaggaatcctcaatgtggatgagttcaagaagatctacgccaacttctttccctatggtgacgcctccaagtttgccgagcacgtcttccgcacctttgacaccaacagcgatggcaccatagactttcgggagttcatcattgcgctgagcgtgacctcgcgcggccgcctggagcagaagctcatgtgggccttcagcatgtatgacctggacggcaacggctacatcagccgggaggagatgctggagatcgtgcaggccatttacaagatggtttcgtccgtgatgaagatgccggaggacgagtcgaccccggaaaagaggactgagaaaatcttccgccaaatggacacaaacaacgacggcaagctgtccttggaggagttcatccgcggggccaaaagcgacccgtccatcgtgcgtctgctgcagtgcgaccccagcagcgcctcccagttctgagaggagccaggttccccttcctccctcccttcaccggccccctcccggctcttagcttccactcccttgtgtgtattctggctgggggccagattggggaagcccttctccccgggtctgccctgtggggggcttccggaaaagggaaccctgcggtacccccaggccaaagcaagtaagcggttagcaccccccaatcccagaggcaacaatagagacacaggctgggttggtctgcccctcagtcaggcccccttacccacccaccagccccaaggcccgacccctcccccaaaggggcagtccccttcttgcaggtctcagcttgcggggtggggggagtcatgcccaggggaggagactttttatctggaggggagagaaggattctaggggtgtggagttggagaaagaggcttccttgagccacccttcccaccccagcccttgctggtccctaggccaagccaccaagtgaaaccttccaggatactagcccgccagctgtgggccccagaaagccagcctgccttttagcacttggatacacacagacccacggagctctctgtgtttggcctctcacacacacacaggcccatagacagatgggcagatgcacccagagccccatgcacagtgtcctgcgtgggaaagagacacggtccccctggctgagcccctgtcctcccctctgtccccccaaccgccccccctgcatgcagccaaatggagcatctctgttctttttaataatttcagaataaagtctcatttcagtgcaaaaaaaaaaaaaaaaaaaaaaaaaaaaaaaaaaa

SEQ ID NO: 53176 - DNA, 4277 bp, Homo sapiens
ggcggctccggcgcagaccttggagagcacagctgccggcccgcgagccagcctcggttcccgcggcccgccgaggctcggagccatccagcgacccggcgaccggcctcaggccccgccatggggaagaccaacagcaagctggcccccgaggtgctggaggaccttgttcagaacactgagttcagcgagcaggagctgaagcagtggtacaagggcttcctgaaggactgccccagcggcatcctcaacctggaggagtttcagcagctctacatcaagttcttcccctacggcgacgcctccaagttcgcgcagcacgctttccgcaccttcgacaagaacggcgacggcaccatcgacttccgggagttcatctgcgccctgtcggtcacctcccgcggcagcttcgagcagaagctcaactgggcctttgagatgtacgacctggacggcgacgggcgcatcacgcgcctggagatgctggagatcatcgaggcaatctacaagatggtgggcaccgtgatcatgatgcgcatgaaccaggacgggctcacgccccagcagcgtgtggacaagatcttcaagaagatggaccaggataaggacgaccagattacattggaggagttcaaggaggcagccaagagtgacccatccattgtgttgctgctgcagtgtgacatgcagaagtagaagctggtgaggggcagggtccctggccagaaggggcatggccacctcccaacctgatgacctctctggctggcctcccaggaggagggacactccagcccccctctctggcccacccagtcctctgcccaagcccttcctcccctccatcaagatctttgagggaccacctcaccctgcaaaagagacaggtcctccagtaccctgtcttctagccccacctcccacttggccagaaccaatgtccattgggcataggggagttggcttttgccccaggaggtgaggttaaggagttgggggcctggggttctggttaggaattctcttgatcctgggattatgctttataggatgtggtcccacaggcctgtcacagggccaaattgggtctgtccattcctgaggctccagatcccataaagggggtctcttccccatcccttctactctacctggcccttccagccccagcctttggagcgttcattcagtcctttcttcagctaatgattactgagcacctgtttggtgctaaggatatggtcatttacaagacacatcttgtgccctctggaagctcatagggttgtgaggcaaacttccagccgtcagggtctcagctaagcagaaggtgctggaaggctggttagtctgggaggagctatttcatcttccagctcagctccacacaaagctgcagaaggacgaaatgaaaagcatttggaagtttaggagccacgtgagtgaaagttttaagaaaaatgaaatttatgtcatacttatttttttagtaccctttaaaggagctacagtcattttattatttcaggaggttaaaatatactctatattacttggtttattataaaatgattaaatgaatagagaaaatattaattttcaaggggaaaaaacctgagaagaaagggagaaaagaccatgaaatttaccagataacactttttaagactaagtcctgagctgccactctcagcagtttttgctgcttcagctcttcctttttattacctttttcaattcaacaagcaactttctgctacatacttactccggttgggtgctgacttcagggacaggaaaaagcaaggtttgcaaagagtgaaactagtgtatattccgtatcttggtagttcgtttctggattgggtttagtttcagaactggacttgttccttcactgccacagaatcagaaagagctagaagaaaaggctcacctggccactgtttaggcacccagacataatttatggacgaaatgcctaaaaatgtgccaggcatgctctgtttgagaggctttttctaaccccaaatcttagatctgccaggtagttcaacatcttccaagtgtgctggttctgctttccaatgcctgcttcccaattttggatccatgagctatacagctgcatgctttgactgccggaaaaattaatcttgcttcttcatcaggtctttctcctgtacttgtgatcagaaattacctttgacgtgcagtgacagttgatttcctcttgaactgccggtgaaaacagtctagtacacaggtgctgtcagcccagggtgggagcaggaaatgattgctgagcccggggcaggggaattgcatctgcaggaaagagatgcagcatgctcctcactcctgagtgcccacctgtcctgcttctctgcaggtgaaaactctgggggatgctgatcaatagagcttggtcccaagctctactgggcccttggaggtagcaaggccactgggttgctatcctcttgctggggatagcaaccactggtttgcaaccactgggttgctatccttttgctatcctcttgctcatgaccagccatatggtgaggctggggagttcacatcctcaggcaggaactagcagttgtttatccagcaatgcctcaaggatgttgcattgctcccaggagctggctattaggtatgtcttgtgcggtcagtcagcatcacagacacatagatgctcaccagcctggcttagctgggacctaaatcttctggtgaaaagcttttcactaagtgaggttccttccctgcaaatgctgaatctagcctaattcgcaaccacacagaatttcatggctttcaaaggcttgccatgtgccccatctcattctatactcacatcccatggaggtgaggattttcacttcttttctctagacttggaagctgagattcagagaggaagcatcccttgtgcaagatcacatagtcaggaggtgacacagggctaagacttgaaccaaggctctaagaggatttcttcttttcagagtctcttccctgtccatttctgtgactaagctgtgcagaggttgacagcagggcaagttacattgatattcatcctttataggcttcctgctaaaaagcttctgagattgtggtcttccaaaaaaaataggagcttggttgaagtccccacattttcaagcactcagtgttctgcctctggcagctgtgctaacagctcagtgctgtcctgggagtcctctgactcagaaccctcgaagcatcctgcattgtctttacccaccatcatcgtcactaagagaaacatgcctacccatgaaggcgtgtttgattactccaggcttctggacacacatacccatgggtgatttttgctcctcaggcccaatattctcagacagcccagcagtgtgaacacacaatgccaggccaggaactgggaccaccatcttgctgatggaaggaacaacaggtggcccaggacatgctcctgcatactcctgggtgtcccagggactgtgtgctcaggagcactgtggtagagcactggccctgccttgagaagagacacaggtctcccgtccctgcaccagctgagagagacttgccacaaagcacaaggctggcagagatttatgtatgacttgcacagacacaaaaatatacagacaatcaaaacattgatatattcaaactctcctttaaattccaatcttattgcaacaactctgtgaattgcaaggtcccagaatctgccttctcacatactctaccctcattcatccttttgggctaattgatgagcatcttatttcttatctctaaaaattatcagcaaaggctacttcagatggccactttagtcctttcagctgtagtcaggattatttaacttacctgtatatcaaaagtgaagaaaaagttagttcataagtaaaggcactaaatcctttcctgacaatggcagagtctctagaggtagaaatttgccttgctgcagagagagaaggaatggcgtgggatgggggaaagaaaagaaagagaagaagctggggtctccaggcagggtagtaagctgacactaaatattttttacacaaaaatgtattgaagcaacaaatatttcctgaagatccaccctgggtgaggctttgagctgactttagagatcactgtggggtcaagaatgtcttacatgttttattcatcattcttgaaaaaagaaataattcaaaccttggaattaaaaagtcagaaaaataaaaaaaaaaaaaaaaaaa

SEQ ID NO: 53177 - DNA, 2699 bp, Homo sapiens
ccacgcgtccgccggctgcacggtcgcaccggcagcggctcaggctccggctcctctcccgctgcagcagccgcgctgccggccccactgggctcggatccggccccggccccctcggcaccgcctgctctggccccggccccggccccgcggaccatgcgctgggcgcccccaggggaaacccgacccggccaagggcccgcaaagacgaggctcccgggccggggcccctcccggccgcccagctctcggccggcgccctgccccgcgtcccggagccgcgtgagcctgcggggccatggagcgcgcgccgcccgacgggccgctgaacgcttcgggggcgctggcgggcgatgcggcggcggcgggcggggcgcgcggcttctcggcagcctggaccgcggtgctggccgcgctcatggcgctgctcatcgtggccacggtgctgggcaacgcgctggtcatgctcgccttcgtggccgactcgagcctccgcacccagaacaacttcttcctgctcaacctcgccatctccgacttcctcgtcggcgccttctgcatcccactgtatgtaccctacgtgctgacaggccgctggaccttcggccggggcctctgcaagctgtggctggtagtggactacctgctgtgcacctcctctgccttcaacatcgtgctcatcagctacgaccgcttcctgtcggtcacccgagcggtctcataccgggcccagcagggtgacacgcggcgggcagtgcggaagatgctgctggtgtgggtgctggccttcctgctgtacggaccagccatcctgagctgggagtacctgtccgggggcagctccatccccgagggccactgctatgccgagttcttctacaactggtacttcctcatcacggcttccaccctggagttctttacgcccttcctcagcgtcaccttctttaacctcagcatctacctgaacatccagaggcgcacccgcctccggctggatggggctcgagaggcagccggccccgagccccctcccgaggcccagccctcaccacccccaccgcctggctgctggggctgctggcagaaggggcacggggaggccatgccgctgcacaggtatggggtgggtgaggcggccgtaggcgctgaggccggggaggcgaccctcgggggtggcggtgggggcggctccgtggcttcacccacctccagctccggcagctcctcgaggggcactgagaggccgcgctcactcaagaggggctccaagccgtcggcgtcctcggcctcgctggagaagcgcatgaagatggtgtcccagagcttcacccagcgctttcggctgtctcgggacaggaaagtggccaagtcgctggccgtcatcgtgagcatctttgggctctgctgggccccatacacgctgctgatgatcatccgggccgcctgccatggccactgcgtccctgactactggtacgaaacctccttctggctcctgtgggccaactcggctgtcaaccctgtcctctaccctctgtgccaccacagcttccgccgggccttcaccaagctgctctgcccccagaagctcaaaatccagccccacagctccctggagcactgctggaagtgagtggcccaccagagcctccctcagccacgcctctctcagcccaggtctcctgggcatctggccctgctgccccctacccggctcgttcccccaggggtgagccccgccgtgtctgtggccctctcttaatgccacggcagccaccctgccatggaggcgccttcctgggttggccagagggcccctcactggctggactggaggctgggtggccggccctgccccccacattctggctccaccggggagggacagtctggaggtcccagacatgctgcccaccccctgctggtgcccacccttcgcagttactggttggtgttcttcccaaagcaagcacctgggtgtgctccaggcttcctgccctagcagtttgcctctgcacgtgcacacacctgcacacccctgcacacacctgcacaccgtccctctccccggacaagcccaggacactgcctttgctgccttctgtctcttgcataagcctcaggcctggccctttcacccctcttcccaccaactctctctgcccccaaaagtgtcaaggggccctaggaacctcgaagctgttctctgcttttccattctgggtgttttcagaaagatgaagaagaaaacatgtctgtgaacttgatgttcgtgggatgtttaatcaagagagacaaaattgctgaggagctcagggctggattggcaggtgtgggctcccacgccctcctccctccgctaaggcttccggctgagctgtgccagctgcttctgcccaccccgcctctgggctcacaccagccctggtggccaagcctgccccggccactctgtttgctcacccaggacctctgggggttgttgggaggagggggcccggctgggcccgagggtcccaaggcgtgcaggggcggtccagaggaggtgcccgggcaggggccgcttcgccatgtgctgtgcacccgtgccacgcgctctgcatgctcctctgcctgtgcccgctgcgctgccctgcaaaccgtgaggtcacaataaagtgtatttttttaaaaaaaaaaaaaaaaaaaaaaaaaaa

SEQ ID NO: 53178 - DNA, 3000 bp, Homo sapiens
ccgtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctgatctgcaacgtcaccctggggggcgaaaaccgggagacccgggagaacgtgaccatctacagcttcccggcaccactcctgaccctgagcgaacccagcgtctccgaggggcagatggtgacagtaacctgcgcagctgggacccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtacgcaccagcgctggacagcgtgggctgcccagaacgcattacttggctggagggaacagaagcctcgctgagctgtgtggcgcacggggtaccgccgcctgatgtgatctgcgtgcgctctggagaactcggggccgtcatcgaggggctgttgcgtgtggcccgggagcatgcgggcacttaccgctgcgaagccaccaaccctcggggctctgcggccaaaaatgtggccgtcacggtggaatatggccccaggtttgaggagccgagctgccccagcaattggacatgggtggaaggatctgggcgcctgttttcctgtgaggtcgatgggaagccacagccaagcgtgaagtgcgtgggctccgggggcgccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtcgccaccggagatggatgaatctacctgcccaagtcaccagacgtggctggaaggggctgaggcttccgcgctggcctgcgccgcccggggtcgcccttccccaggagtgcgctgctctcgggaaggcatcccatggcctgagcagcagcgcgtgtcccgagaggacgcgggcacttaccactgtgtggccaccaatgcgcatggcacggactcccggaccgtcactgtgggcgtggaataccggccagtggtggccgaacttgctgcctcgccccctggaggcgtgcgcccaggaggaaacttcacgttgacctgccgcgcggaggcctggcctccagcccagatcagctggcgcgcgcccccgggggccctcaacatcggcctgtcgagcaacaacagcacactgagcgtggcaggcgccatgggaagccacggcggcgagtacgagtgcgcacgcaccaacgcgcacgggcgccacgcgcggcgcatcacggtgcgcgtggccggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctcaacggagcgggcggcggcgctggcggggcggcaggcgcggagggcggacccgaggcggcggggggcgcggccgagtcgccggcggagggcgaggtcttcgccatacagctgacatcggcgtgagccgctcccctctccccgcgggccgggggacgccccccagactcacacgggggcttatttattgctttatttatttacttattcatttatttatgtattcaactccaagggcgtcacccccattttctacccatcccctcaataaagtttttataaagga

SEQ ID NO: 53179 - DNA, 2701 bp, Homo sapiens
gttgctgcggagccaggaggggaagcgatggctgggcccgcgtggatctctaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactgaaaaaaaaaaaaaaaaaaaaaaaaaaaaaaaaaaaaa

SEQ ID NO: 53180 - DNA, 3347 bp, Homo sapiens
atgtttgttctcttcttgtgcaacctttccttggtaccagcggccgcttcaaagaataaagttaaaggcagccaagggcagtttccactaacacagaatgtaaccgttgttgaaggtggaactgcaattttgacctgcagggttgatcaaaatgataacacctccctccagtggtcaaatccagctcaacagactctgtactttgacgacaagaaagctttaagggacaataggatcgagctggttcgcgcttcctggcatgaattgagtattagtgtcagtgatgtgtctctctctgatgaaggacagtacacctgttctttatttacaatgcctgtcaaaacttccaaggcatatctcaccgttctgggtgttcctgaaaagcctcagattagtggattctcatcaccagttatggagggtgacttgatgcagctgacttgcaaaacatctggtagtaaacctgcagctgatataagatggttcaaaaatgacaaagagattaaagatgtaaaatatttaaaagaagaggatgcaaatcgcaagacattcactgtcagcagcacactggacttccgagtggaccggagtgatgatggagtggcggtcatctgcagagtagatcacgaatccctcaatgccacccctcaggtagccatgcaggtgctagaaatacactatacaccatcagttaagattataccatcgactccttttccacaagaaggacagcctttaattttgacttgtgaatccaaaggaaaaccactgccagaacctgttttgtggacaaaggatggcggagaattaccagatcctgaccgaatggttgtgagtggtagggagctaaacattcttttcctgaacaaaacggataatggtacatatcgatgtgaagccacaaacaccattggccaaagcagtgcggaatatgttctcattgtgcatgatgttcccaacactttgcttcccactactatcatcccctcccttaccactgcaacagtcacaaccactgtagccataacaaccagcccaaccacatctgcaacaaccagcagcatcagagatcctaatgctttggctggccagaatggccctgaccatgctctcataggaggaatagtggctgtagttgtatttgtcacgctgtgttctatctttctgcttggtcgatatctggcaaggcataaaggaacgtatttaacaaatgaagctaaaggagctgaagatgcaccagatgctgatacagccattatcaatgctgaaggcagccaagtcaatgctgaagagaaaaaagagtatttcatttaagatgcaggccaagattctgagttttactaccaggctgaatgctggagaaaactggctatcatctttcagaagtcatttctaccatcgtctgctacccttattaactcccatactgtactgctatcagtagccagtgtataccaacaatcagctgttgaaagcatcattctttaattactgtaccatccataatgcaggacatttcttactgcctaaatttcacaccattgctcttttaacatacagtgcttgaatatacagccttaacaatgttaatcatctccttggatcattatattgagtggtttttatacattaaaaaatgtatgcagagtttttttcccccattttttcccctttaagtcatagaccttatcagtttgccattggacagctttcacaagtaacaggattagggaaggacataatgtatttaagaataagtgaaggttagaggtttacaattaatgttttctacatgtctgtcttcaaagacaacatgctttggaaacatatgtcctagaaaacataaaattaaaaaaaaacactatagtgtagtttttggaatgttggagattatactggtaaagctgtatcgatttgctattgaaatatagtatttgatacaggagccatgtgtacgaattgcaatcatgacatggtattttctataattatagagatcttactattaggatattgtagcttcatttaccaataaattattccaaatgatttactgcttttggaatcacaaatatttaattcatttctctaatttgattctataatttatttgcttcataaagattcacctgcctaaacaatattgaagtatccatagggcacaattttcagacattttagtatctgtatatagtgcatataataaatccaattaaacattatttgatacatatttaacttttttggctgtatgtaattcagtcataagtaagcattttctaacgtccattatatccctttaggtattacttaaaccaatattataagtagataacatgtattagtatttttgtctgtatgtcctagcactgttcaacaacaaatttttctagttcttgttaatttttatttgttatacaatggaagcacaatgttataaggaaaggtaattttaagctaacaaccagtgcacagcctcaggttttaaattacaaccacagttgaataataacctaaaaataaattttagtttgctaaaaatttacaaattttcattttgcagttccagagctgcttacctatgttggtttgccaaaaagaagtgtttaagatatgttttctgtataaatgaactaattctttatattaaattcctgtctatgcattttgtgaggtacaaactgatgaaacagtgagtgatagagaatttctgccatgcttttaactccaaagtgaaagtctctttctctggattattttaaaattttggcgtgtttaaccattaagaaatgctgtattcttaaatatgaaacagttaatctaaagtcttattatttcttctagtaaaataaaatattgttagattagttctcattaaatttattatatgctaaagaataaaactccagttagatttaaaaaaatcccatttacaagcattgcacctttaagaagaaaacaaatatgacagtatggtagctatacttgtgatgtctgacgcatgatggcctatggttttaaaaatagtattgtggaatatatttttgggtaataagaatggttgagtgcaacatcatgtattaatatcaaatgaaagacaagggtgctgtatctttgattatttatcaaaaaagtataaatcttttaaggaaaatgttagaattttaaagtttttttttgattgttgaagcatttatcttgttgatttcttacaaaagaaaaaggacgatgtcagtcaagcagcactttttcagaatatacagaacataaataatatgatgtggttgagtgttaacataataaatcatatacagtatgacattttaaggaaaaaaaaaaaaaaaaaa

SEQ ID NO: 53181 - DNA, 2297 bp, Homo sapiens
ccacgcgtccgttcggcagctccagttcagctcgctcggcgcacccacgcctcgctgccccgcttcctgccctcaacctgggcatgcgccccccacccttccggccccccagaacccgcgccatcccccggagcctccccagagctggccgcgcaggatgggcgccctcaggcccacgctgctgccgccttcgctgccgctgctgctgctgctaatgctaggaatgggatgctgggcccgggaggtgctggtccccgaggggcccttgtaccgcgtggctggcacagctgtctccatctcctgcaatgtgaccggctatgagggccctgcccagcagaacttcgagtggttcctgtataggcccgaggccccagatactgcactgggcattgtcagtaccaaggatacccagttctcctatgctgtcttcaagtcccgagtggtggcgggtgaggtgcaggtgcagcgcctacaaggtgatgccgtggtgctcaagattgcccgcctgcaggcccaggatgccggcatttatgagtgccacaccccctccactgatacccgctacctgggcagctacagcggcaaggtggagctgagagttcttccagatgtcctccaggtgtctgctgcccccccagggccccgaggccgccaggccccaacctcacccccacgcatgacggtgcatgaagggcaggagctggcactgggctgcctggcgaggacaagcacacagaagcacacacacctggcagtgtcctttgggcgatctgtgcccgaggcaccagttgggcggtcaactctgcaggaagtggtgggaatccggtcagacttggccgtggaggctggagctccctatgctgagcgattggctgcaggggagcttcgtctgggcaaggaagggaccgatcggtaccgcatggtagtagggggtgcccaggcaggggacgcaggcacctaccactgcactgccgctgagtggattcaggatcctgatggcagctgggcccagattgcagagaaaagggccgtcctggcccacgtggatgtgcagacgctgtccagccagctggcagtgacagtggggcctggtgaacgtcggatcggcccaggggagcccttggaactgctgtgcaatgtgtcaggggcacttcccccagcaggccgtcatgctgcatactctgtaggttgggagatggcacctgcgggggcacctgggcccggccgcctggtagcccagctggacacagagggtgtgggcagcctgggccctggctatgagggccgacacattgccatggagaaggtggcatccagaacataccggctacggctagaggctgccaggcctggtgatgcgggcacctaccgctgcctcgccaaagcctatgttcgagggtctgggacccggcttcgtgaagcagccagtgcccgttcccggcctctccctgtacatgtgcgggaggaaggtgtggtgctggaggctgtggcatggctagcaggaggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagagctgggagtccggcctggaggaggccctgtcagcgtagagctggtggggccccgaagccatcggctgagactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatgaagaggcttcgaaaacggtgatcccttactcctcaggtcttgcaggtgtcgactgtcttccggcccagctccaagccctcctctggttgcctggacaccctctccctctgtccactcttcctttaatttatttgacctcccactacccagaatgggagacgtgcctccccttccccactccttccctcccaagcccctccctctggccttctgttcttgatctcttagggatcctatagggaggccatttcctgtcctggaattagtttttctaaaatgtgaataaacttgttttataaaaagcaaaaaaaaaaaaaaa

SEQ ID NO: 53182 - DNA, 3243 bp, Homo sapiens
cttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggccgcgctgcgacagcgccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaaggcgccgagcgcgccctgaaggcgcagcagcgcgacgtggacggcgccacgctggcccgcctggacctggagaagaaggtggagtcgctgctggacgagctggccttcgtacgccaggtgcacgacgaggaggtagccgagctgctggccacgctgcaggcgtcgtcgcaggccgcggccgaggtggacgtgactgtggctaaaccagacctgacctcggctctgagggagatccgcgcccagtatgagtccctggccgctaagaacctgcagtccgcggaagaatggtacaagtccaagtttgccaacctgaacgagcaggcggcgcgcagcaccgaggccatccgggccagccgcgaggagatccacgagtatcggcgccagctgcaggcgcgcaccatcgagatcgagggcctgcgcggggccaacgagtccttggagaggcagatcctggagctggaggagcggcacagtgccgaggtagctggctaccaggatagcattgggcagctggagaatgatctgaggaacaccaagagtgagatggcacgccaccttcgggaataccaggacttgctcaatgtcaaaatggctcttgacattgagatagcagcttacaggaaactgctggaaggcgaggagacacgttttagcaccagtgggttaagcatttcggggctgaatccacttcccaatccaagttacctgctcccacctagaatcctcagtgctacaacctccaaagtctcatccactgggctatcacttaagaaagaggaggaggaggaggaggcatctaaggtagcctctaagaaaacctcccagataggggaaagttttgaagaaatattagaggagacagtaatatctactaagaaaaccgagaaatcaaatatagaagaaaccaccatttcaagccaaaaaatataattccattgctttgaaaaagttaatgcttaagagggaatgatatgcatttgacttgttaaacagcctattcctgaactataacacctgccaccactataaaatgtcttcaaggcttcagtctcatatttagtattgaatacttacattctctaataagaaaaccaccccttagattgaagtaaactgcagtcctggagcaatcacagatgagttatctaagaatacagctttctgaccttcagctcacgcttcacagtgatcgatgattcaggtgcagaggaagtacaaactaaggtgctaaatctgcgatcatcgtcatttgctgtgaactgaaattaaaactattcatgctacccagccattacccagctaaataatcttactctagatacctaaaacataagatcactgccagagataaactaatggtccacacccaattccactctgatagaattatttcacaaataataggtgtttgtttaatggacacttttcacctccttcaattccatatatccttttcttctatgtaggaaaaaaatagtctagtgtagtattcttcccttttaaacacattttggttcttctcaaaagaacttacccccattcgcgctctgctcagtgggtaaaattagatgcatgttgaccatgtctatgattcgtgtaattacttatccctgcccatttcatattctttcaattctgtaggttaaaaaaatggcagtgatgaattttaagggtttcccccaacatataaaataatgcaaagaatccctagactttaggctttcagcttacacaaatctatttaattaggaaaaaaaactattaaggatgtagcttttcacctttactttagaagcacagtaaatatcccaaactgtgatgaagccgaccttagatttagtagtgtaagctagaagaagtgagtgtttctatgagtggaaaaagccaaggtgtcatttatgtgtcagttcatttgtggtgatatagaattagctttttcatccccttacccttagaatccacgtattccccttcccactagcctaggtcataaagaggcgttgctttcactctcctatgccttttacgagtgctaagtgtaggatattttgtcaccagaacacaatgctaccgccccaaagtaaaagaaaccacttctggtcaatcaacactaccagcgtatatataagaaagacatctttctcttttctaaaagacttccctaacacttaccccatggctgcacagttggtggggtcctgccggagaggaagagacactcagaccagagaaggggtgtgcatgcgcctactcgcttgctagaagtagattctggacagtcagctcttcatctgcccaactgtgtagcatctgcattgcccagtctttcatgtgtgccaaggctgatgcaggatttgttctctgtccagcagtcacttcggccagagctgaagagttgccccgtctctgttccatgtctcctttaagagctctggtgataaggacatgatgcttttactgaactttcttatcctagcacatgcttcaatagttcaaggaacttgaaaaatacttttccttacctttaccccatccctgtctttactcctcacacttactgtaagacattagtaacataataaattaaaagtcacacgaatctcaccaaaaaaaaaaaaaaaaaa

SEQ ID NO: 53183 - DNA, 2551 bp, Homo sapiens
agctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaaggtgggcaaactgcgcgagcggctgcaggaggcgaagctggagcgcgagcaggagcagcgacggcacacggcctacatttcggagctcaaggccaagctgcatgaggagaagaccaaggagctgcaggcgctgcgcgaggggctcatccggcagcacgagcaggaggcggcgcgcaccgccaagatcaaggagggcgagctgcagcggctgcaggccacgctgaacgtgctgcgcgacggcgcggccgacaaggtcaagacggcgctgctgaccgaggcgcgcgaggaggcgcgcagggccttcgatggagagcgcctgcggctgcagcaggagatcctggagctcaaggcagcgcgcaagcaggcagaggaggcgctcagtaactgcatgcaggctgacaagaccaaggcagccgacctgcgtgccgcctaccaggcgcaccaagacgaggtgcaccgcatcaagcgcgagtgcgagcgcgacatccgcaggctgatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagatttacagactggaaatggaagagaaccagctgaagaatgaaatgcaagacgccaaggatcagaacgagctgttagaattcagagtgctagaactcgaagtaagagactctatctgttgtaaactctcaaacggagcagacattctctttgaacccaaactgaaattcatgtaaagctctcagatgttttcaagcatgtgtaaaggggacatgttatagtttctttctttctttctttctttttttttttaaatctgtatgttcagaataatttcactgccttaatgtgttctggagagcgtgctcacccaagtctatggacatgtaccagagctaatatatttattgcctatggcttgttttgcacttaataaaataatttgtttttgcaaaa

SEQ ID NO: 53184 - DNA, 2304 bp, Homo sapiens
ttgtgtttagaaaaggctcgggcaaagccagcccaagttcgctctctgcacacctcgagcacctcgcggacggcgtgggtccgccagctccgggacctgccgccgctgcctgcgcgccccggggcggaggacggtgccagccgcccacgaggagaccccgctcccgcaggaggccgagctgaagcggcggagcgcgccgccagccagccggggtgagtgccccgggcgaggccggcggccgccaaagcccccgcgggctcgcccgggcgcccggatgccagccccgagccccgccgccgggtgcatgcctcccccgcggcgcgcccccgcaggctgctgcccgctgtgaccgcccttccccgcaggcgggcgccggccaggctctccccgagatcagcgcacgggtggcacccgccggacccccagcggcagcggcggcggcggctgcagggggcgcggggcggaggctgcgagggcgcgcgcggggaggatggacgggtccggggagcgcagcctcccggagccgggcagccagagctccgctgccagcgacgacatagagatagtcgtcaacgtggggggcgtgcggcaggtgctgtacggggacctcctcagtcagtaccctgagacccggctggcggagctcatcaactgcttggctgggggctacgacaccatcttctccctgtgcgacgactacgaccccggcaagcgcgagttctactttgacagggacccggacgccttcaagtgtgtcatcgaggtgtactatttcggggaggtccacatgaagaagggcatctgccccatctgcttcaagaacgagatggacttctggaaggtggacctcaagttcctggacgactgttgcaagagccacctgagcgagaagcgcgaggagctggaggagatcgcgcgccgcgtgcagctcatcctggacgacctgggcgtggacgcagccgagggccgctggcgccgctgccagaagtgcgtctggaagttcctggagaagcccgagtcgtcgtgcccggcgcgggtggtggccgtgctctccttcctgctcatcctcgtctcgtccgtggtcatgtgcatgggcaccatccccgagctgcaggtgctggacgccgagggcaaccgcgtggagcacccgacgctggagaacgtggagacggcgtgcattggctggttcaccctggagtacctgctgcgcctcttctcgtcacccaacaagctgcacttcgcgctgtccttcatgaacattgtggacgtgctggccatcctccccttctacgtgagcctcacgctcacgcacctgggtgcccgcatgatggagctgaccaacgtgcagcaggccgtgcaggcgctgcggatcatgcgcatcgcgcgcatcttcaagctggcccgccactcctcgggcctgcagaccctcacctatgccctcaagcgcagcttcaaggaactggggctgctgctcatgtacctggcagtgggtatcttcgtcttctctgccctgggctacaccatggagcagagccatccagagaccctgtttaagagcatcccccagtccttctggtgggccatcatcaccatgaccaccgtcggctacggcgacatctaccccaagaccacgctgggcaagctcaacgcggccatcagcttcttgtgtggtgtcatcgccatcgccctgcccatccaccccatcatcaacaactttgtcaggtactacaacaagcagcgcgtcctggagaccgcggccaagcacgagctggagctgatggaactcaactccagcagcgggggcgagggcaagaccgggggctcccgcagtgacctggacaacctccctccagagcctgcggggaaggaggcgccgagctgcagcagccggctgaagctctcccacagcgacaccttcatccccctcctgaccgaggagaagcaccacaggacccggctccagagttgcaagtgacaggagggcccctcaggcagagatggaccaggcggtggacagatgggtagatgtggcaggcatgtcatcgacagcacagaagggctgtcctgtgtccccccaaccctcccctggacagactctgaaggccctcccggcacctctgccaaggctgggtaagactcctctatgttgcctgctgtccaggagcccgggagggaggggtgtgcaggagccgcagggccgtgtgggacgagtggaggccgcggcctggctggcacgagagcccacgcccgcttctgtatctccctcaataaagcctcctgctctgtgcaaaaaaaaaaaaaaaa

SEQ ID NO: 53185 - DNA, 3853 bp, Homo sapiens
ggccgcggggcctggagcccgggatttgtgggcggcgagggcgcgaggggccgcgcgccatgctccgggccccgacggcgcggacgccccctcgcgcgccagcgtccggcgcgaccccggatcccggtctgcgcattgccccccgacggctgcgctagggagcgcggggcccggcggggggcggccgagctgggcgccctcccccggcgcggagtccccgcaccccggagggatggggcgggcagccgcgggcgcctaagatgccggccatgcggggcctcctggcgccgcagaacaccttcctggacaccatcgctacgcgcttcgacggcacgcacagtaacttcgtgctgggcaacgcccaggtggcggggctcttccccgtggtctactgctctgatggcttctgtgacctcacgggcttctcccgggctgaggtcatgcagcggggctgtgcctgctccttcctttatgggccagacaccagtgagctcgtccgccaacagatccgcaaggccctggacgagcacaaggagttcaaggctgagctgatcctgtaccggaagagcgggctcccgttctggtgtctcctggatgtgatacccataaagaatgagaaaggggaggtggctctcttcctagtctctcacaaggacatcagcgaaaccaagaaccgagggggccccgacagatggaaggagacaggtggtggccggcgccgatatggccgggcacgatccaaaggcttcaatgccaaccggcggcggagccgggccgtgctctaccacctgtccgggcacctgcagaagcagcccaagggcaagcacaagctcaataagggggtgtttggggagaaaccaaacttgcctgagtacaaagtagccgccatccggaagtcgcccttcatcctgttgcactgtggggcactgagagccacctgggatggcttcatcctgctcgccacactctatgtggctgtcactgtgccctacagcgtgtgtgtgagcacagcacgggagcccagtgccgcccgcggcccgcccagcgtctgtgacctggccgtggaggtcctcttcatccttgacattgtgctgaatttccgtaccacattcgtgtccaagtcgggccaggtggtgtttgccccaaagtccatttgcctccactacgtcaccacctggttcctgctggatgtcatcgcagcgctgccctttgacctgctacatgccttcaaggtcaacgtgtacttcggggcccatctgctgaagacggtgcgcctgctgcgcctgctgcgcctgcttccgcggctggaccggtactcgcagtacagcgccgtggtgctgacactgctcatggccgtgttcgccctgctcgcgcactgggtcgcctgcgtctggttttacattggccagcgggagatcgagagcagcgaatccgagctgcctgagattggctggctgcaggagctggcccgccgactggagactccctactacctggtgggccggaggccagctggagggaacagctccggccagagtgacaactgcagcagcagcagcgaggccaacgggacggggctggagctgctgggcggcccgtcgctgcgcagcgcctacatcacctccctctacttcgcactcagcagcctcaccagcgtgggcttcggcaacgtgtccgccaacacggacaccgagaagatcttctccatctgcaccatgctcatcggcgccctgatgcacgcggtggtgtttgggaacgtgacggccatcatccagcgcatgtacgcccgccgctttctgtaccacagccgcacgcgcgacctgcgcgactacatccgcatccaccgtatccccaagcccctcaagcagcgcatgctggagtacttccaggccacctgggcggtgaacaatggcatcgacaccaccgagctgctgcagagcctccctgacgagctgcgcgcagacatcgccatgcacctgcacaaggaggtcctgcagctgccactgtttgaggcggccagccgcggctgcctgcgggcactgtctctggccctgcggcccgccttctgcacgccgggcgagtacctcatccaccaaggcgatgccctgcaggccctctactttgtctgctctggctccatggaggtgctcaagggtggcaccgtgctcgccatcctagggaagggcgacctgatcggctgtgagctgccccggcgggagcaggtggtaaaggccaatgccgacgtgaaggggctgacgtactgcgtcctgcagtgtctgcagctggctggcctgcacgacagccttgcgctgtaccccgagtttgccccgcgcttcagtcgtggcctccgaggggagctcagctacaacctgggtgctgggggaggctctgcagaggtggacaccagctccctgagcggcgacaatacccttatgtccacgctggaggagaaggagacagatggggagcagggccccacggtctccccagccccagctgatgagccctccagccccctgctgtcccctggctgcacctcctcatcctcagctgccaagctgctatccccacgtcgaacagcaccccggcctcgtctaggtggcagagggaggccaggcagggcaggggctttgaaggctgaggctggcccctctgctcccccacgggccctagaggggctacggctgccccccatgccatggaatgtgcccccagatctgagccccagggtagtagatggcattgaagacggctgtggctcggaccagcccaagttctctttccgcgtgggccagtctggcccggaatgtagcagcagcccctcccctggaccagagagcggcctgctcactgttccccatgggcccagcgaggcaaggaacacagacacactggacaagcttcggcaggcggtgacagagctgtcagagcaggtgctgcagatgcgggaaggactgcagtcacttcgccaggctgtgcagcttgtcctggcgccccacagggagggtccgtgccctcgggcatcgggagaggggccgtgcccagccagcacctccgggcttctgcagcctctgtgtgtggacactggggcatcctcctactgcctgcagcccccagctggctctgtcttgagtgggacttggccccaccctcgtccggggcctcctcccctcatggcaccctggccctggggtcccccagcgtctcagagctccccctggcctcgagccacagctttctggacctccacctcagactcagagccccctgcctcaggagacctctgctctgagcccagcacccctgcctcccctcctccttctgaggaaggggctaggactgggcccgcagagcctgtgagccaggctgaggctaccagcactggagagcccccaccagggtcagggggcctggccttgccctgggacccccacagcctggagatggtgcttattggctgccatggctctggcacagtccagtggacccaggaagaaggcacaggggtctgagtaccagccctagaactcagcgttgccaggtgtgctgccatctgctgttcggcccaacctcagagtgaaggcagggtggcagcctccccacggactccatgcggcccgctggctcagggcagggagcctggaagcaaaggaggacctggctcctgactctcagagaggataggctggatccctggggcaggcctctcctcggcctgctcctctgacctcccggtctccctctgcaggctgggggcagaggcctgaggacaaggaagagctttgccatcccctgcatgtgcccctgcctctacctgtccccaaatttttatattaaaaaaaaaaaataaaat

SEQ ID NO: 53186 - DNA, 4440 bp, Homo sapiens
gacaagcccttatctgatcccagctccgggtttaagagtcctggcccggcccgtcgcacagctctgctcctaactcctgcccgccccgtccgtccatctgtcccgctgccccgcggcccatccaaggggccactccacctcggacccaagatgacgtcagttgccaaggtgtattacagtcagaccactcagacagaaagccggcccctaatgggcccagggatacgacggcggagagtcctgacaaaagatggtcgcagcaacgtgagaatggagcacattgccgacaagcgcttcctctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggtaccttcctggcgaagattgcccggcccaagaagcgggctgagaccattcgtttcagccagcatgcagttgtggcctcccacaatggcaagccctgcctcatgatccgagttgccaatatgcgcaaaagcctcctcattggctgccaggtgacaggaaaactgcttcagacccaccaaaccaaggaaggggagaacatccggctcaaccaggtcaatgtgactttccaagtagacacagcctctgacagccccttccttattctaccccttaccttctatcatgtggtagatgagaccagtcccttgaaagatctccctcttcgcagtggtgagggtgactttgagctggtgctgatcctaagtgggacagtggagtccaccagtgccacctgtcaggtgcgcacttcctacctgccagaggagatcctttggggctacgagttcacacctgccatctcactgtcagccagtggtaaatacatagctgactttagcctttttgaccaagttgtgaaagtggcctctcctagtggcctccgtgacagcactgtacgctacggagaccctgaaaagctcaagttggaggagtcattaagggagcaagctgagaaggagggcagtgcccttagtgtgcgcatcagcaatgtctgatgacctgttcccactcccccattcctctggtctcttttcctctcttccaatgccctggtaaggaatactacccgggtttactggagatcccccgaagcacccatcctccactccctcttctttaacccagtggcctgttggtagcttaggccaactggagtccaggttcgcctcccactgtcccctttccacttccccagcttctgccccaatacacatacctcccttaagccaggatgggggaaagagtgggattaggctgaagtggcttagaaggcctcagccatgcttggatactcacattaggaggaccatgtggttggaaggatagactgccccctacctcccaccaccaccatgaagtttggtgacttgaggctggagctccctctgttacctttccatctagcaagttcccaaaggcaagactctctctgatggtcactttgtggtctgtgctttcagaaatacaggaatctgatatcaacatatcctagggtttctaccaatctctgttgaaagaagccagggtttgccactgtgaagcttgatttctgctggtgacttctgaccataagctagaaccatggtcgccactgttttccctctgtagtttctcaagtgaacactctcaggatacccagttccctcatagcctctgttctcagagaattggagttggcccaagaaacataaacatataaccacccatatctatcctggattctgaactcttcaatttggagtgactaacacaagttgttatctaaacctttaaacctatcttccaggcagcccagagaagatctgtttccctgtgtcctgtgaatggaaggacccaagccaatatgttcctttgaaaagagtccagtacccaggccccatggaaaggtctgaaaataatattccagattacactgtacctggcttctcttcttcctttcctgctcagcctagatccttcttccttaaccccaactctttgggagaagggagggaaaatgcaagggccttcctctcttaacacggatgctcaagtaaaactagattcacagggcacagattccccagaaagttaacacaatcccaccatgagggatgggtaaattctcagatttccaaactgctgtacagagcctctgagaattggtgatgctttgttaaggtttgggcaggagcagaactctgtggctggcagccactattctcagttacacctcccagtgcccttctgaaaagtgccagctatttcattaggcaatgctggaaggaaatgaaattataccttctgatcaaataaccatggcttccctcagccattcctgagacttggtataaaatgaagaaatcagtgtcatctctactctcctctgccatgaggccattttcagacaagttaaaaagtagactttaagagatcaaactcagcctattccttgttccctggtggggtctgtggtaagggtcagggaagggcatataggcaccagagctttatccaaagccccaaatccctagagtgctttctggtctcactttggtaccaaggaagcctcacatagtggtactgcatagtcccactataagtcaagttgcagtttaaggtggtctcagccaattgttacaagctacagaatatatacatgcatctatgtacagagccttgcagagaaacacaaaattttgaggctagacccatgatcaccaccaactataattgcacaaggtcttgttatattgatctctcctcgaactcaactaactatatcttgaaaacaaagacccttcggtgtccatctacagtaaaccccaccattaccttctagttggcataaaaacaagaaccacaaaaacttgaaaaatctgaaacagagaacagaaggccaagagccagcttctgcgttctcaactttattcaacattagacttaccttatttctttcagtgtgtagggacaagatgtactgctgtgtgtgtgtgtgtgtgtgtgtgtgtgtgtgtgtgtgtgtgtgtgtgtgtctataccttcctatccattgccaagttaacctccatctggtttatttggccatgctatgctttcttcccattcccctgctgtctattctaagcccccagactcaagcctctagactcttggatgaaacagtgagaagaaaacattttctgacttacccttttggaatctcctccattattacccaggctttgctttaagttgcactttaaatcacactgtcctattaatgcgatctggcatcttctcccacaagccccctacagggaacaactaccccctaccttaactctaaatggttctttagactatagtctgtctcctctgacctgaaatcctcttttaggcaataggccgagctttagaagcagccaggtctggtgagaaatgggcccccataccaactgtggacttggaatatcagcagagtagtaggcacagttgtaaaaaggggagatttcggtaggcacaggtgtaaaaaggggagatttcagaagacgggcgaaacaactgatgggggaagatacctggggtgagaagatgagaaagaaatgatgctgagggacctagtgaaatcaatgaaactcttgagtcttgcttaggctcgcaaacaagaagtggggaggcttgggaaattaggatatgacatatatgaaaggtttatctaagaagaaagaaacagagataatatatatatagaaagatgtatatagatgtatatatgcccaaatatattgaatgtacagaaaggaaatattcagagactttagcattgggggcagatatcttggcctggttatggggtaggacacccagattttcagacttacaatcagtggtcctggtttcaacatggaagtgagatagctgatgaaggatttcaagtctggaaatgggaaagggaggggtagaagttccttttcagaaataaagaggcattcatgaaggcttttgttgaatcctatgctactgataggaccaggaagagaggaactcggaggacaatagggaggggaagtcttggaaaatctaccacttacactgtgtgtccccatccccagcagcgtcctgccactgtagcgcctttttaaaataaataaaataaaataaagcaccattttgtttccctttca

SEQ ID NO: 53187 - DNA, 1913 bp, Homo sapiens
gagaatttcaaccagaaagaacagccagtgcaaaggcccagagacaggaataaacttggccctgcgtcttcccaggtgaccacgccggcttcaggacatgcacggacacagccgcaacggccaggcccacgtgccccggcggaagcgccgcaaccgcttcgtcaagaagaacggccaatgcaacgtgtacttcgccaacctgagcaacaagtcgcagcgctacatggcggacatcttcaccacctgcgtggacacgcgctggcgctacatgctcatgatcttctccgcggccttccttgtctcctggctctttttcggcctcctcttctggtgtatcgccttcttccacggtgacctggaggccagcccaggggtgcctgcggcggggggcccggcggcgggtggtggcggagcagccccggtggcccccaagccctgcatcatgcacgtgaacggcttcctgggtgccttcctgttctcggtggagacgcagacgaccatcggctatgggttccggtgcgtgacagaggagtgcccgctggcagtcatcgctgtggtggtccagtccatcgtgggctgcgtcatcgactccttcatgattggcaccatcatggccaagatggcgcggcccaagaagcgggcgcagacgttgctgttcagccaccacgcggtcatttcggtgcgcgacggcaagctctgcctcatgtggcgcgtgggcaacctgcgcaagagccacattgtggaggcccacgtgcgggcccagctcatcaagccctacatgacccaggagggcgagtacctgcccctggaccagcgggacctcaacgtgggctatgacatcggcctggaccgcatcttcctggtgtcgcccatcatcattgtccacgagatcgacgaggacagcccgctttatggcatgggcaaggaggagctggagtcggaggactttgagatcgtggtcatcctggagggcatggtggaggccacggccatgaccacccaggcccgcagctcctacctggccagcgagatcctgtggggccaccgctttgagcctgtggtcttcgaggagaagagccactacaaggtggactactcacgttttcacaagacctacgaggtggccggcacgccctgctgctcggcccgggagctgcaggagagtaagatcaccgtgctgcccgccccaccgccccctcccagtgccttctgctacgagaacgagctggcccttatgagccaggaggaagaggagatggaggaggaggcagctgcggcggccgcggtggccgcaggcctgggcctggaggcgggttccaaggaggaggcgggcatcatccggatgctggagttcggcagccacctggacctggagcgcatgcaggcttccctcccgctggacaacatctcctaccgcagggagtctgccatctgacctccaggcccggccctcaccactgcccacaagagcctctgccgggggtgggatgccaggacaccccctcccacactcaggacagagccaaccctggctccgtggaccttctggaggaaggtgggggtttcaaagactgggggaccccttcctcctgactccagcacccaggcctgggaagagctcggccccgatcagcctgagttccgccagcgcctacttctggtggctctaggtccccggatccaccacccttcccccactgactcttcaaggacgtgccctctttgctctcagaaccttggggaaggtggctggactgctgggcgggggacatctcggggtttcagggtgggcagggggttagtttggggaggggggggtgcgtttcttttgcatgactgtggcctgttgctcatgactttcttttgtaaatatctataaatggagacagatggagacaccaaaaaaaaaaaaa

SEQ ID NO: 53188 - DNA, 2063 bp, Homo sapiens
gagcggcgcgggacggccgggacgcgcggagaccccaagacccacgcgcagaccgagcggcagccggggaggggagcgcgggccggccggccgagttcgcgggcagggggcgccgggactcccctctccgcgcccgggacgccgcccgccggatcgcgccttgggatgtagcgcccgctcgccgcctcccggactctcgtcggaccctccgcccagcggccctgcgtcttcccaggtgaccacgccggcttcaggacatgcacggacacagccgcaacggccaggcccacgtgccccggcggaagcgccgcaaccgcttcgtcaagaagaacggccaatgcaacgtgtacttcgccaacctgagcaacaagtcgcagcgctacatggcggacatcttcaccacctgcgtggacacgcgctggcgctacatgctcatgatcttctccgcggccttccttgtctcctggctctttttcggcctcctcttctggtgtatcgccttcttccacggtgacctggaggccagcccaggggtgcctgcggcggggggcccggcggcgggtggtggcggagcagccccggtggcccccaagccctgcatcatgcacgtgaacggcttcctgggtgccttcctgttctcggtggagacgcagacgaccatcggctatgggttccggtgcgtgacagaggagtgcccgctggcagtcatcgctgtggtggtccagtccatcgtgggctgcgtcatcgactccttcatgattggcaccatcatggccaagatggcgcggcccaagaagcgggcgcagacgttgctgttcagccaccacgcggtcatttcggtgcgcgacggcaagctctgcctcatgtggcgcgtgggcaacctgcgcaagagccacattgtggaggcccacgtgcgggcccagctcatcaagccctacatgacccaggagggcgagtacctgcccctggaccagcgggacctcaacgtgggctatgacatcggcctggaccgcatcttcctggtgtcgcccatcatcattgtccacgagatcgacgaggacagcccgctttatggcatgggcaaggaggagctggagtcggaggactttgagatcgtggtcatcctggagggcatggtggaggccacggccatgaccacccaggcccgcagctcctacctggccagcgagatcctgtggggccaccgctttgagcctgtggtcttcgaggagaagagccactacaaggtggactactcacgttttcacaagacctacgaggtggccggcacgccctgctgctcggcccgggagctgcaggagagtaagatcaccgtgctgcccgccccaccgccccctcccagtgccttctgctacgagaacgagctggcccttatgagccaggaggaagaggagatggaggaggaggcagctgcggcggccgcggtggccgcaggcctgggcctggaggcgggttccaaggaggaggcgggcatcatccggatgctggagttcggcagccacctggacctggagcgcatgcaggcttccctcccgctggacaacatctcctaccgcagggagtctgccatctgacctccaggcccggccctcaccactgcccacaagagcctctgccgggggtgggatgccaggacaccccctcccacactcaggacagagccaaccctggctccgtggaccttctggaggaaggtgggggtttcaaagactgggggaccccttcctcctgactccagcacccaggcctgggaagagctcggccccgatcagcctgagttccgccagcgcctacttctggtggctctaggtccccggatccaccacccttcccccactgactcttcaaggacgtgccctctttgctctcagaaccttggggaaggtggctggactgctgggcgggggacatctcggggtttcagggtgggcagggggttagtttggggaggggggggtgcgtttcttttgcatgactgtggcctgttgctcatgactttcttttgtaaatatctataaatggagacagatggagacaccaaa

SEQ ID NO: 53189 - DNA, 3029 bp, Homo sapiens
acatttaggagaaacagcggtgtctgcggctcccacccttcggggggcccgtggggggggcggtgtcaggggcatggacgccaccccccaggggtctctgctgccggctactctcctctccacgtgctcccctccaggacccccgacgccgcctaggcgcccagcgacgcgcggcaggtggcagcagctcgggcccccgccgcactccaggcgcccgcagcgctcgccctgacgcggccgccatggcgcaggagaacgcggccttctcgcccgggcaggaggagccgccgcggcgccgcggccgccagcgctacgtggagaaggatggccggtgcaacgtgcagcagggcaacgtgcgcgagacataccgctacctgacggacctgttcaccacgctggtggacctgcagtggcgcctcagcctgttgttcttcgtcctggcctacgcgctcacctggctcttcttcggcgccatctggtggctgatcgcctacggccgcggcgacctggagcacctggaggacaccgcgtggacgccgtgcgtcaacaacctcaacggcttcgtggccgccttcctcttctccatcgagaccgagaccaccatcggctacgggcaccgcgtcatcaccgaccagtgccccgagggcatcgtgctgctgctgctgcaggccatcctgggctccatggtgaacgccttcatggtgggctgcatgttcgtcaagatctcgcagcccaacaagcgcgcagccacgctcgtcttctcctcgcacgccgtggtgtcgctgcgcgacgggcgcctctgcctcatgttccgcgtgggcgacttgcgctcctcacacatagtggaggcctccatccgcgccaagctcatccgctcgcgccagacgctggagggcgagttcatcccgctgcaccagaccgacctcagcgtgggcttcgacacgggagacgaccgcctcttcctcgtctcgccgctggttatcagccacgagatcgacgccgccagccccttctgggaggcgtcgcgccgtgccctcgagagggacgacttcgagatcgtcgttatcctcgagggcatggtggaagccacgggaatgacatgccaagctcggagctcctacctggtagacgaggtgctgtggggccaccgcttcacgtcagtgctgactctggaggacggcttctacgaagtggactatgccagctttcacgagacttttgaggtgcccacaccttcgtgcagtgctcgagagctggcagaggctgccgcccgccttgatgcccatctctactggtccatccccagccggctggatgagaaggtggaggaggagggggcgggggagggggcgggtggggaagctggggctgacaaggagcagaatggctgcctgccacccccagagagtgagtccaaggtgtgaccagcttcctccagacccctgtggcagaccgggggccagacacagatacatggggaactgcatatcggaggtggtggaggaggaggaggaggaggaaggcaaagcccctggaaatgtgctaaagttggaaagtccccgtcccccagaacctcaagtctagaaaccagtatggaagggaggggtcctgatttcagggaaatggagggtggggccgggtgaaaatgccagtctgtgtttgaccttcacatttgttcatgagtggatggatggacagaatgatggacttttgggggttggatgggaagatggtagcagataaagacagctgacagatacatagatggaccagtagacaactggtccactcagggctgccactaacctgtagaacacccctgtgcaaattttaaaaaggaacccttttcctccagacagatacagccccaaaccagggtgcatggcttggggagcagagtataggatggattgcagtccccagtcacctcttctgccagcctccccacatatggcacaactgtctaatgacacggtaggccaagctgaagtgaaggagaaaggagccggaccaagatgggcacatgaggagggtgccctcctagctccaccctcaccaggatgaaggcgtgcaaggggctcagcaaggtgtgaatgaccttagtccgcaagttcagggaagcaggcagagcggggaggtgcctgagctggggcctggagaggggcctgggaaaggaaaaccagggatagctattttcttacagtggagtgagatcttacaggtatcaggcacaggcaggaagagagagagagaggttctggggaggaagggccaggagagagatctagaaagtgggttcactagagctgggaaacagggagcccctaggaaagcagtgtgtccttggggcacagtcattcacatcactgattgggtgccatgtggagtggacattcaaaaacctggttcctgtcctcaaaataaggggcacctgggaaaacagaggaatctacctgtggtgactgaacgagggataattcaaactgacaacctgtgcagtcccgtggagggtaggggagtgtgggtgatcagaaggctggggccagtgtaaggcatagggaatatgtaagtcaggagttagaaatctccagtgtgcgttggaatcacctggagggcttggtaaaacacagatttttgggctccactccaagggtttctgacccaagaggtggggaccaaaaccatgcattcctaagaagtccccaggtcatgctgctgttgctggactgaggaccacactttgagaacctgtgctctaagtgaatacttggaagtcgtttcaggacatggggcatagaaactgaggagtagctgagaggaagatgaagagaagctgagaagaagctgaggatcctcacaggagcagacagagaaatgtgaagggtggggttttatgtgtgggaaagggacccgaagcccaggctgaagagtttaactttgggcccagaaactcaaccatcaatggaaacagggcagtgacaagtggagggggtgtctggaagctgagcaggcccgacagagagatgaag

SEQ ID NO: 53190 - DNA, 2657 bp, Homo sapiens
ggtggtctgagctggagccacgctttctgttggagggggcagctgaaggagaacagcaagacatatccggcggccctacggactcggagagctggagggaccccggagatctcaaagggacaggaaaggcagcagcagccaccctctctcccagtcaagtggtcaccagcaggactgaaggggacagcccctttgcagtggctcggcgaggagacccctgcaccctagggtcagtgcaggagcccagccgctgagccatgccgggccccgggcggcctgcagcgagcccaacccctgcacccaggtagtcatgaacagccacagctacaatggcagcgtggggcggccgctgggcagcgggccgggcgccctgggacgagaccctccggaccctgaggccggccaccccccacaacccccgcacagcccgggcctccaggtggtagtggccaagagtgagccagcccggccctcacccggcagcccccgggggcagccccaggaccaggacgatgacgaggatgatgaggaagatgaggccggcaggcagagagcctcggggaaaccctcaaatgtgggccaccgcctgggccaccggcgggcgctcttcgagaagcggaagcgcctcagcgactatgccctcattttcggcatgtttggcatcgtcgtcatggtgacggagaccgagctgtcctggggggtgtacaccaaggagtctctgtactcattcgcactcaaatgcctcatcagcctctccacggccatcctgctgggtctcgttgtcctctaccatgcccgggagatccagctgttcatggtggacaacggggctgatgactggcgcatcgccatgacctgcgagcgcgtgttcctcatctcgctagagctggcagtgtgcgccattcacccggtgcccggccactaccgcttcacgtggacggcgcggctggccttcacgtacgcgccctcggtggccgaggccgacgtggacgtgctgctgtccatccccatgttcctgcgcctctacctgctgggccgggtgatgctactgcacagcaaaatcttcacggacgcctcgagccgcagcatcggggccctcaacaagatcaccttcaacacgcgcttcgtcatgaagacactcatgaccatctgccccggcaccgtgctgctggtcttcagcatctcctcctggatcatcgcagcctggaccgtgcgcgtctgcgagaggtaccacgacaagcaggaagtgaccagcaacttcctgggggccatgtggctgatttccatcaccttcctctccattggctacggcgacatggtgccccacacctactgcgggaagggtgtgtgcctgctcactggcatcatgggagctggctgtaccgcgctcgtggtggctgtggtggctcggaagctggagctcaccaaggctgagaagcacgtgcacaacttcatgatggacactcagctcaccaagcgggtaaaaaacgccgctgctaacgttctcagggagacgtggctcatctacaaacataccaggctggtgaagaagccagaccaagcccgggttcggaaacaccagcgtaagttcctccaagccatccatcaggctcagaagctccggagtgtgaagatcgagcaagggaagctgaacgaccaggctaacacgcttaccgacctagccaagacccagaccgtcatgtacgaccttgtatcggagctgcacgctcagcacgaggagctggaggcccgcctggccaccctggaaagccgcttggatgcgctgggtgcctctctacaggccctgcctggcctcatcgcccaagccatacgcccacccccgcctcccctgcctcccaggcccggccccggcccccaagaccaggcagcccggagctccccctgccggtggacgcccgtggccccctcggactgcgggtgacggccctgcccgccaccagacccctaaatcttggccatcgtgtggccgccacctccgggaagccttgtacagtggcgcctcttggagttcaagaagccaacgctgagtcaggctgagtggactgaggcctgccccgcccagactgcccaggcagagggcagggctggaccatgggtgagggcaggggagcccggagcttcctctggtcacctggtcccccgactctccccaggcccccggtgggcatggagcagcccggggaggggtccgtgctggttctgaataaagcaggacccgcctagtggctgcctgtgtgcatggctggaaggcactggtgatgtcccaggaggtagacctccagccctgggtaccaagatgaatgtgggaatcagaaaaacctgttcccatcaccggcctagcctagaatcctagcctagaagccctctctccctctgggctggagctcagtgagggacaactctctagggacacctgtaccagccccacctggcgctgagatccctcagacagcatggcccagccctggccagaagcatcgctccccttcaaccaaccgcgttgatggacacccactgtgtgccaggccccagcggggcccatgggggaggtgacctgggtgaggaaggtcatttgggtttttgtgagatttgtattgagcacctgctgtctacagagaatgtgatgatgtcaatta

SEQ ID NO: 53191 - DNA, 2905 bp, Homo sapiens
cgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaa
